US012746261B2

(12) United States Patent
Gangaiah et al.

(10) Patent No.: US 12,746,261 B2
(45) Date of Patent: Sep. 29, 2026

(54) **PROBIOTIC *BACILLUS* COMPOSITIONS AND METHODS OF USE**

(71) Applicant: BiomEdit, Inc., Fishers, IN (US)

(72) Inventors: Dharanesh Mahimapura Gangaiah, Fishers, IN (US); Arvind Kumar, Fishers, IN (US); Shrinivasrao Peerajirao Mane, Fishers, IN (US); Dwi Susanti, Fishers, IN (US); Alyssa Volland, Fishers, IN (US)

(73) Assignee: BiomEdit, Inc., Fishers, IN (US)

( * ) Notice: Subject to any disclaimer, the term of this patent is extended or adjusted under 35 U.S.C. 154(b) by 652 days.

(21) Appl. No.: 18/028,378

(22) PCT Filed: Sep. 24, 2021

(86) PCT No.: PCT/US2021/051973
§ 371 (c)(1),
(2) Date: Mar. 24, 2023

(87) PCT Pub. No.: WO2022/067052
PCT Pub. Date: Mar. 31, 2022

(65) Prior Publication Data

US 2023/0390346 A1 Dec. 7, 2023

Related U.S. Application Data

(60) Provisional application No. 63/083,697, filed on Sep. 25, 2020, provisional application No. 63/241,369, filed on Sep. 7, 2021.

(51) Int. Cl.

| | |
|---|---|
| ***A61K 35/742*** | (2015.01) |
| ***A23K 10/18*** | (2016.01) |
| ***A23K 50/30*** | (2016.01) |
| ***A23K 50/75*** | (2016.01) |
| ***A61K 9/00*** | (2006.01) |
| ***A61K 35/00*** | (2006.01) |
| ***A61K 39/00*** | (2006.01) |
| ***A61K 39/012*** | (2006.01) |
| ***A61P 39/00*** | (2006.01) |
| ***C12N 1/205*** | (2026.01) |
| ***C12R 1/07*** | (2006.01) |
| ***C12R 1/125*** | (2006.01) |

(52) U.S. Cl.
CPC ............ *A61K 35/742* (2013.01); *A23K 10/18* (2016.05); *A23K 50/75* (2016.05); *A61K 9/0056* (2013.01); *A61K 39/012* (2013.01); *A61P 39/00* (2018.01); *C12N 1/205* (2021.05); *A61K 2035/115* (2013.01); *C12R 2001/07* (2021.05); *C12R 2001/125* (2021.05)

(58) Field of Classification Search
None
See application file for complete search history.

(56) References Cited

U.S. PATENT DOCUMENTS

2020/0085069 A1 3/2020 Showell et al.
2020/0178540 A1 6/2020 Dagher et al.

FOREIGN PATENT DOCUMENTS

WO WO2019/206820 A1 10/2019

OTHER PUBLICATIONS

Chen et al., "*Bacillus amyloliquefaciens* strain LM2303 chromosome, complete genome", GenBank Accession CP018152.1; Dec. 6, 2016 [Retrieved on Nov. 30, 2021]. Retrieved from the internet: <URL: https://www.ncbi.nlm.gov/nuccore/CP018152.1/>; truncated: pp. 1-2.

*Primary Examiner* — S. Devi
(74) *Attorney, Agent, or Firm* — Hoffmann & Baron LLP

(57) ABSTRACT

The present invention relates to probiotic compositions and methods for improving animal health and animal production. The probiotic compositions include one, two, three, or more isolated strains of novel *Bacillus* strains which are capable of colonizing the gastrointestinal tract to improve the health of an animal. The probiotic compositions include a combination of at least one *Bacillus amyloliquefaciens* strain and a *Bacillus subtilis* strain.

15 Claims, 47 Drawing Sheets

Specification includes a Sequence Listing.

B

A

A B

C

ADG (Unchallenged)

| Treatment | Mean | % vs Basal |
|---|---|---|
| Basal | 59.9 | 0% |
| BMD | 61.8 | 3.3% |
| Combo1 | 61.0 | 2.0% |
| Combo2 | 60.3 | 0.7% |
| Combo3 | 61.9 | 3.4% |
| Combo4 | 59.3 | -1.0% |

MA-ADG (Unchallenged)

| Treatment | Mean | % vs Basal |
|---|---|---|
| Basal | 60.9 | 0% |
| BMD | 62.8 | 3.1% |
| Combo1 | 61.9 | 1.7% |
| Combo2 | 61.0 | 0.2% |
| Combo3 | 62.7 | 3.0% |
| Combo4 | 60.1 | -1.4% |

Worse Better

A B

C

ADFI (Unchallenged)

| Diet | Mean | % vs Basal | P-value |
|---|---|---|---|
| Basal | 99.8 | 0% | |
| BMD | 102.7 | 2.9% | **0.084** |
| Combo1 | 100.4 | 0.6% | 0.736 |
| Combo2 | 99.7 | -0.1% | 0.947 |
| Combo3 | 101.3 | 1.6% | 0.354 |
| Combo4 | 100.0 | 0.2% | 0.893 |

MA_ADFI (Unchallenged)

| Diet | Mean | % vs Basal |
|---|---|---|
| Basal | 97.4 | 0.0% |
| BMD | 99.3 | 2.0% |
| Combo1 | 98.1 | 0.7% |
| Combo2 | 97.3 | -0.1% |
| Combo3 | 99.1 | 1.8% |
| Combo4 | 97.5 | 0.0% |

Worse Better

C

FCR (Unchallenged)

| **Diet** | **Mean** | **% vs Basal** |
|---|---|---|
| Basal | 1.671 | 0% |
| BMD | 1.662 | -0.5% |
| Combo1 | 1.644 | -1.6% |
| Combo2 | 1.655 | -0.9% |
| Combo3 | 1.638 | -1.9% |
| Combo4 | 1.692 | 1.3% |

MA FCR (Unchallenged)

| **Rank** | **Mean** | **% vs Basal** |
|---|---|---|
| Basal | 1.603 | 0% |
| BMD | 1.583 | -1.3% |
| Combo1 | 1.584 | -1.2% |
| Combo2 | 1.597 | -0.4% |
| Combo3 | 1.581 | -1.3% |
| Combo4 | 1.626 | 1.5% |

Worse Better

C

EBI (unchallenged)

| **Diet** | **Mean** | **% vs Basal** |
|---|---|---|
| Basal | 351.7 | 0% |
| BMD | 364.2 | 3.6% |
| Combo1 | 364.0 | 3.5% |
| Combo2 | 362.9 | 3.2% |
| Combo3 | 376.9 | 7.2% |
| Combo4 | 346.3 | -1.5% |

Mortalities (unchallenged)

| **Diet** | **Mean** | **% vs Basal** |
|---|---|---|
| Basal | 2.1% | 0% |
| BMD | 4.8% | 125% |
| Combo1 | 1.9% | -10% |
| Combo2 | 1.4% | 33% |
| Combo3 | 1.4% | 33% |
| Combo4 | 2.4% | 12% |

Worse Better

A B C

D

Avg Lesion Scores

| Diet | Mean | % vs Basal | P-value |
|---|---|---|---|
| Basal | 1.37 | 0% | |
| BMD | 0.97 | -29% | 0.155 |
| Combo1 | 1.47 | 7% | 0.722 |
| Combo2 | 1.03 | -25% | 0.236 |
| Combo3 | 0.90 | -34% | **0.098** |
| Combo4 | 1.07 | -22% | 0.286 |

Lesion Scores 3+

| Diet | Mean | % vs Basal | P-value (ChiSq) |
|---|---|---|---|
| Basal | 24% | 0% | |
| BMD | 14% | -43% | 0.317 |
| Combo1 | 28% | 14% | 0.766 |
| Combo2 | 17% | -29% | 0.519 |
| Combo3 | 7% | -71% | **0.071** |
| Combo4 | 10% | -57% | 0.166 |

Worse Better

A B

C

ADG (NE)

| Diet | Mean | % vs Basal | P-value |
|---|---|---|---|
| Basal | 53.9 | 0% | |
| BMD | 58.2 | 7.9% | **0.001** |
| Combo1 | 56.5 | 4.7% | **0.049** |
| Combo2 | 55.9 | 3.6% | 0.128 |
| Combo3 | 58.0 | 7.6% | **0.002** |
| Combo4 | 55.3 | 2.5% | 0.288 |

MA ADG (NE)

| Diet | Mean | % vs Basal | P-value |
|---|---|---|---|
| Basal | 55.1 | 0% | |
| BMD | 59.2 | 7.4% | **0.001** |
| Combo1 | 58.1 | 5.4% | **0.016** |
| Combo2 | 57.2 | 3.7% | **0.091** |
| Combo3 | 59.7 | 8.2% | **0.004** |
| Combo4 | 56.8 | 2.9% | 0.180 |

Worse Better

A

B

C

ADFI (NE)

| Diet | Mean | % vs Basal | P-value |
|---|---|---|---|
| Basal | 95.0 | 0% | |
| BMD | 99.5 | 4.7% | **0.067** |
| Combo1 | 100.9 | 6.2% | **0.018** |
| Combo2 | 99.8 | 5.1% | **0.049** |
| Combo3 | 102.7 | 8.1% | **0.003** |
| Combo4 | 98.9 | 4.1% | 0.107 |

MA_ADFI (NE)

| Diet | Mean | % vs Basal | P-value |
|---|---|---|---|
| Basal | 90.6 | 0% | |
| BMD | 95.4 | 5.4% | **0.005** |
| Combo1 | 94.2 | 4.0% | **0.031** |
| Combo2 | 93.4 | 3.2% | **0.087** |
| Combo3 | 96.3 | 6.3% | **0.001** |
| Combo4 | 92.5 | 2.2% | 0.231 |

Worse Better

A

B

C

FCR (NE)

| Diet | Mean | % vs Basal |
|---|---|---|
| Basal | 1.763 | 0.0% |
| BMD | 1.709 | -3.1% |
| Combo1 | 1.788 | 1.4% |
| Combo2 | 1.787 | 1.4% |
| Combo3 | 1.770 | 0.4% |
| Combo4 | 1.792 | 1.6% |

MA FCR (NE)

| Diet | Mean | % vs Basal | P-value |
|---|---|---|---|
| Basal | 1.644 | 0.0% | |
| BMD | 1.612 | -1.9% | **0.082** |
| Combo1 | 1.622 | -1.3% | 0.221 |
| Combo2 | 1.635 | -0.5% | 0.617 |
| Combo3 | 1.613 | -1.8% | **0.096** |
| Combo4 | 1.632 | -0.7% | 0.500 |

Worse Better

A B

C

EBI (NE)

| Diet | Mean | % vs Basal |
|---|---|---|
| Basal | 228 | 0% |
| BMD | 257 | 12.7% |
| Combo1 | 209 | -8.4% |
| Combo2 | 217 | -5.0% |
| Combo3 | 225 | -1.7% |
| Combo4 | 205 | -10.2% |

NE Mortality

| Diet | Mean | % vs Basal |
|---|---|---|
| Basal | 12% | 0% |
| BMD | 10% | -15% |
| Combo1 | 19% | 54% |
| Combo2 | 17% | 35% |
| Combo3 | 18% | 46% |
| Combo4 | 17% | 38% |

Worse Better

| | Combo 3 (% diff vs Ctrl) | | BMD (% diff vs Ctrl) | |
|---|---|---|---|---|
| | Unchall. | NE | Unchall. | NE |
| ADG | 3.4% | 7.6% | 3.3% | 7.9% |
| MA_ADG | 3.0% | 8.2% | 3.1% | 7.4% |
| ADFI | 1.6% | 8.1% | 2.9% | 4.7% |
| MA_ADFI | 1.8% | 6.3% | 2.0% | 5.4% |
| FCR | -1.9% | 0.4% | -0.5% | -3.1% |
| MA_FCR | -1.3% | -1.8% | -1.3% | -1.9% |
| EBI | 7.2% | -1.7% | 3.6% | 12.7% |
| Survival | 0.7% | -6.5% | -2.7% | 2.2% |
| Lesion Score | n/a | -34% | n/a | -29% |
| Severe Lesions | n/a | -71% | n/a | -43% |

D

| | Final BW (kg) | | ADG (g) | | ADFI (g) | | Gain:Feed | |
|---|---|---|---|---|---|---|---|---|
| T01: Control | 18.29 | 0.0% | 299.5 | 0.0% | 494.6 | 0.0% | 0.6054 | 0.0% |
| T02: Conventional | 21.49 | 17.5% | 375.5 | 25.4% | 602.7 | 21.9% | 0.6185 | 2.2% |
| T08: 25+105+6 | 15.90 | -13.1% | 242.4 | -19.1% | 383.4 | -22.5% | 0.6307 | 4.2% |
| T09: 105+6+71 | 18.70 | 2.2% | 309.0 | 3.2% | 484.0 | -2.1% | 0.6367 | 5.2% |
| T10: 25+71 | 18.25 | -0.2% | 298.4 | -0.4% | 468.7 | -5.2% | 0.6370 | 5.2% |
| T11: 25+105 | 17.56 | -4.0% | 281.0 | -6.2% | 458.4 | -7.3% | 0.6035 | -0.3% |
| T12: 105+6 | 18.94 | 3.5% | 316.4 | 5.7% | 510.8 | 3.3% | 0.6202 | 2.4% |

D

| | O_fBW_kg | | O_ADG_g | | O_ADFI_g | | O_GF | |
|---|---|---|---|---|---|---|---|---|
| T01: Control | 18.29 | 0.0% | 299.5 | 0.0% | 494.6 | 0.0% | 0.605463 | 0.0% |
| T02: Conventional | 21.49 | 17.5% | 375.5 | 25.4% | 602.7 | 21.9% | 0.622988 | 2.9% |
| T08: 25+125+6 | 16.02 | -12.4% | 244.5 | -18.4% | 391.1 | -20.9% | 0.625143 | 3.3% |
| T09: 105+6+71 | 18.70 | 2.2% | 309.0 | 3.2% | 484.0 | -2.1% | 0.638356 | 5.4% |
| T10: 25+71 | 18.25 | -0.2% | 298.4 | -0.4% | 468.7 | -5.2% | 0.63649 | 5.1% |
| T11: 25+105 | 17.69 | -3.3% | 283.1 | -5.5% | 458.1 | -7.4% | 0.617881 | 2.1% |
| T12: 105+6 | 18.94 | 3.5% | 316.4 | 5.7% | 510.8 | 3.3% | 0.619485 | 2.3% |

A

B

Smaller Piglets: 3.9-5.7 kg

| | Ph3_fBW_kg | | O_ADFI_g | | O_ADG_g | | O_GF | |
|---|---|---|---|---|---|---|---|---|
| T01: Control | 16.4 | 0.0% | 443 | 0.0% | 269 | 0.0% | 0.607 | 0.0% |
| T02: Conventional | 17.8 | 8.7% | 506 | 14.3% | 305 | 13.5% | 0.603 | -0.7% |
| T08: 25+125+6 | 14.8 | -9.6% | 368 | -16.8% | 231 | -14.1% | 0.627 | 3.2% |
| T09: 105+6+71 | 17.5 | 7.0% | 463 | 4.6% | 296 | 10.0% | 0.639 | 5.2% |
| T10: 25+71 | 16.3 | -0.5% | 421 | -4.8% | 269 | -0.1% | 0.638 | 5.0% |
| T11: 25+105 | 17.8 | 8.6% | 477 | 7.7% | 302 | 12.4% | 0.634 | 4.4% |
| T12: 105+6 | 17.8 | 8.9% | 478 | 8.0% | 306 | 13.8% | 0.641 | 5.5% |

Larger Piglets: 5.7-7.9 kg

| | Ph3_fBW_kg | | O_ADFI_g | | O_ADG_g | | O_GF | |
|---|---|---|---|---|---|---|---|---|
| T01: Control | 20.6 | 0.0% | 556 | 0.0% | 336 | 0.0% | 0.604 | 0.0% |
| T02: Conventional | 25.0 | 21.4% | 694 | 24.8% | 442 | 31.6% | 0.637 | 5.5% |
| T08: 25+125+6 | 17.1 | -16.8% | 414 | -25.5% | 257 | -23.5% | 0.620 | 2.8% |
| T09: 105+6+71 | 19.8 | -4.0% | 503 | -9.5% | 317 | -5.5% | 0.630 | 4.4% |
| T10: 25+71 | 20.4 | -1.2% | 519 | -6.7% | 330 | -1.8% | 0.635 | 5.3% |
| T11: 25+105 | 17.6 | -14.5% | 439 | -21.0% | 264 | -21.4% | 0.600 | -0.5% |
| T12: 105+6 | 20.1 | -2.2% | 546 | -1.9% | 327 | -2.5% | 0.600 | -0.6% |

A

B

ADG

| | Small | Medium | Large |
|---|---|---|---|
| Conv | +23% | +29% | +21% |
| 105+6 | +18% | +5.4% | +1.8% |
| 105+6+71 | +18% | +5.4% | [illegible] |

FIG. 27
Phase 1
Day 0 to 7
Phase 2
Day 7 to 21
Phase 3
Day 21 to 42

Seabiscuit/Santana Dose Titration – ELA210123

Blend A = Santana
Blend B = Seabiscuit

| TG | Diet | Total Dose (CFU/g) | Dose/Strain (CFU/g) | Pens | Pigs | Total |
|---|---|---|---|---|---|---|
| T01 | Control | 0 | 0 | 10 | 5 | 50 |
| T02 | ZnO | 0 | 0 | 10 | 5 | 50 |
| T03 | Blend A | 75k | 25k | 10 | 5 | 50 |
| T04 | Blend A | 150k | 50k | 10 | 5 | 50 |
| T05 | Blend A | 300k | 100k | 10 | 5 | 50 |
| T06 | Blend B | 75k | 25k | 10 | 5 | 50 |
| T07 | Blend B | 150k | 50k | 10 | 5 | 50 |
| T08 | Blend B | 300k | 100k | 10 | 5 | 50 |
| | | | | **80** | | **400** |

FIG. 29E

| Comparison | | ADFI | | | | ADG | | | | Gain:Feed | | | |
|---|---|---|---|---|---|---|---|---|---|---|---|---|---|
| | | % Diff (mean) | P-value (T-test) | % Diff (median) | P-value (Wilcoxon) | % Diff (mean) | P-value (T-test) | % Diff (median) | P-value (Wilcoxon) | % Diff (mean) | P-value (T-test) | % Diff (median) | P-value (Wilcoxon) |
| Blend A - 150k | Control | 9.5% | 0.149 | 5.6% | 0.045 | 14.4% | 0.083 | 18.7% | 0.031 | 3.9% | 0.340 | 5.4% | 0.241 |
| Blend B - 75k | Control | 10.7% | 0.107 | 6.7% | 0.064 | 18.4% | 0.168 | 17.7% | 0.045 | 6.8% | 0.107 | 8.1% | 0.076 |
| Blend B - 75k | Blend A - 150k | 1.1% | 0.852 | 1.0% | 0.910 | 3.5% | 0.693 | -0.8% | 0.791 | 2.8% | 0.483 | 2.6% | 0.521 |

| Comparison | | ADG | |
|---|---|---|---|
| | | % Diff (mean) | P-value (t-test) |
| Blend A - 150k | Control | 13.9% | 0.097 |
| Blend B - 75k | Control | 18.2% | 0.030 |
| Blend B - 75k | Blend A - 150k | 3.8% | 0.605 |

% of pigs with bodyweight within 15% of pen average

A B

C

| Comparison | | BW Uniformity % Diff (mean) | P-value (t-test) |
|---|---|---|---|
| Blend A - 150k | Control | 4.1% | 0.813 |
| Blend B - 75k | Control | 32% | 0.074 |
| Blend B - 75k | Blend A - 150k | 27%% | 0.117 |

FIG. 33

Dose Titration Study Design & Power

| TG | Challenge | Diet | Total Dose (CFU/g) | Dose/Strain (CFU/g) | Pens | Birds | Total |
|---|---|---|---|---|---|---|---|
| T01 | None | Basal | 0 | 0 | 15 | 18 | 270 |
| T02 | NE | Basal | 0 | 0 | 15 | 18 | 270 |
| T03 | NE | BMD | 0 | 0 | 15 | 18 | 270 |
| T04 | NE | DFM | 50k | 17k | 15 | 18 | 270 |
| T05 | NE | DFM | 100k | 33k | 15 | 18 | 270 |
| T06 | NE | DFM | 200k | 67k | 15 | 18 | 270 |
| T07 | NE | DFM | 400k | 133k | 15 | 18 | 270 |
| T08 | NE | DFM | 600k | 200k | 15 | 18 | 270 |
| | | | | | **120** | | **2,160** |

| | ADG | FCR | EBI | Lesion Scores |
|---|---|---|---|---|
| **6 Doses (n=15)** | **5.6%** | **3.3%** | **11.7%** | **60.0%** |
| DLL Target | | 3.6% | | |
| Previously Observed | 2-8% | 0-8% | 0-16% | 14-34% |

| Design | Group N | Total N | Power | Avg. R |
|---|---|---|---|---|
| **6 Doses** | **15** | **90** | **98.8%** | **0.437** |

A

B

A B C D

E

| Parameter | Control | Bacillus Combo | % Diff. | P-value |
|---|---|---|---|---|
| Mortality (%) | 26.3 | 11.6 | -55% | <0.0001 |
| **FCR** | **1.822** | **1.671** | **-8.3% (15pts)** | **<0.0001** |
| MA_FCR | 1.657 | 1.625 | -1.9% (3 pts) | 0.0078 |
| EBI | 245 | 316 | +29% | <0.0001 |

A

| | Clindamycin | Chloramphenicol | Erythromycin | Gentamicin | Kanamycin | Streptomycin | Tetracycline | Vancomycin | Ampicillin |
|---|---|---|---|---|---|---|---|---|---|
| EFSA threshold, μg/mL | 4 | 8 | 4 | 4 | 8 | 8 | 8 | 4 | NR* |
| *Ba* ELA006 | 0.25 | 4 | 0.12 | 0.12 | 0.5 | 2 | 4 | 0.5 | ≤0.06 |
| *Ba* PTA84 | 0.25 | 4 | 0.12 | 0.12 | 0.5 | 2 | 4 | 0.5 | ≤0.06 |
| *Ba* PTA85 | 0.25 | 2 | 0.12 | 0.12 | 0.5 | 2 | 4 | 0.5 | ≤0.06 |
| *Ba* ELA071 | 0.5 | 4 | 0.12 | 0.12 | 0.5 | 2 | 2 | 0.5 | ≤0.06 |
| *Ba* ELA151 | 1 | 4 | 0.12 | 0.25 | 0.5 | 4 | 8 | 0.5 | ≤0.06 |
| *Ba* ELA175 | 0.25 | 4 | 0.12 | 0.12 | 0.5 | 2 | 4 | 0.5 | ≤0.06 |
| *Bs* ELA082 | 1 | 4 | 0.12 | 0.25 | 1 | 16 | 4 | 0.5 | ≤0.06 |
| *Bs* PTA86 | 2 | 2 | ≤0.06 | 0.12 | 1 | 4 | 4 | 0.5 | ≤0.06 |

Sensitive   Borderline resistance

B

PROBIOTIC *BACILLUS* COMPOSITIONS AND METHODS OF USE

CROSS REFERENCE TO RELATED APPLICATIONS

The present application is a national stage application which claims priority from PCT Application No. PCT/US2021/051973 filed Sep. 24, 2021, which in turn claims priority from U.S. Provisional Application Ser. No. 63/083,697 filed Sep. 25, 2020, and U.S. Provisional Application Ser. No. 63/241,369 filed Sep. 7, 2021. Applicant claims the benefits of 35 U.S.C. § 120 as to the PCT application and priority under 35 U.S.C. § 119 as to the said U.S. Provisional applications, and the entire disclosures of all applications are incorporated herein by reference in their entireties.

SEQUENCE LISTING

This application contains a Sequence Listing, which was submitted in ASCII format via EFS-Web, and is hereby incorporated by reference in its entirely. The ASCII copy, created on Oct. 1, 2025, is named "2950-16 PCTUS Sequence Listing_ST25" and is 43,202,900 bytes in size.

FIELD OF THE INVENTION

The present invention relates to probiotic compositions and methods for improving animal health. The probiotic compositions include one or more isolated strains of *Bacillus* sp. which colonizes the gastrointestinal tract to improve the health and production performance of an animal.

BACKGROUND

Direct fed microbials (DFMs), often also called probiotics, are microorganisms which colonize the gastrointestinal tract of an animal and provide some beneficial effect to that animal. The microorganisms can be bacterial species, for example those from the genera *Bacillus, Lactobacillus, Lactococcus*, and *Enterococcus*. The microorganisms can also be yeast or even molds. The microorganisms can be provided to an animal orally or mucosally or, in the case of birds, provided to a fertilized egg, i.e. in ovo.

The beneficial activity provided by a DFM can be through the synthesis and secretion of vitamins or other nutritional molecules needed for a healthy metabolism of the host animal. A DFM can also protect the host animal from disease, disorders, or clinical symptoms caused by pathogenic microorganisms or other agents. For example, the DFM may naturally produce factors having inhibitory or cytotoxic activity against certain species of pathogens, such as deleterious or disease-causing bacteria.

Probiotics and DFMs provide an attractive alternative or addition to the use and application of antibiotics in animals. Antibiotics can promote resistant or less sensitive bacteria and can ultimately end up in feed products or foods consumed by other animals or humans.

There is a need in the art for probiotic compositions and methods that provide improved delivery of beneficial molecules to the gastrointestinal tract of an animal and thus improve animal health.

The citation of references herein shall not be construed as an admission that such is prior art to the present invention.

SUMMARY OF THE INVENTION

The invention provides compositions and methods for improving animal health and animal production and performance.

In one embodiment, the invention provides a probiotic composition having at least one of: a first isolated *Bacillus amyloliquefaciens* strain, a second isolated *Bacillus amyloliquefaciens* strain, and a first isolated *Bacillus subtilis* strain; and a carrier suitable for animal administration; wherein said composition reduces or inhibits the colonization of an animal by a pathogenic bacterium when an effective amount is administered to an animal, as compared to an animal not administered the composition.

In an embodiment, the first isolated *Bacillus amyloliquefaciens* strain includes a nucleic acid sequence having at least 95%, at least 96%, at least 97%, at least 98%, or at least 99% sequence identity with at least one of: SEQ ID NO: 59, 61, 63, 65, 67, 69, 71, 73, 1, 2, 3, 4, and 5. In an embodiment, the second *Bacillus amyloliquefaciens* strain includes a nucleic acid sequence having at least 95%, at least 96%, at least 97%, at least 98%, or at least 99% sequence identity with at least one of: SEQ ID NO: 133, 135, 137, 139, 141, 143, 145, 147, 6, 7, 8, 9, 10, and 11. In an embodiment, the first isolated *Bacillus amyloliquefaciens* strain includes a nucleic acid sequence having at least 95%, at least 96%, at least 97%, at least 98%, or at least 99% sequence identity with SEQ ID NO: 261. In an embodiment, the first isolated *Bacillus amyloliquefaciens* strain includes a nucleic acid sequence having at least 95%, at least 96%, at least 97%, at least 98%, or at least 99% sequence identity with SEQ ID NO: 261 and having a nucleic acid sequence having least 95%, at least 96%, at least 97%, at least 98%, or at least 99% sequence identity with at least one of a nucleic acid sequence encoding a polypeptide or amino acid sequence SEQ ID NO: 263, 264, 265, 266, 267, 268, 269, 270, 271, 272, 273, 274, 275 and 276. In an embodiment, the second isolated *Bacillus amyloliquefaciens* strain includes a nucleic acid sequence having at least 95%, at least 96%, at least 97%, at least 98%, or at least 99% sequence identity with SEQ ID NO: 262. In an embodiment, the second isolated *Bacillus amyloliquefaciens* strain includes a nucleic acid sequence having at least 95%, at least 96%, at least 97%, at least 98%, or at least 99% sequence identity with SEQ ID NO: 262 and having a nucleic acid sequence having least 95%, at least 96%, at least 97%, at least 98%, or at least 99% sequence identity with at least one of a nucleic acid sequence encoding a polypeptide or amino acid sequence SEQ ID NO: 277, 278, 279, 280, 281, 282, 283 and 284.

In an embodiment, the first *Bacillus subtilis* strain includes a nucleic acid sequence having least 95%, at least 96%, at least 97%, at least 98%, or at least 99% sequence identity with at least one of: SEQ ID NO:257, 253, 251, 249, 247, 245, 243, 12, 13, 14, 15, and 16. In an embodiment, the first *Bacillus subtilis* strain includes a nucleic acid sequence having least 95%, at least 96%, at least 97%, at least 98%, or at least 99% sequence identity with at least one of 12, 13, 14, 15, and 16, In an embodiment, the first *Bacillus subtilis* strain includes a nucleic acid sequence having least 95%, at least 96%, at least 97%, at least 98%, or at least 99% sequence identity with at least one of 12, 13, 14, 15, and 16 and having a nucleic acid sequence having least 95%, at least 96%, at least 97%, at least 98%, or at least 99% sequence identity with at least one of a nucleic acid sequence encoding a polypeptide or amino acid sequence SEQ ID NO: 285, 286, 287, 288, 289, 290, 291, 292, 293, 294, 295, 296, 297, 298, 299, 300, 301, 302, 303, 304 and 305.

In an embodiment, the invention provides a feed additive comprising a combination of *Bacillus* strains. In one embodiment the feed additive comprises lyophilized or otherwise dried spores or spore forms of a combination of *Bacillus* strains. In one embodiment, the feed additive comprising a combination of one or more isolated *Bacillus amyloliquefaciens* strain and an isolated *Bacillus subtilis* strain. In one embodiment, the feed additive comprises a combination of a first isolated *Bacillus amyloliquefaciens* strain, a second isolated *Bacillus amyloliquefaciens* strain, and a first isolated *Bacillus subtilis* strain. In an embodiment, the additive further comprises a carrier suitable for animal administration. In one embodiment, the feed additive further comprises a nutritional source such as a sugar. In one embodiment, the feed additive further comprises a prebiotic. In an embodiment, the feed additive is a probiotic feed additive and comprises a combination of a first isolated *Bacillus amyloliquefaciens* strain, a second isolated *Bacillus amyloliquefaciens* strain, and a first isolated *Bacillus subtilis* strain; and a carrier suitable for animal administration; wherein said composition reduces or inhibits the colonization of an animal by a pathogenic bacterium when an effective amount is administered to an animal, as compared to an animal not administered the composition.

In an embodiment, the first isolated *Bacillus amyloliquefaciens* strain includes a nucleic acid sequence having at least 95%, at least 96%, at least 97%, at least 98%, or at least 99% sequence identity with at least one of: SEQ ID NO: 59, 10 61, 63, 65, 67, 69, 71, 73, 1, 2, 3, 4, and 5. In an embodiment, the second *Bacillus amyloliquefaciens* strain includes a nucleic acid sequence having at least 95%, at least 96%, at least 97%, at least 98%, or at least 99% sequence identity with at least one of: SEQ ID NO: 133, 135, 137, 139, 141, 143, 145, 147, 6, 7, 8, 9, 10, and 11. In an embodiment, the first isolated *Bacillus amyloliquefaciens* strain includes a nucleic acid sequence having at least 95%, at least 96%, at least 97%, at least 98%, or at least 99% sequence identity with SEQ ID NO: 261. In an embodiment, the first isolated *Bacillus amyloliquefaciens* strain includes a nucleic acid sequence having at least 95%, at least 96%, at least 97%, at least 98%, or at least 99% sequence identity with SEQ ID NO: 261 and having a nucleic acid sequence having least 95%, at least 96%, at least 97%, at least 98%, or at least 99% sequence identity with at least one of a nucleic acid sequence encoding a polypeptide or amino acid sequence SEQ ID NO: 263, 264, 265, 266, 267, 268, 269, 270, 271, 272, 273, 274, 275 and 276. In an embodiment, the second isolated *Bacillus amyloliquefaciens* strain includes a nucleic acid sequence having at least 95%, at least 96%, at least 97%, at least 98%, or at least 99% sequence identity with SEQ ID NO: 262. In an embodiment, the second isolated *Bacillus amyloliquefaciens* strain includes a nucleic acid sequence having at least 95%, at least 96%, at least 97%, at least 98%, or at least 99% sequence identity with SEQ ID NO: 262 and having a nucleic acid sequence having least 95%, at least 96%, at least 97%, at least 98%, or at least 99% sequence identity with at least one of a nucleic acid sequence encoding a polypeptide or amino acid sequence SEQ ID NO: 277, 278, 279, 280, 281, 282, 283 and 284.

In an embodiment, the feed additive comprises a first isolated *Bacillus amyloliquefaciens* strain including ELA191024 or a second isolated *Bacillus amyloliquefaciens* strain including ELA191036, and a first isolated *Bacillus subtilis* strain including ELA191105. In an embodiment, the feed additive includes a first isolated *Bacillus amyloliquefaciens* strain including ELA191024 or a second isolated *Bacillus amyloliquefaciens* strain including ELA191006, and a first isolated *Bacillus subtilis* strain including ELA 191105. In some embodiments, the feed additive includes a first isolated *Bacillus amyloliquefaciens* strain ELA191024 or ELA191006, a second isolated *Bacillus amyloliquefaciens* strain including ELA202071, and a first isolated *Bacillus subtilis* strain including ELA191105. In some embodiments, the feed additive includes a first isolated *Bacillus* arnyloliquefaciens strain ELA191024, a second isolated *Bacillus amyloliquefaciens* strain including ELA202071, and a first isolated *Bacillus subtilis* strain including ELA191105. In some embodiments, the feed additive includes a first isolated *Bacillus amyloliquefaciens* strain ELA191006, a second isolated *Bacillus amyloliquefaciens* strain including ELA202071, and a first isolated *Bacillus subtilis* strain including ELA191105.

In an embodiment, the feed additive comprises a combination of at least two *Bacillus* strains provided herein. In one such embodiment, the feed additive comprises a combination of spore forms of at least two *Bacillus* strains provided herein.

In another embodiment of the invention, an animal feed is provided comprises a combination of at least two *Bacillus* strains provided herein. In one such embodiment, the feed additive comprises a combination of spore forms of at least two *Bacillus* strains provided herein. In an embodiment, the animal feed further comprises at least one nutritional source, such as sugar or amino acid(s). In one embodiment, the animal feed further comprises a prebiotic.

In an embodiment, the feed additive or animal feed is suitable and formulated for an animal selected from a human, poultry, cattle, cat, dog, horse, swine or fish.

In embodiments, the feed additive or animal feed is suitable for and applicable in the methods provided herein.

In one embodiment, the invention provides a method for reducing or inhibiting the colonization of an animal by a pathogenic bacterium. In one embodiment, the invention provides a method for reducing or inhibiting the colonization of the gut or gastrointestinal tract (GIT) of an animal by a pathogenic bacterium. The method includes administering to an animal an effective amount of a probiotic composition described above and herein. In an embodiment, the probiotic composition comprises a non natural and unique combination of *Bacillus* bacteria strains. The method includes administering to an animal an effective amount of a feed additive or animal feed described above and herein. In an embodiment, the feed additive or animal feed comprises a non natural and unique combination of *Bacillus* bacteria strains.

In one embodiment, the invention provides a method of treating necrotic enteritis in poultry by administering to poultry a probiotic composition described above and herein.

In one embodiment, the invention provides a method of preparing a fermentation product. The method includes the steps of (a) obtaining at least one bacterial strain selected from a first isolated *Bacillus amyloliquefaciens* strain described above and herein, a second isolated *Bacillus amyloliquefaciens* strain described above and herein, and a first isolated *Bacillus subtilis* strain described above and herein; (b) contacting the at least one strain of step (a) with cell growth media; (c) incubating a combination of at least one strain of step (a) and cell growth media of step (b) at a temperature of about 37° C. for an incubation time of about 24 hours; and (d) cooling the combination of step (c); wherein the product of step (d) includes the fermentation product.

In one embodiment, the invention provides a method of delivering a metabolite to the gut of an animal. The method includes administering to an animal a probiotic composition having a first isolated *Bacillus amyloliquefaciens* strain and a second isolated *Bacillus amyloliquefaciens* strain described above and herein. The metabolite includes at least one of: histidine, N-acetylhistidine, phenyllactate (PLA), I-carboxyethyltyrosine, 3-(4-hydroxyphenyl)lactate 5

(HPLA), tryptophan, N-acetyltryptophan, anthranilate, indolelactate, isovalerylglycine, N-acetylisoleucine, N-acetylmethionine, urea, ornithine, spermidine, spermine, cysteinylglycine, pyruvate, sucrose, fumarate, deoxycarnitine, 2R,3R-dihydroxybutyrate, chiro-inositol, glycerophosphorylcholine (GPC), 5-aminoimidazole-4-carboxamide, xanthine, AMP, 2'-deoxyadenosine, dihydroorotate, UMP, uridine, CMP, cytidine, (3'-5')-adenylyluridine, (3'-5')-cytidylyladenosine, (3'-5')-cytidylylcytidine, (3'-5')-cytidylyluridine, (3'-5')-guanylylcytidine, (3'-5')-guanylyluridine, (3'-5')-uridylylcytidine, (3'-5)-uridylyluridine, (3'-5')-uridylyladenosine, NAD+, oxalate (ethanedioate), maltol, 1-methylhistidine, N6,N6-dimethyllysine, S-methylcysteine, and 2-methylcitrate.

The metabolite is secreted by the combination of the first *Bacillus amyloliquefaciens* strain and the second isolated *Bacillus amyloliquefaciens* strain.

In one embodiment, the invention provides a method of delivering a metabolite to the gut of an animal by administering a probiotic composition having a first isolated *Bacillus amyloliquefaciens* strain, a second isolated *Bacillus amyloliquefaciens* strain, and a first isolated *Bacillus subtilis* strain, as described herein and above. The metabolite includes at least one of: N-carbamoylserine, beta-citrylglutamate, N6-methyllysine, N6,N6-dimethyllysine, N6,N6,N6-trimethyllysine, saccharopine, cadaverine, N-succinylphenylalanine, 2-hydroxyphenylacetate, 3-(4-hydroxyphenyl)lactate (HPLA), N-acetyltryptophan, indolelactate, N-acetylleucine, 4-methyl-2-oxopentanoate, homocitrulline, dimethylarginine (ADMA+SDMA), N-monomethylarginine, guanidinoacetate, N(1)-acetylspermine, glucose 6-phosphate, Isobar: hexose diphosphates, ribitol, arabonate/xylonate, ribulonate/xylulonate/lyxonate, fructose, galactonate, isocitric lactone, fumarate, malate, 3-hydroxyhexanoate, 5-hydroxyhexa.noate, myo-inositol, chiro-inositol glycerophosphoethanolamine, glycerophosphoinositol, 3-hydroxy-3-methylglutarate, Mevalonate, 5-arninoimidazole-4-carboxamide, 2-AMP, 2'-O-methyladenosine, N6-succinyladenosine, guanosine 2'-monophosphate (2'-GMP), 2'-O-methyluridine, uridine 2'-monophosphate (2'-UMP), 5-methylcytosine, pantoate, pantothenate (Vitamin B5), glucarate (saccharate), hippurate, histidinol, homocitrate, pyrraline, 2-keto-3-deoxy-gluconate, pentose acid, N,N-dimethylalanine, Isobar: hexose diphosphates, 2-methylcitrate, and (3-5')-adenylylguanosine.

The metabolite is secreted by the combination of the first *Bacillus amyloliquefaciens* strain, the second isolated *Bacillus amyloliquefaciens* strain, and the first *Bacillus subtilis* strain.

In some embodiments, a composition of the invention includes a first isolated *Bacillus amyloliquefaciens* strain including ELA191024 and a second isolated *Bacillus amyloliquefaciens* strain including ELA191036. In some embodiments, the composition includes a first isolated *Bacillus amyloliquefaciens* strain ELA191024 and a second isolated *Bacillus amyloliquefaciens* strain ELA191036. In some embodiments, the composition includes a first isolated *Bacillus amyloliquefaciens* strain ELA191024 and a second isolated *Bacillus amyloliquefaciens* strain ELA202071. In some embodiments, the composition includes a first isolated *Bacillus amyloliquefaciens* strain ELA191006 and a second isolated *Bacillus amyloliquefaciens* strain ELA202071.

In some embodiments, the composition includes a first isolated *Bacillus amyloliquefaciens* strain including ELA191024 or a second isolated *Bacillus amyloliquefaciens* strain including ELA191036, and a first isolated *Bacillus subtilis* strain including ELA 191105. In some embodiments, the composition includes a first isolated *Bacillus amyloliquefaciens* strain including ELA191024 or a second isolated *Bacillus amyloliquefaciens* strain including ELA191006, and a first isolated *Bacillus subtilis* strain including ELA191105. In some embodiments, the composition includes a first isolated *Bacillus amyloliquefaciens* strain ELA191024 or ELA191006, a second isolated *Bacillus amyloliquefaciens* strain including ELA202071, and a first isolated *Bacillus subtilis* strain including ELA191105. In some embodiments, the composition includes a first isolated *Bacillus amyloliquefaciens* strain ELA191024, a second isolated *Bacillus amyloliquefaciens* strain including ELA202071, and a first isolated *Bacillus subtilis* strain including ELA191105. In some embodiments, the composition includes a first isolated *Bacillus amyloliquefaciens* strain ELA191006, a second isolated *Bacillus amyloliquefaciens* strain including ELA202071, and a first isolated *Bacillus subtilis* strain including ELA191105.

In embodiments of the invention, a *Bacillus amyloliquefaciens* strain ELA191024 corresponding to ATCC deposit PTA-126784 is provided. In an embodiment, *Bacillus amyloliquefaciens* strain ELA191036 corresponding to ATCC deposit PTA-126785 is provided. In an embodiment, *Bacillus amyloliquefaciens* strain ELA191006 corresponding to ATCC deposit PTA-127065 is provided. In an embodiment, *Bacillus amyloliquefaciens* strain ELA202071 corresponding to ATCC deposit PTA-127064 is provided. In an embodiment, *Bacillus subtilis* strain ELA191105 corresponding to ATCC deposit PTA-126786 is provided.

In an embodiment of the invention, a probiotic composition or direct feed microbial is provided which comprises a combination of at least two *Bacillus* strains. In embodiments, the *Bacillus* strains are selected from ELA 191024 or a *Bacillus* strain having at least 90% identity, 95% identity, 97% identity, 98% identity, 99% identity in genomic sequence to one or more of SEQ ID NO: 1, 2, 3, 4 and 5; ELA191036 or a *Bacillus* strain having at least 90% identity, 95% identity, 97% identity, 98% identity, 99% identity in genomic sequence to one or more of SEQ ID NO: 6, 7, 8, 9, 10 and 11; ELA191006 or a *Bacillus* strain having at least 90% identity, 95% identity, 97% identity, 98% identity, 99% identity in genomic sequence to the sequence of SEQ ID NO: 261; ELA202071 or a *Bacillus* strain having at least 90% identity, 95% identity, 97% identity, 98% identity, 99% identity in genomic sequence to the sequence of SEQ ID NO: 262; and ELA191105 or a *Bacillus* strain having at least 90% identity, 95% identity, 97% identity, 98% identity, 99% identity in genomic sequence to one or more of SEQ ID NO: 12, 13, 14, 15 and 16.

In an embodiment of the invention, a probiotic composition or direct feed microbial is provided which comprises a combination of ELA191024, ELA191036 and ELA191105. In an embodiment of the invention, a probiotic composition or direct feed microbial is provided which comprises a combination of ELA191006, ELA191036 and ELA191105. In an embodiment of the invention, a probiotic composition or direct feed microbial is provided which comprises a combination of ELA191006, ELA202071 and ELA191105. In an embodiment of the invention, a probiotic composition or direct feed microbial is provided which comprises a combination of ELA 191024, ELA202071 and ELA191105.

In some embodiments, the invention relates to related, homologous or derivative *Bacillus* strains having significant genome sequence identity to the genome sequence of any of *Bacillus amyloliquefaciens* strain ELA191024 corresponding to ATCC deposit PTA-126784, *Bacillus amyloliquefaciens* strain ELA191036 corresponding to ATCC deposit PTA-126785, *Bacillus amyloliquefaciens* strain ELA191006 corresponding to ATCC deposit PTA-127065, *Bacillus amyloliquefaciens* strain ELA202071 corresponding to ATCC deposit PTA-127064, and/or *Bacillus subtilis* strain ELA 191105. Thus, derivative or similar or nearly genetically identical strains to the *Bacillus* strains provided herein are contemplated by and additional embodiments of the invention. *Bacillus* strains having 80% identity, 85% identity, 90% identity, 95% identity, 97% identity, 98% identity, 99% identity in genomic sequence to a strain provided and deposited in association with this invention are contemplated and are embodiments of the invention. Such derivative or similar or nearly genetically identical strains must similarly function as probiotics and have activity/capability or function in improving animal health and animal production and performance, including as detailed in the capability and activity or function of the strains and examples hereof. Exemplary of this embodiment, it is noted that *Bacillus amyloliquefaciens* strain ELA191024 corresponding to ATCC deposit PTA-126784 and *Bacillus amyloliquefaciens* strain ELA191006 corresponding to ATCC deposit PTA-127065 are genetically related or similar strains, demonstrating 99% identity in genome sequence.

In embodiments, the *Bacillus* strains are selected from ELA191024 corresponding to ATCC deposit PTA-126784 or a *Bacillus* strain having at least 90% identity, 95% identity, 97% identity, 98% identity, 99% identity in genomic sequence to the sequence of ELA191024 corresponding to ATCC deposit PTA-126784; ELA191036 corresponding to ATCC deposit PTA-126785 or a *Bacillus* strain having at least 90% identity, 95% identity, 97% identity, 98% identity, 99% identity in genomic sequence to the sequence of ELA191036 corresponding to ATCC deposit PTA-126785; ELA191006 corresponding to ATCC deposit PTA-127065 or a *Bacillus* strain having at least 90% identity, 95% identity, 97% identity, 98% identity, 99% identity in genomic sequence to the sequence of ELA191006 corresponding to ATCC deposit PTA-127065; ELA202071 corresponding to ATCC deposit PTA-127064 or a *Bacillus* strain having at least 90% identity, 95% identity, 97% identity, 98% identity, 99% identity in genomic sequence to the sequence of ELA202071 corresponding to ATCC deposit PTA-127064; and ELA191105 corresponding to ATCC deposit PTA-126786 or a *Bacillus* strain having at least 90% identity, 95% identity, 97% identity, 98% identity, 99% identity in genomic sequence to the sequence of ELA 191105 corresponding to ATCC deposit PTA-126786.

In accordance with one embodiment of the invention, a probiotic composition is provided comprising at least one of: a first isolated *Bacillus amyloliquefaciens* strain, a second isolated *Bacillus amyloliquefaciens* strain, and a first isolated *Bacillus subtilis* strain; and a carrier suitable for animal administration; wherein said composition reduces or inhibits the colonization of an animal by a pathogenic bacterium when an effective amount is administered to an animal, as compared to an animal not administered the composition; and wherein the first isolated *Bacillus amyloliquefaciens* strain comprises a nucleic acid sequence having at least 95%, at least 96%, at least 97%, at least 98%, or at least 99% sequence identity with SEQ ID NO: 59, or wherein the first isolated *Bacillus amyloliquefaciens* strain comprises a nucleic acid sequence having at least 95%, at least 96%, at least 97%, at least 98%, or at least 99% sequence identity with SEQ ID NO: 261, and/or with nucleic acid encoding one or more protein of SEQ ID NO: 263-276;

wherein the second *Bacillus amyloliquefaciens* strain comprises a nucleic acid sequence having at least 95%, at least 96%, at least 97%, at least 98%, or at least 99% sequence identity with SEQ ID NO: 133, or wherein the second *Bacillus amyloliquefaciens* strain comprises a nucleic acid sequence having at least 95%, at least 96%, at least 97%, at least 98%, or at least 99% sequence identity with SEQ ID NO: 262, and/or with nucleic acid encoding one or more protein of SEQ ID NO: 277-284;

wherein the first *Bacillus subtilis* strain comprises a nucleic acid sequence having at least 95%, at least 96%, at least 97%, at least 98%, or at least 99% sequence identity with SEQ ID NO:257, or with a nucleic acid sequence encoding one or more protein of SEQ ID NO: 285-305.

In an embodiment, the composition comprises at least two of: the first isolated *Bacillus amyloliquefaciens* strain, the second isolated *Bacillus amyloliquefaciens* strain, and the first isolated *Bacillus subtilis* strain. In an embodiment, the composition comprises the first isolated *Bacillus amyloliquefaciens* strain, the second isolated *Bacillus amyloliquefaciens* strain, and the first isolated *Bacillus subtilis* strain.

In an embodiment of the composition, the carrier is selected from edible food grade material, mineral mixture, gelatin, cellulose, carbohydrate, starch, glycerin, water, rice hulls, glycol, molasses, calcium carbonate, whey, sucrose, dextrose, soybean oil, vegetable oil, sesame oil, and corn oil.

In an embodiment, the composition does not comprise *Lactobacillus*. In an embodiment, the composition does not comprise non-*Bacillus* strains. In an embodiment, *Bacillus amyloliquefaciens* and/or *Bacillus subtilis* are the only bacterial strains in the composition.

In one embodiment of the composition, the first *Bacillus amyloliquefaciens* strain comprises at least one of:

a nucleic acid sequence having at least 95%, at least 96%, at least 97%, at least 98%, or at least 99% sequence identity with SEQ ID NO: 61, 63, 65, 67, 69, 71, or 73, or a nucleic acid sequence having at least 95%, at least 96%, at least 97%, at least 98%, or at least 99% sequence identity with nucleic acid encoding a protein of SEQ ID NO: 263, 264, 265, 266, 267, 268, 269, 270, 271, 272, 273, 274, 275, or 276; and wherein the second *Bacillus amyloliquefaciens* strain comprises at least one of:

a nucleic acid sequence having at least 95%, at least 96%, at least 97%, at least 98%, or at least 99% sequence identity with SEQ ID NO: 135, 137, 139, 141, 143, 145 or 147, or a nucleic acid sequence having at least 95%, at least 96%, at least 97%, at least 98%, or at least 99% sequence identity with nucleic acid encoding a protein of SEQ ID NO: 277, 278, 279, 280, 281, 282, 283 or 284;

wherein the first *Bacillus subtilis* strain comprises at least one of:

a nucleic acid sequence having at least 95%, at least 96%, at least 97%, at least 98%, or at least 99% sequence identity with SEQ ID NO: 255, 253, 251, 249, 247, 245 or 243, or a nucleic acid sequence having at least 95%, at least 96%, at least 97%, at least 98%, or at least 99% sequence identity with nucleic acid encoding a protein of SEQ ID NO: 285, 286, 287, 288, 289, 290, 291, 292, 293, 294, 295, 296, 297, 298, 299, 300, 301, 302, 303, 304 or 305.

In an embodiment, a composition is provided, wherein:

the first isolated *Bacillus amyloliquefaciens* strain comprises a nucleic acid sequence having at least 95%, at least 96%, at least 97%, at least 98%, or at least 99% sequence identity with at least one of SEQ ID NO: 1, SEQ ID NO: 2, SEQ ID NO: 3, and SEQ ID NO: 4, or wherein the first isolated *Bacillus amyloliquefaciens* strain comprises a nucleic acid sequence having at least 95%, at least 96%, at least 97%, at least 98%, or at least 99% sequence identity with SEQ ID NO: 261;

the second isolated *Bacillus amyloliquefaciens* strain comprises a nucleic acid sequence having at least 95%, at least 96%, at least 97%, at least 98%, or at least 99% sequence identity with at least one of SEQ ID NO: 6, SEQ ID NO: 7, SEQ ID NO: 8, SEQ ID NO: 9, SEQ ID NO: 10, and SEQ ID NO: 11, or wherein the second isolated *Bacillus amyloliquefaciens* strain comprises a nucleic acid sequence having at least 95%, at least 96%, at least 97%, at least 98%, or at least 99% sequence identity with SEQ ID NO: 262; and the first isolated *Bacillus subtilis* strain comprises a nucleic acid sequence having at least 95%, at least 96%, at least 97%, at least 98%, or at least 99% sequence identity with at least one of SEQ ID NO: 12, SEQ ID NO: 13, SEQ ID NO: 14, and SEQ ID NO: 15.

In an embodiment, the first isolated *Bacillus amyloliquefaciens* strain comprises a nucleic acid sequence having at least 95%, at least 96%, at least 97%, at least 98%, or at least 99% sequence identity with SEQ ID NO: 5. In an embodiment, the first isolated *Bacillus amyloliquefaciens* strain comprises a nucleic acid sequence having at least 95%, at least 96%, at least 97%, at least 98%, or at least 99% sequence identity with SEQ ID NO: 261. In an embodiment, the second isolated *Bacillus amyloliquefaciens* strain comprises a nucleic acid sequence having at least 95%, at least 96%, at least 97%, at least 98%, or at least 99% sequence identity with SEQ ID NO: 10 and/or with SEQ ID NO: 11. In an embodiment, the second isolated *Bacillus amyloliquefaciens* strain comprises a nucleic acid sequence having at least 95%, at least 96%, at least 97%, at least 98%, or at least 99% sequence identity with SEQ ID NO: 262. In an embodiment, the first isolated *Bacillus subtilis* strain comprises a nucleic acid sequence having at least 95%, at least 96%, at least 97%, at least 98%, or at least 99% sequence identity with SEQ ID NO: 16. In an embodiment, the first isolated *Bacillus subtilis* strain comprises a nucleic acid sequence having at least 95%, at least 96%, at least 97%, at least 98%, or at least 99% sequence identity with SEQ ID NO: 12, 13, 14, 15 and 16.

In an embodiment, the composition comprises the first isolated *Bacillus amyloliquefaciens* strain; and the second isolated *Bacillus amyloliquefaciens* strain or the first isolated *Bacillus subtilis* strain. In an embodiment, the composition comprises the first isolated *Bacillus amyloliquefaciens* strain and the second isolated *Bacillus amyloliquefaciens* strain.

In an embodiment of the composition, at least one unique metabolite is secreted by the combination of the first isolated *Bacillus amyloliquefaciens* strain and the second isolated *Bacillus amyloliquefaciens* strain, wherein the at least one metabolite is selected from: histidine, N-acetylhistidine, phenyllactate (PLA), 1-carboxyethyltyrosine, 3-(4-hydroxyphenyl)lactate (HPLA), tryptophan, N-acetyltryptophan, anthranilate, indolelactate, isovalerylglycine, N-acetylisoleucine, N-acetylmethionine, urea, ornithine, spermidine, spermine, cysteinylglycine, pyruvate, sucrose, fumarate, deoxycarnitine, 2R,3R-dihydroxybutyrate, chiro-inositol, glycerophosphorylcholine (GPC), 5-arninoimidazole-4-carboxamide, xanthine, AMP, 2'-deoxyadenosine, dihydroorotate, IMP, uridine, CMP, cytidine, (3'-5')-adenylyluridine, (3'-5')-cytidylyladenosine, (3'-5')-cytidylylcytidine, (3'-5')-cytidylyluridine, (3-5')-guanylylcytidine, (3'-5')-guanylyluridine, (3'-5')-uridylylcytidine, (3'-5')-uridylyluridine, (3'-5')-uridylyladenosine, NAD+, oxalate (ethanedioate), maltol, I-methylhistidine, N6,N6-dimethyllysine, S-methylcysteine, and 2-methylcitrate.

In one embodiment, the composition comprises a ratio of the first isolated *Bacillus amyloliquefaciens* strain and the second isolated *Bacillus amyloliquefaciens* strain of 0.75-1.5:1. In an embodiment, the composition comprises about equal amounts of the first isolated *Bacillus amyloliquefaciens* strain and the second isolated *Bacillus amyloliquefaciens* strain. In an embodiment, the composition comprises the first isolated *Bacillus amyloliquefaciens* strain, the second isolated *Bacillus amyloliquefaciens* strain, and the first isolated *Bacillus subtilis* strain. In an embodiment, the composition comprises the first isolated *Bacillus amyloliquefaciens* strain, the second isolated *Bacillus amyloliquefaciens* strain, and the first isolated *Bacillus subtilis* strain in about equal amounts.

In an embodiment, the composition comprises a combination of two *Bacillus amyloliquefaciens* strains and one *Bacillus subtillis* strain, wherein each strain is present in about equal amounts. In an embodiment, the composition comprises a combination of two *Bacillus amyloliquefaciens* strains and one *Bacillus subtillis* strain, wherein each strain is present in equal amounts. In an embodiment, the composition comprises a combination of two *Bacillus amyloliquefaciens* strains and one *Bacillus subtillis* strain, wherein the ratio of the strains is 0.75-1.5:1.

In one embodiment, a composition is provided comprising strain ELA191024, ELA191036 and ELA191105 in equal amounts or at a ratio of 0.75-1.5:1. In one embodiment, a composition is provided comprising strain ELA191006, ELA191036 and ELA191105 in equal amounts or at a ratio of 0.75-1.5:1. In one embodiment, a composition is provided comprising strain ELA1910006, ELA202071 and ELA 191105 in equal amounts or at a ratio of 0.751.5:1.

An embodiment of the composition is provided, wherein at least one unique metabolite is secreted by the combination of the first isolated *Bacillus amyloliquefaciens* strain, the second isolated *Bacillus amyloliquefaciens* strain, and the first isolated *Bacillus subtilis* strain; wherein the at least one metabolite is selected from: N-carbamoyiserine, beta-citrylglutamate, N6-methyllysine, N6,N6-dimethyllysine, N6,N6,N6-trimethyllysine, saccharopine, cadaverine, N-succinylphenylalanine, 2-hydroxyphenylacetate, 3-(4-hydroxyphenyl)lactate (HPLA), N-acetyltryptophan, indolelactate, N-acetylleucine, 4-methyl-2-oxopentanoate, homocitrulline, dimethylarginine (ADMA+SDMA), N-monomethylarginine, guanidinoacetate, N(1)-acetylspermine, glucose 6-phosphate, Isobar: hexose diphosphates, ribitol, arabonate/xylonate, ribulonate/xylulonate/lyxonate, fructose, galactonate, isocitric lactone, fumarate, malate, 3-hydroxyhexanoate, 5-hydroxyhexanoate, myo-inositol, chiro-inositol glycerophosphoethanolamine, glycerophosphoinositol, 3-hydroxy-3-methylglutarate, Mevalonate, 5-aminoimidazole-4-carboxamide, 2'-AMP, 2'-O-methyladenosine, N6-succinyladenosine, guanosine 2'-monophosphate (2'-GMP), 2'-O-methyluridine, uridine 2'-monophosphate (2'-UMP), 5-methyleytosine, pantoate, pantothenate (Vitamin B5), glucarate (saccharate), hippurate, histidinol, homocitrate, pyrraline, 2-keto-3-deoxy-gluconate, pentose acid, N,N-dimethylalanine, Isobar: hexose diphosphates, 2-methyleitrate, and (3'-5')-adenylylguanosine.

In one embodiment, the first isolated *Bacillus amyloliquefaciens* strain comprises strain ELA191024 deposited with ATCC under patent deposit number PTA-126784. In one embodiment, the first isolated *Bacillus amyloliquefaciens* strain comprises strain ELA191006 deposited with ATCC under patent deposit number PTA-127065. In one embodiment, the second isolated *Bacillus amyloliquefaciens* strain comprises strain ELA191036 deposited with ATCC under patent deposit number PTA-126785. In one embodiment, the second isolated *Bacillus amyloliquefaciens* strain comprises strain ELA202071 deposited with ATCC under patent deposit number PTA-127064. In one embodiment, the first isolated *Bacillus subtilis* strain comprises strain ELA191105 deposited with ATCC under patent deposit number PTA-1126786.

In an embodiment, the composition comprises a ratio of the first isolated *Bacillus amyloliquefaciens* strain, the second isolated *Bacillus amyloliquefaciens* strain, and the first isolated *Bacillus subtilis* strain of 0.75-1.5:1:0.75-1.5. In an embodiment, the composition comprises about equal amounts of the first isolated *Bacillus amyloliquefaciens* strain, the second isolated *Bacillus amyloliquefaciens* strain, and the first isolated *Bacillus subtilis* strain. In an embodiment, the ratio or amount is characterized by the number of viable spores per gram dry weight. In an embodiment, the composition comprises from about $1^4$ to about $1^{10}$ viable spores per gram dry weight.

In one embodiment, the first isolated *Bacillus amyloliquefaciens* strain, the second isolated *Bacillus amyloliquefaciens* strain, and the first isolated *Bacillus subtilis* strain are isolated from poultry.

In an embodiment of the invention, the composition is formulated as animal feed, feed additive, food ingredient, water additive, water-mixed additive, consumable solution, consumable spray additive, consumable solid, consumable gel, injection, or combinations thereof. In one embodiment, the composition comprises animal feed.

In an embodiment of the composition or method of the invention, the animal administered the composition further exhibits at least one improved gut characteristic, as compared to an animal not administered the composition; wherein improved gut characteristics includes at least one of: decreasing pathogen-associated lesion formation in the gastrointestinal tract, increasing feed digestibility, increasingr meat quality, increasing egg quality, modulating microbiome, improving short chain fatty acids, improving laying performance, and increasing gut health (reducing permeability and inflammation).

In an embodiment, the pathogenic bacterium comprises at least one of: *Salmonella Typhimurium, Salmonella Infantis, Salmonella* Hadar, *Salmonella Enteritidis, Salmonella* Newport, *Salmonella* Kentucky, *Clostridium perfringens, Staphylococcus aureus, Streptoccus uberis, Streptococcus suis, Escherichia coli, Campylobacter jejuni, Fusobacterium necrophorum*, Avian pathogenic *Escherichia coli* (APEC), *Salmonella* Lubbock, Trueperella *pyogenes*, shiga toxin producing *E. coli*, enterotoxigenic *E. coli, Campylobacter coli*, and Lawsonia intracellularis.

In an embodiment, the composition treats, alleviates, or reduces an infection from at least one of: *Salmonella Typhimurium, Salmonella Infantis, Salmonella* Hadar, *Salmonella Enteritidis, Salmonella* Newport, *Salmonella* Kentucky, *Clostridium perfringens, Staphylococcus aureus, Streptoccus uberis, Streptococcus suis, Escherichia coli, Campylobacter jejuni, Fusobacterium necrophorum*, Avian pathogenic *Escherichia coli* (APEC), *Salmonella* Lubbock, *Trueperella pyogenes*, shiga toxin producing *E. coli*, enterotoxigenic *E. coli, Campylobacter coli*, and Lawsonia intracellularis.

In an embodiment, the composition treats, alleviates, or reduces at least one of: leaky gut syndrome, intestinal inflammation, necrotic enteritis, and coccidiosis.

In an embodiment of the invention, the animal is human, non-human, poultry (chicken, turkey), bird, cattle, swine, salmon, fish, cat, or dog. In an embodiment the animal is poultry. In an embodiment, the poultry is a chicken. In an embodiment, the poultry is a broiler chicken. In an embodiment, the poultry is an egg-producing chicken (layer).

In an embodiment, the animal is poultry and wherein the poultry administered the composition further exhibits at least one of: decreased feed conversion ratio, increased weight, increased lean body mass, decreased pathogen-associated lesion formation in the gastrointestinal tract, decreased colonization of pathogens, modulated microbiome, increased egg quality, increased feed digestibility, and decreased mortality rate, as compared to poultry not administered the composition.

In an embodiment, the feed conversion ratio is decreased by at least 1%, at least 5%, at least 6%, at least 7%, at least 8%, at least 9%, at least 10%, or at least 15%. In an embodiment, poultry weight is increased by at least 1%, at least 5%, at least 10%, at least 15%, at least 25%, or at least 50%. In an embodiment, pathogen-associated lesion formation in the gastrointestinal tract is decreased by at least 1%, at least 5%, at least 10%, at least 15%, at least 25%, or at least 50%. In an embodiment, mortality rate is decreased by at least 1%, at least 5%, at least 10%, at least 15%, at least 25%, or at least 50%.

In an embodiment, the pathogen comprises at least one of *Salmonella* spp., *Clostridium* spp., *Campylobacter* spp., *Staphylococcus* spp., *Streptococcus* spp., *E. coli.*, and Avian Pathogenic *E. coli.*

In an embodiment, administered comprises in ovo administration. In an embodiment, administered comprises spray administration. In an embodiment, administered comprises immersion, intranasal, intramammary, topical, or inhalation.

In an embodiment, administered comprises administration of a vaccine. In an embodiment, the animal is administered a vaccine prior to the administration of the composition. In an embodiment, the animal is poultry and the poultry is administered a vaccine prior to the administration of the composition. In an embodiment, the animal is swine and the swine is administered a vaccine prior to the administration of the composition. In an embodiment, the animal is administered a vaccine concurrently with the administration of the composition. In an embodiment, the animal is poultry and the poultry is administered a vaccine concurrently with the administration of the composition. In an embodiment, the animal is poultry and the poultry is administered a vaccine, wherein said vaccine comprises a vaccine that aids in the prevention of coccidiosis. In an embodiment, the animal is swine and the swine is administered a vaccine concurrently with the administration of the composition.

In one embodiment, the isolated strains are inactivated. In an embodiment, the isolated strains are not genetically engineered.

In an embodiment, a composition is provided for use in therapy. In an embodiment, a composition is provided for use in improving animal health. In an embodiment, a composition is provided for use in reducing colonization of an animal by a pathogenic bacterium. In an embodiment, a composition is provided for use in the manufacture of a medicament for reducing colonization of an animal by a pathogenic bacterium.

In an embodiment, a method is provided for reducing or inhibiting the colonization of an animal by a pathogenic bacterium, the method comprising administering to an animal an effective amount of a composition according to the invention. In an embodiment, a method is provided for reducing or inhibiting the colonization of an animal by a pathogenic bacterium, the method comprising administering to an animal an effective amount of a composition comprising a first isolated *Bacillus amyloliquefaciens* strain, a second isolated *Bacillus amyloliquefaciens* strain, and a first isolated *Bacillus subtilis* strain. In an embodiment, a method is provided for reducing or inhibiting the colonization of an animal by a pathogenic bacterium, the method comprising administering to an animal an effective amount of a composition comprising a first isolated *Bacillus amyloliquefaciens* strain selected from ELA191024 and ELA191006 or active and effective variants thereof having at least 95%, 97%, 98% or 99% identity to the nucleic acid genome sequence of ELA191024 (SEQ ID NO: 1, 2, 3, 4, 5) or ELA 191006 (SEQ ID NO:261), a second isolated *Bacillus amyloliquefaciens* strain selected from ELA191036 and ELA202071 or active and effective variants thereof having at least 95%, 97%, 98% or 99% identity to the nucleic acid genome sequence of ELA191036 (SEQ ID NO: 16, 7, 8, 9, 10, 11) or ELA202071 (SEQ ID NO:262), and a first isolated *Bacillus subtilis* strain ELA191105 or active and effective variants thereof having at least 95%, 97%, 98% or 99% identity to the nucleic acid genome sequence of ELA191105 (SEQ ID NO: 12, 13, 14, 15, 16).

In embodiments of the method, the animal is human, non-human animal, poultry (chicken, turkey), bird, cattle, swine, salmon, fish, cat, or dog. In one embodiment, the animal is poultry. In one embodiment, the animal is swine.

In an embodiment, the method further comprises improving animal health, and wherein improving animal health comprises at least one of decreasing pathogen-associated lesion formation in the gastrointestinal tract, decreasing colonization of pathogens, and decreasing mortality rate.

In an embodiment, a method is provided for improving animal health, the method comprising administering to an animal an effective amount of a composition according to the invention. In an embodiment, a method is provided for improving animal health, the method comprising administering to an animal an effective amount of a composition comprising a first isolated *Bacillus amyloliquefaciens* strain, a second isolated *Bacillus amyloliquefaciens* strain, and a first isolated *Bacillus subtilis* strain. In an embodiment, a method is provided for improving animal health, the method comprising administering to an animal an effective amount of a composition comprising a first isolated *Bacillus amyloliquefaciens* strain selected from ELA191024 and ELA191006 or active and effective variants thereof having at least 95%, 97%, 98% or 99% identity to the nucleic acid genome sequence of ELA191024 (SEQ ID NO: 1, 2, 3, 4, 5) or ELA191006 (SEQ ID NO:261), a second isolated *Bacillus amyloliquefaciens* strain selected from ELA191036 and ELA202071 or active and effective variants thereof having at least 95%, 97%, 98% or 99% identity to the nucleic acid genome sequence of ELA191036 (SEQ ID NO: 16, 7, 8, 9, 10, 11) or ELA202071 (SEQ ID NO:262), and a first isolated *Bacillus subtilis* strain ELA191105 or active and effective variants thereof having at least 95%, 97%, 98% or 99% identity to the nucleic acid genone sequence of ELA191105 (SEQ ID NO: 12, 13, 14, 15, 16).

In an embodiment, a method is provided for treating necrotic enteritis in poultry, wherein said method comprises administering a composition according to the invention as provided herein to a poultry in need thereof. In an embodiment, a method is provided reducing mortality in poultry due to necrotic enteritis, wherein said method comprises administering a composition according to the invention as provided herein to a poultry in need thereof. In an embodiment, a method is provided for improving performance selected from average daily feed intake (ADFI), average daily gain (ADG) and feed conversion ratio (FCR) in poultry, wherein said method comprises administering a composition according to the invention as provided herein to a poultry in need thereof.

In an embodiment, a method is provided for reducing post-weaning diarrhea in swine, wherein said method comprises administering a composition according to the invention as provided herein to a post-weaning swine in need thereof. In an embodiment, a method is provided for improving feed intake, penn weight and/or weight gain in swine, wherein said method comprises administering a composition according to the invention as provided herein to a post-weaned swine or piglet. In an embodiment, a method is provided for improving performance selected from average daily feed intake (ADFI), average daily gain (ADG) and feed conversion ratio (FCR) in swine, particularly in post-weaning swine, wherein said method comprises administering a composition according to the invention as provided herein to a swine, particularly post-weaning swine, in need thereof.

In embodiments of the methods, the composition comprises the first isolated *Bacillus amyloliquefaciens* strain, and the second isolated *Bacillus amyloliquefaciens* strain. In an embodiment of the methods, the method comprises administering to an animal an effective amount of a composition comprising a first isolated *Bacillus amyloliquefaciens* strain selected from ELA191024 and ELA191006 or active and effective variants thereof having at least 95%, 97%, 98% or 99% identity to the nucleic acid genome sequence of ELA191024 (SEQ ID NO: 1, 2, 3, 4, 5) or ELA191006 (SEQ ID NO:261), a second isolated *Bacillus amyloliquefaciens* strain selected from ELA191036 and ELA202071 or active and effective variants thereof having at least 95%, 97%, 98% or 99% identity to the nucleic acid genome sequence of ELA191036 (SEQ ID NO: 16, 7, 8, 9, 10, 11) or ELA202071 (SEQ ID NO:262), and a first isolated *Bacillus subtilis* strain ELA191105 or active and effective variants thereof having at least 95%, 97%, 98% or 99% identity to the nucleic acid genome sequence of ELA191105 (SEQ ID NO: 12, 13, 14, 15, 16). In an embodiment, equal amounts of the strains are administered or ratios of 0.75-1.5:1 respectively.

In an embodiment of the method(s), at least one unique metabolite is secreted by the combination of the first isolated *Bacillus amyloliquefaciens* strain and the second isolated *Bacillus amyloliquefaciens* strain; wherein the at least one unique metabolite is selected from: histidine, N-acetylhistidine, phenyllactate (PLA), 1-carboxyethyltyrosine, 3-(4-hydroxyphenyl)lactate (HPLA), tryptophan, N-acetyltryptophan, anthranilate, indolelactate, isovalerylglycine, N-acetylisoleucine, N-acetylmethionine, urea, ornithine, spermidine, spermine, cysteinylglycine, pyruvate, sucrose, fumarate, deoxycarnitine, 2R,3R-dihydroxybutyrate, chiro-inositol, glycerophosphorylcholine (GPC), 5-aminoimidazole-4-carboxamide, xanthine, AMP, 2'-deoxyadenosine, dihydroorotate, UMP, uridine, CMP, cytidine, (3'-5')-adenylyluridine, (3'-5')-cytidylyladenosine, (3'-5')-cytidylylcytidine, (3'-5')-cytidylyluridine, (3'-5')-guanylylcytidine, (3'-5')-guanylyluridine, (3'-5')-uridylylcytidine, (3'-5')-uridylyluridine, (3-5')-uridylyladenosine, NAD+, oxalate (ethanedioate), maltol, 1-methylhistidine, N6,N6-dimethyllysine, S-methylcysteine, and 2-methylcitrate.

In an embodiment, the composition comprises the first isolated *Bacillus amyloliquefaciens* strain, the second isolated *Bacillus amyloliquefaciens* strain, and the first isolated *Bacillus subtilis* strain. In one such embodiment, at least one unique metabolite is secreted by the combination of the first isolated *Bacillus amyloliquefaciens* strain, the second isolated *Bacillus amyloliquefaciens* strain, and the first isolated *Bacillus subtilis* strain; wherein the at least one metabolite is selected from: N-carbamoylserine, beta-citrylglutamate, N6-methyllysine, N6,N6-dimethyllysine, N6,N6,N6-trimethyllysine, saccharopine, cadaverine, N-succinyl-phenylalanine, 2-hydroxyphenylacetate, 3-(4-hydroxyphenyl)lactate (HPLA), N-acetyltryptophan, indolelactate, N-acetylleucine, 4-methyl-2-oxopentanoate, homocitrulline, dimethylarginine (ADMA+SDMA), N-monomethylarginine, guanidinoacetate, N(1)-acetylspermine, glucose 6-phosphate, Isobar: hexose diphosphates, ribitol, arabonate/xylonate, ribulonate/xylulonate/lyxonate, fructose, galactonate, isocitric lactone, furmarate, malate, 3-hydroxyhexanoate, 5-hydroxyhexanoate, myo-inositol, chiro-inositol glycerophosphoethanolamine, glycerophosphoinositol, 3-hydroxy-3-methylglutarate, Mevalonate, 5-aminoimidazole-4-carboxamide, 2'-AMP, 2'-O-methyladenosine, N6-succinyladenosine, guanosine 2'-monophosphate (2'-GMP), 2'-O-methyluridine, uridine 2'-monophosphate (2'-UMP), 5-methylcytosine, pantoate, pantothenate (Vitamin B5), glucarate (saccharate), hippurate, histidinol, homocitrate, pyrraline, 2-keto-3-deoxy-gluconate, pentose acid, N,N-dimethylalanine, Isobar: hexose diphosphates, 2-methylcitrate, and (3'-5')-adenylylguanosine.

In an embodiment of the method(s), the method does not comprise administration of an antibiotic.

In a further embodiment, a method is provided of preparing a fermentation product comprising the steps of:

(a) obtaining at least one bacterial strain selected from a first isolated *Bacillus amyloliquefaciens* strain comprising SEQ ID NO: 59 or a first isolated *Bacillus amyloliquefaciens* strain comprising one or more of SEQ ID NO: 263-276, a second isolated *Bacillus amyloliquefaciens* strain comprising SEQ ID NO: 133 or a second isolated *Bacillus amyloliquefaciens* strain comprising one or more of SEQ ID NO: 277-284, and a first isolated *Bacillus subtilis* strain comprising SEQ ID NO: 257 or a first isolated *Bacillus subtilis* strain comprising one or more of SEQ ID NO: 285-305;

(b) contacting the at least one strain of step (a) with cell growth media;

(c) incubating a combination of at least one strain of step (a) and cell growth media of step (b) at a temperature of about 37° C. for an incubation time of about 24 hours; and (d) cooling the combination of step (c);

wherein the product of step (d) comprises the fermentation product.

In an embodiment, the cell growth media comprises: 0.5 g casamino acids/L, 1% glucose, Disodium Phosphate (anhydrous) 6.78 g/L, Monopotassium Phosphate 3 g/L, Sodium Chloride 0.5 g/L, and Ammonium Chloride Ig/L.

In an embodiment, the cell growth media comprises: Peptone 30 g/L; Sucrose 30 g/L; Yeast extract 8 g/L; KH2PO4 4 g/L; MgSO4 1.0 g/L; and MnSO4 25 mg/L.

In an embodiment, a method is provided of delivering a metabolite to the gut of an animal, said method comprising administering to an animal a composition comprising: a first isolated *Bacillus amyloliquefaciens* strain comprising SEQ ID NO: 59 or a first isolated *Bacillus amyloliquefaciens* strain comprising nucleic acid encoding one or more of SEQ ID NO: 263-276, and a second isolated *Bacillus amyloliquefaciens* strain comprising SEQ ID NO: 133 or a second isolated *Bacillus amyloliquefaciens* strain comprising nucleic acid encoding one or more of SEQ ID NO: 277-284;

wherein the metabolite comprises at least one of: histidine, N-acetylhistidine, phenyllactate (PLA), 1-carboxyethyltyrosine, 3-(4-hydroxyphenyl)lactate (HPLA), tryptophan, N-acetyltryptophan, anthranilate, indolelactate, isovalerylglycine, N-acetylisoleucine, N-acetylmethionine, urea, ornithine, spermidine, spermine, cysteinylglycine, pyruvate, sucrose, fumarate, deoxycarnitine, 2R,3R-dihydroxybutyrate, chiro-inositol, glycerophosphorylcholine (GPC), 5-aminoimidazole-4-carboxamide, xanthine, AMP, 2'-deoxyadenosine, dihydroorotate, UMP, uridine, CMP, cytidine, (3'-5')-adenylyluridine, (3'-5')-cytidylyladenosine, (3'-5')-cytidylylcytidine, (3'-5')-cytidylyluridine, (3'-5')-guanylylcytidine, (3'-5')-guanylyluridine, (3'-5')-uridylylcytidine, (3'-5')-uridylyluridine, (3'-5')-uridylyladenosine, NAD+, oxalate (ethanedioate), maltol, 1-methylhistidine, N6,N6-dimethyllysine, S-methylcysteine, and 2-methylcitrate.

In an embodiment, the metabolite is secreted by the combination of the first *Bacillus amyloliquefaciens* strain and the second isolated *Bacillus amyloliquefaciens* strain.

In an embodiment of the method(s), the composition is formulated as animal feed, feed additive, food ingredient, water additive, water-mixed additive, consumable solution, consumable spray additive, consumable solid, consumable gel, injection, or combinations thereof. In an embodiment, the composition comprises animal feed.

In an embodiment, the composition further comprises a carrier. In one embodiment, the carrier selected from edible food grade material, mineral mixture, gelatin, cellulose, carbohydrate, starch, glycerin, water, rice hulls, glycol, molasses, calcium carbonate, whey, sucrose, dextrose, soybean oil, vegetable oil, sesame oil, and corn oil.

In one embodiment of the method(s), the first isolated *Bacillus amyloliquefaciens* strain comprises strain ELA191024 deposited with ATCC under patent deposit number PTA-126784, and the second isolated *Bacillus amyloliquefaciens* strain comprises strain ELA191036 deposited with ATCC under patent deposit number PTA-126785. In one embodiment of the method(s), the first isolated *Bacillus amyloliquefaciens* strain comprises strain ELA191006 deposited with ATCC under patent deposit number PTA-127065, and the second isolated *Bacillus amyloliquefaciens* strain comprises strain ELA202071 deposited with ATCC under patent deposit number PTA-127064. In one embodiment of the method(s), the first isolated *Bacillus subtillis* strain comprises strain ELA191105 deposited with ATCC under patent deposit number PTA-126786.

In another embodiment, a method is provided of delivering a metabolite to the gut of an animal, said method comprising administering to an animal a composition comprising: a first isolated *Bacillus amyloliquefaciens* strain comprising SEQ ID NO: 59 or a first isolated *Bacillus amyloliquefaciens* strain comprising nucleic acid encoding one or more of SEQ ID NO: 263-276, a second isolated *Bacillus amyloliquefaciens* strain comprising SEQ ID NO: 133 or a second isolated *Bacillus amyloliquefaciens* strain comprising nucleic acid encoding one or more of SEQ ID NO: 277-284, and a first isolated *Bacillus subtilis* strain comprising SEQ ID NO: 257; and a carrier suitable for animal administration;

wherein metabolite comprises at least one of: N-carbamoylserine, beta-citrylglutamate, N6-methyllysine, N6,N6-dimethyllysine, N6,N6,N6-trimethyllysine, saccharopine, cadaverine, N-succinyl-phenylalanine, 2-hydroxyphenylacetate, 3-(4-hydroxyphenyl)lactate (HPLA), N-acetyltryptophan, indolelactate, N-acetylleucine, 4-methyl-2-oxopentanoate, homocitrulline, dimethylarginine (ADMA+SDMA), N-monomethylarginine, guanidinoacetate, N(1)-acetylspermine, glucose 6-phosphate. Isobar: hexose diphosphates, ribitol, arabonate/xylonate, ribulonate/xylulonate/lyxonate, fructose, galactonate, isocitric lactone, fumarate, malate, 3-hydroxyhexanoate, 5-hydroxyhexanoate, myo-inositol, chiro-inositol glycerophosphoethanolamine, glycerophosphoinositol, 3-hydroxy-3-methylglutarate, Mevalonate, 5-aminoimidazole-4-carboxamide, 2'-AMP, 2-O-methyladenosine, N6-succinyladenosine, guanosine 2'-monophosphate (2'-GMP), 2'-O-methyluridine, uridine 2'-monophosphate (2'-UMP), 5-methylcytosine, pantoate, pantothenate (Vitamin B5), glucarate (saccharate), hippurate, histidinol, homocitrate, pyrraline, 2-keto-3-deoxy-gluconate, pentose acid, N,N-dimethylalanine, Isobar: hexose diphosphates, 2-methylcitrate, and (3'-5')-adenylylguanosine.

In one embodiment, the composition is formulated as animal feed, feed additive, food ingredient, water additive, water-mixed additive, consumable solution, consumable spray additive, consumable solid, consumable gel, injection, or combinations thereof. In an embodiment, the composition comprises animal feed. In an embodiment, the composition comprises a carrier. In an embodiment, the carrier is selected from edible food grade material, mineral mixture, gelatin, cellulose, carbohydrate, starch, lycerin, water, rice hulls, glycol, molasses, calcium carbonate, whey, sucrose, dextrose, soybean oil, vegetable oil, sesame oil, and corn oil.

In embodiments of the method(s) hereof, the first isolated *Bacillus amyloliquefaciens* strain comprises strain ELA191024 deposited with ATCC under patent deposit number PTA-126784 or strain ELA191006 deposited with ATCC under patent deposit number PTA-127065, the second isolated *Bacillus amyloliquefaciens* strain comprises strain ELA191036 deposited with ATCC under patent deposit number PTA-126785 or ELA202071 deposited with ATCC under patent deposit number PTA-127064, and the first isolated *Bacillus subtilis* strain comprises strain ELA191105 deposited with ATCC under patent deposit number PTA-126786.

While there have been described what are presently believed to be the preferred embodiments of the present invention, those skilled in the art will realize that other and further changes and modifications may be made thereto without departing from the spirit of the invention, and it is intended to claim all such modifications and changes as come within the true scope of the invention.

Other objects and advantages will become apparent to those skilled in the art from a review of the ensuing detailed description, which proceeds with reference to the following illustrative drawings, and the attendant claims.

TABLE 1

| Sample ID | Key |
|---|---|
| P-BAM24 | Pellet, minimal media, *Bacillus* #24 |
| P-BAM36 | Pellet, minimal media, *Bacillus* #36 |
| P-BAM105 | Pellet, minimal media, *Bacillus* #105 |
| P-BAM24-36 | Pellet, minimal media, *Bacillus* #24 and #36 cocultured together |
| P-BAM24-36A | Pellet, minimal media, *Bacillus* #24 and #36 cocultured together with 100 µl of APEC supernatant |
| P-BAM24-36-105 | Pellet, minimal media, *Bacillus* #24, #36 and #105 cocultured together |
| S-BAM24 | Supernatant, minimal media, *Bacillus* #24 |
| S-BAM36 | Supernatant, minimal media, *Bacillus* #36 |
| S-BAM105 | Supernatant, minimal media, *Bacillus* #105 |
| S-BAM24-36 | Supernatant, minimal media, *Bacillus* #24 and #36 cocultured together |
| S-BAM24-36A | Supernatant, minimal media, *Bacillus* #24 and #36 cocultured together with 100 µl of APEC supernatant |
| S-BAM24-36-105 | Supernatant, minimal media, *Bacillus* #24, #36 and #105 cocultured together |

TABLE 1-continued

| Sample ID | Key |
|---|---|
| Media2 | Minimal media control |
| P-BAR24 | Pellet, rich media, *Bacillus* #24 |
| P-BAR36 | Pellet, rich media, *Bacillus* #36 |
| P-BAR105 | Pellet, rich media, *Bacillus* #105 |
| P-BAR24-36 | Pellet, rich media, *Bacillus* #24 and #36 cocultured together |
| P-BAR24-36A | Pellet, rich media, *Bacillus* #24 and #36 cocultured together with 100 μl of APEC supernatant |
| P-BAR24-36-105 | Pellet, rich media, *Bacillus* #24, #36 and #105 cocultured together |

"P" indicates pellet, "S" indicates supernatant, BA indicates *Bacillus*, 24 indicates *Bacillus amyloliquefaciens* strain ELA191024, 36 indicates *Bacillus amyloliquefaciens* strain ELA191036, and 105 indicates *Bacillus subtilis* strain ELA191105. "M" indicates minimal media and "R" indicates rich media.

Figure 6:
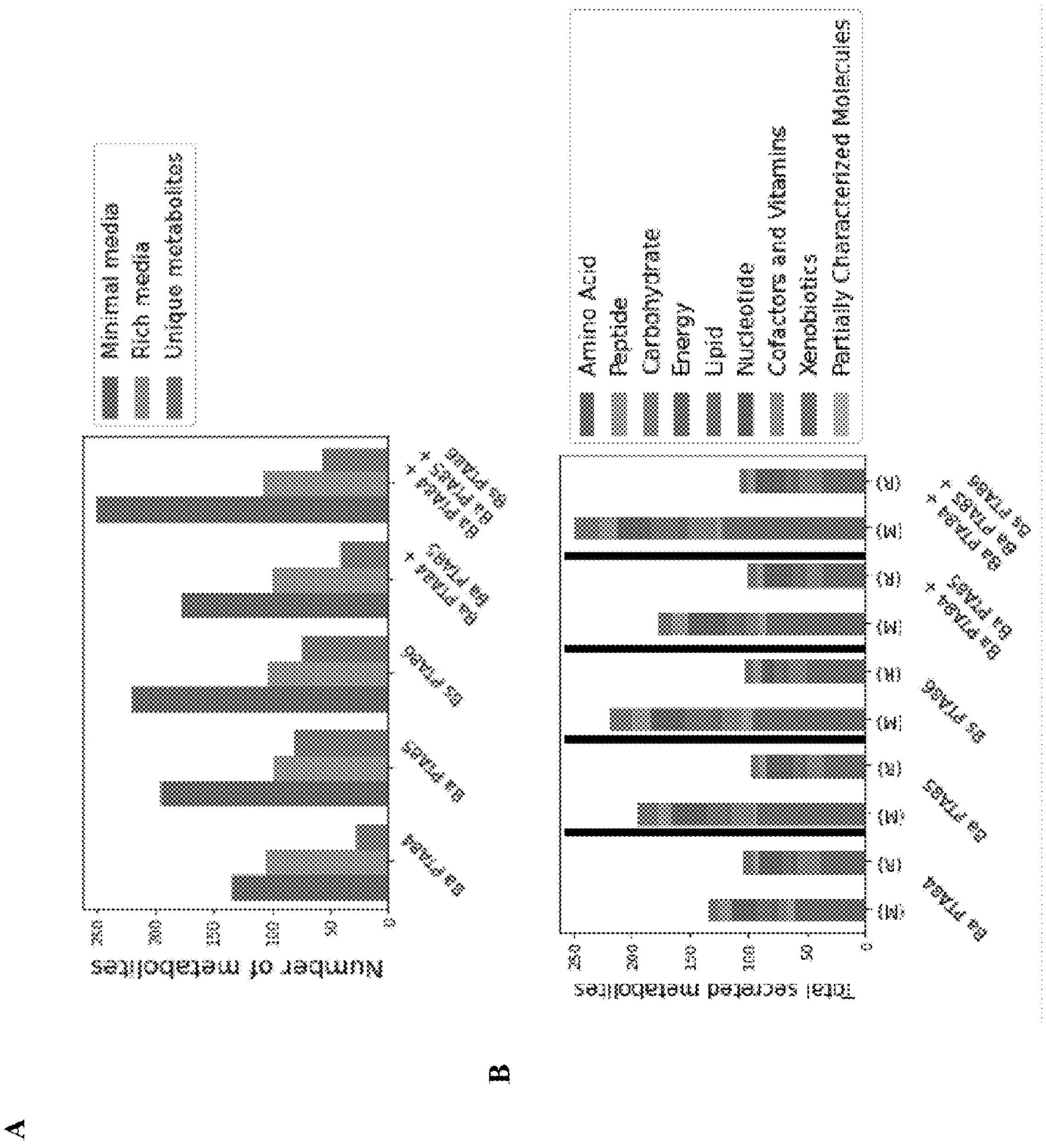

FIGS. 6 A and B depicts global untargeted metabolomic analysis of strains ELA191024 (Ba PTA84), ELA191036 (Ba PTA85), and ELA191105 (Bs PTA86). A. Number of identified secreted metabolites in culture supernatants in two different media. Secreted metabolites were defined as having a scaled intensity at least 1.5-fold higher than observed in media controls. Unique metabolites represent secreted compounds with abundances at least 1.5-fold higher than observed for other single strains (in the case of individual strain cultures) or corresponding individual strains (in the case of co-cultures). B. Pathway representation of metabolites secreted by strains or strain combinations under minimal and rich media culture conditions.

Number of unique metabolites in different *Bacillus* samples. The bar on the left of each paired set bars indicates supernatant; and the bar on the right of each paired set of bars indicates cell pellet.

Figure 7:
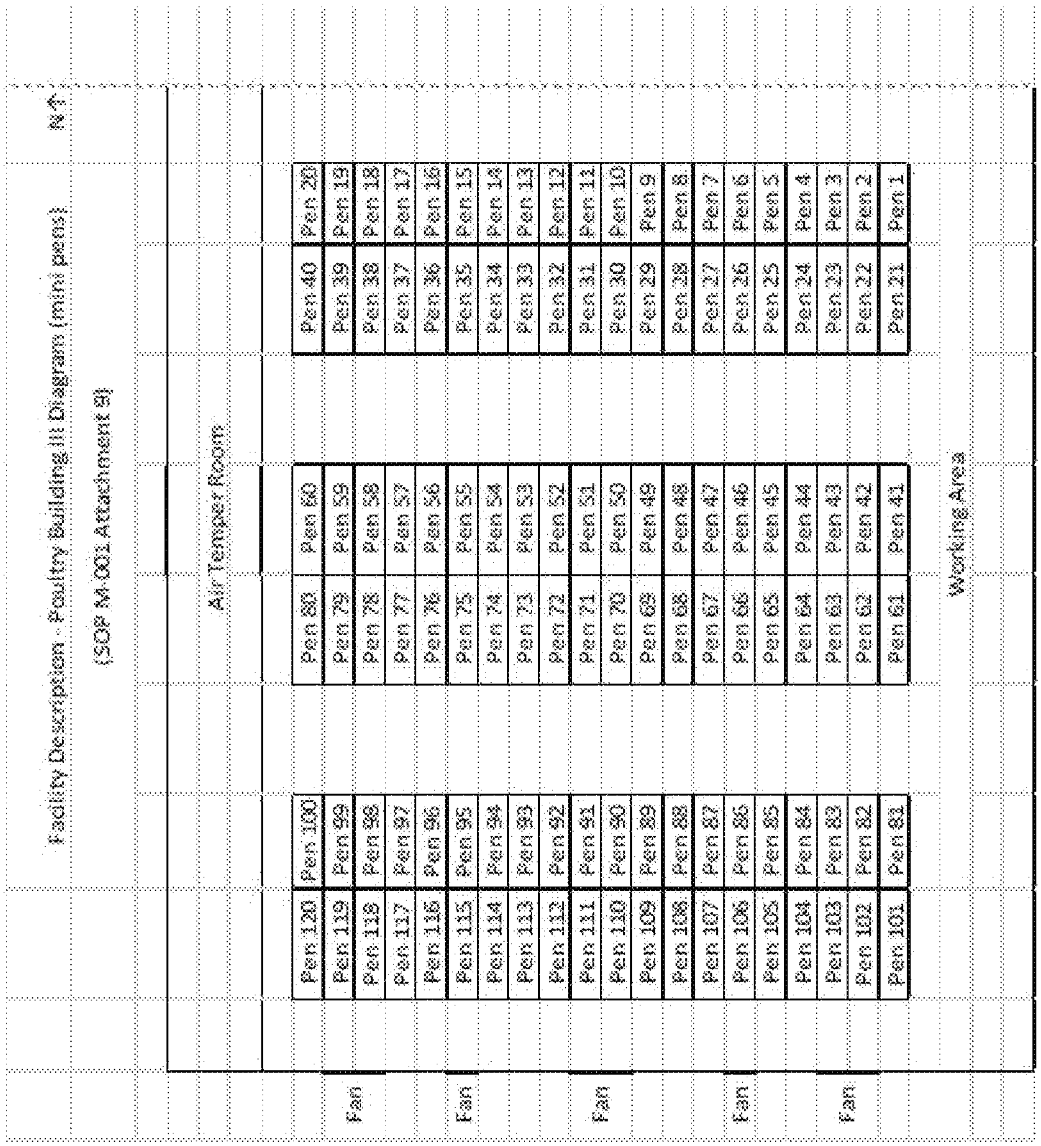

FIG. 7 provides a diagram of the facility where the *Bacillus* probiotic blends study in broiler chickens was conducted.

FIG. 8A-8C depicts (A) final body weight, (B) feed conversion and (C) survival of unchallenged animals is, where it is noted that one outlier pen (circled) was removed from the T01 unchallenged control due to inordinate outlier results across all three measures. The Diet is noted on the x(lower) axis of each chart: Basal (T01), BMD (T03), Combo 1 (T05), Combo 2 (T07), Combo 3 (TO9) and Combo 4 (T11).

FIG. 9A-9C depicts weight gain in unchallenged chickens. (A) depicts average daily gain, (B) depicts mortality-adjusted average daily gain (ADG), and (C) charts the results, with better % vs basal indicated by a color coding (blue being better). The Diet is noted on the x(lower) axis of each chart: Basal (T01), BMD (T03), Combo 1 (T05), Combo 2 (T07), Combo 3 (T09) and Combo 4 (T11).

Figure 10:
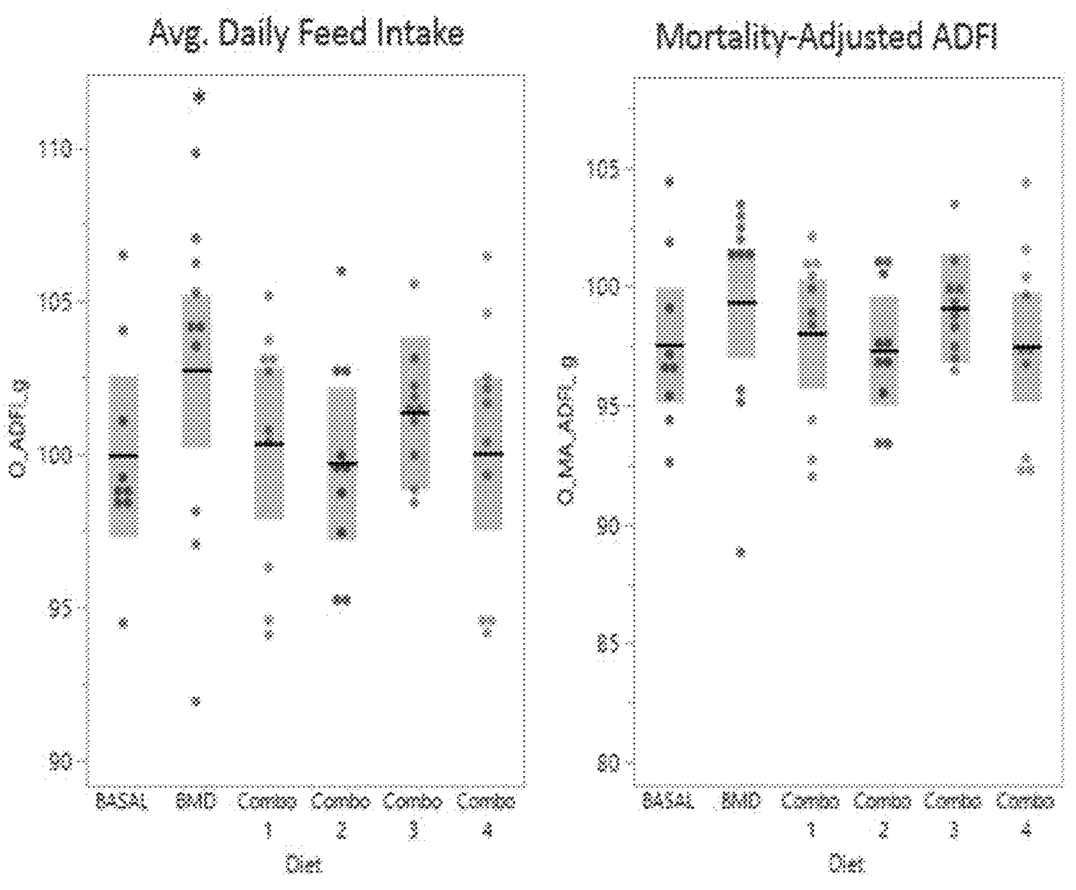

FIG. 10A-10C depicts feed intake in unchallenged chickens. (A) depicts average daily feed intake, (B) depicts mortality-adjusted average daily average daily feed intake (ADFI) and (C) charts the results, with better % vs basal indicated by a color coding (blue being better). The Diet is noted on the lower axis of each chart: Basal (TO1), BMD (T03), Combo 1 (T05), Combo 2 (T07), Combo 3 (T09) and Combo 4 (T11).

FIG. 11A-11C depicts feed efficiency in unchallenged chickens. (A) depicts feed conversion ratio, (B) depicts mortality-adjusted feed conversion ratio (FCR) and (C) charts the results, with better % vs basal indicated by a color coding (blue being better). The Diet is noted on the lower axis of each A and B chart: Basal (T01), BMD (T03), Combo 1 (TO5), Combo 2 (T07), Combo 3 (T09) and Combo 4 (T11).

FIG. 12A-12C depicts production efficiency and mortality in unchallenged chickens. (A) depicts the European Broiler Index, (B) depicts mortality results, and (C) charts the results, with better % vs basal indicated by a color coding (blue being better). The Diet is noted on the lower axis of each A and B chart: Basal (T01), BMD (T03), Combo 1 (T05), Combo 2 (T07), Combo 3 (T09) and Combo 4 (T11).

FIG. 13A-13D depicts necrotic enteritis (NE) lesion scores as assessed on Day 19 of the study, two days post challenge with *C. perfringes* on Day 17. Scores 0, 1, 2, 3 and 4 are in accordance with the observed macroscopic finding as detailed in Table 22. (A) depicts the percentage of each of the scores 0-4 for each of the diets/combos. (B) depicts the average scores. (C) provides the percentage (%) of animals with scores 3 or greater (3+). The results are charted in (D) with better % vs basal indicated by a color coding (blue being better). The Diet is noted on the lower axis of each A, B and C chart: Basal (T02), BMD (T04), Combo 1 (T06), Combo 2 (T08), Combo 3 (T10) and Combo 4 (T12). P value vs Basal are provided as: *<0.1, <0.01 and *<0.001.

Figure 14:
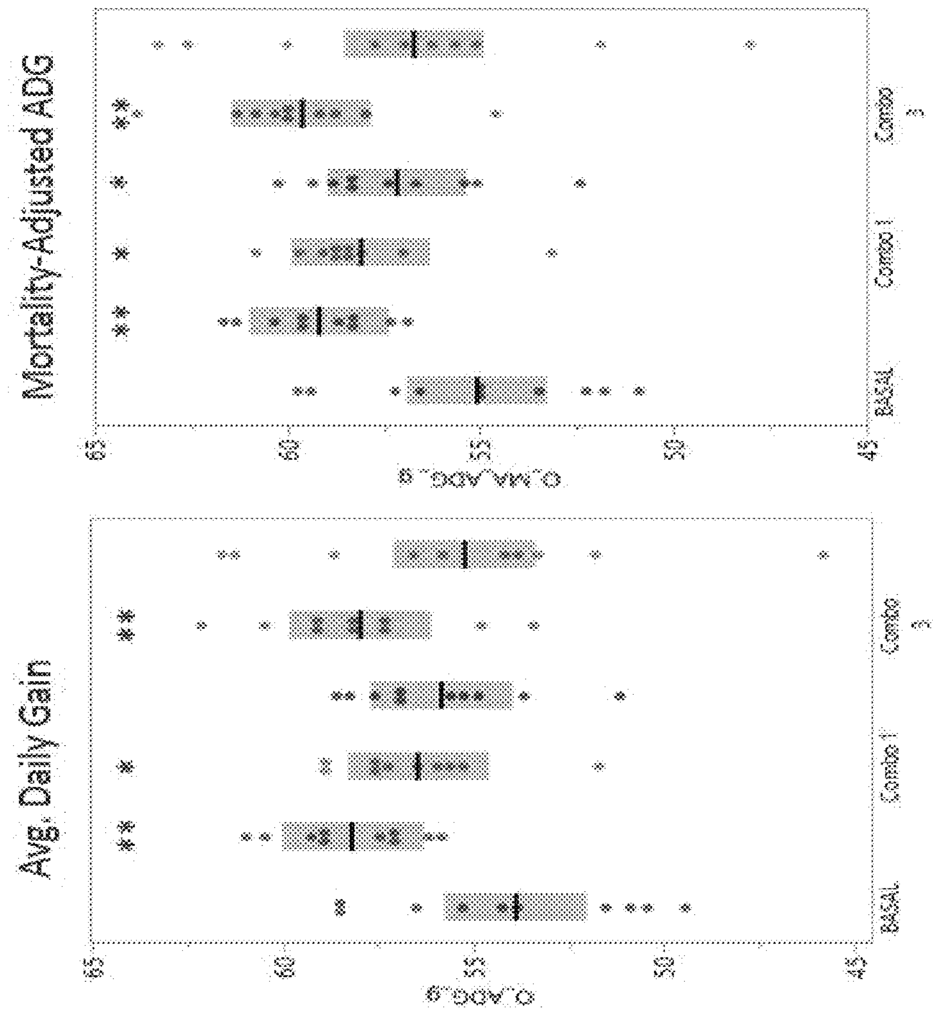

FIG. 14A-14C provides weight gain with NE challenge, particularly average daily gain and mortality-adjusted average daily gain (ADG). (A) depicts average daily gain, (B) depicts mortality-adjusted average daily gain (ADG), and (C) charts the results, with better % vs basal indicated by a color coding (blue being better). The Diet is noted on the lower axis of each A and B chart: Basal (T02), BMD (T04), Combo 1 (T06), Combo 2 (T08), Combo 3 (T10) and Combo 4 (T12). P value vs Basal are provided as: *<0.1, <0.01 and *<0.001.

Figure 15:
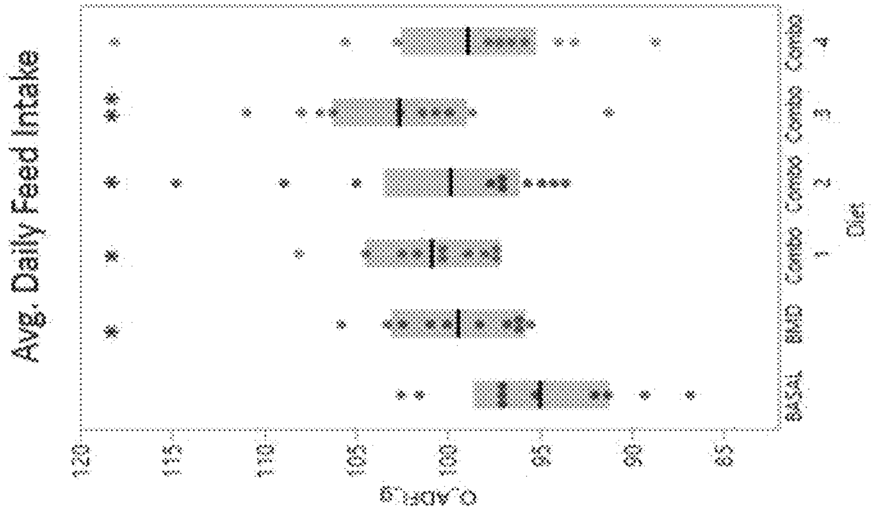
Figure 15:
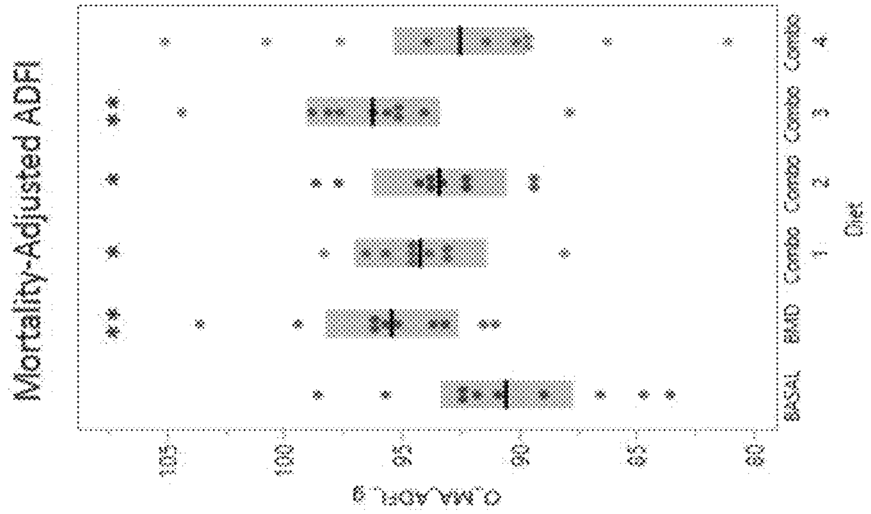

FIG. 15A-15C provides feed intake with NE challenge, particularly average daily feed intake and mortality-adjusted average daily feed intake (ADFI). (A) depicts average daily feed intake, (B) depicts mortality-adjusted average daily feed intake (ADFI), and (C) charts the results, with better % vs basal indicated by a color coding (blue being better). The Diet is noted on the lower axis of each A and B chart: Basal (T02), BMD (T04), Combo 1 (T06), Combo 2 (T08), Combo 3 (TIO) and Combo 4 (T12). P value vs Basal are provided as: *<0.1, <0.01 and *<0.001.

Figure 16:
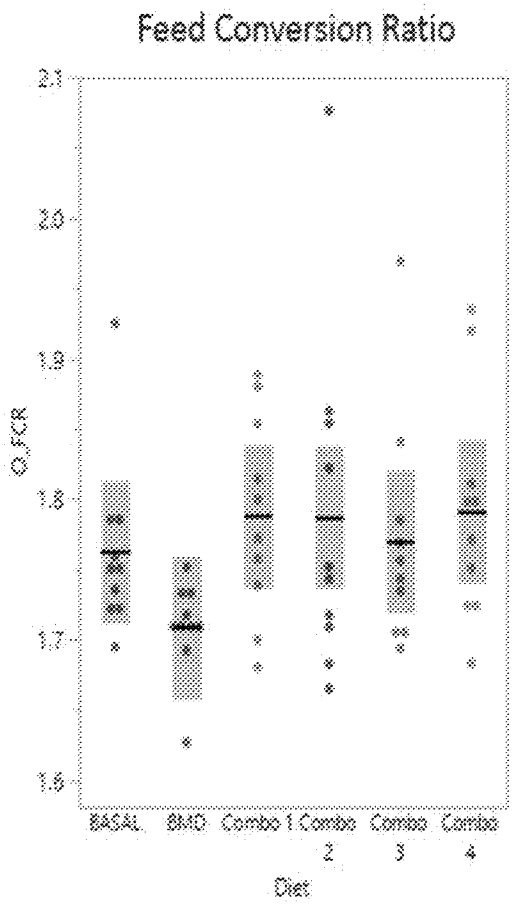
Figure 16:
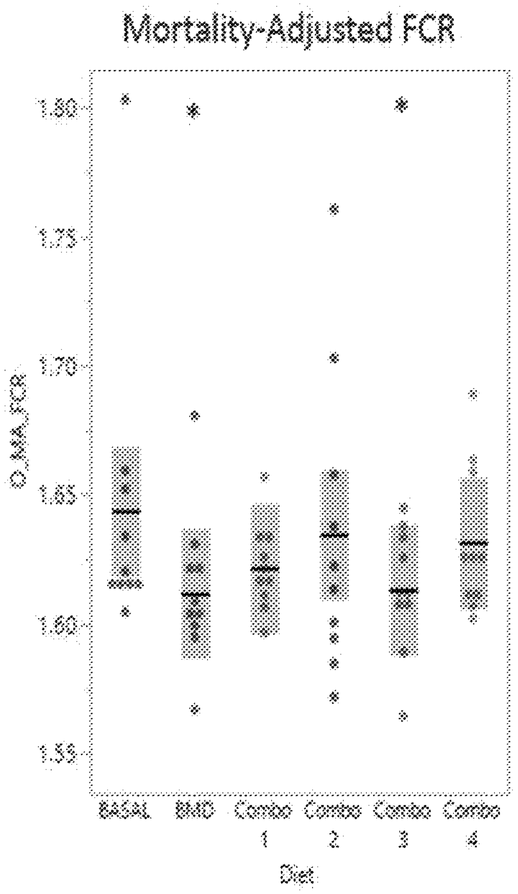

FIG. 16A-16C depicts feed efficiency with NE challenge, particularly feed conversion ratio and mortality-adjusted feed conversion ratio (FCR). (A) depicts feed conversion ratio, (B) depicts mortality-adjusted feed conversion ratio (FCR), and (C) charts the results, with better % vs basal indicated by a color coding (blue being better). The Diet is noted on the lower axis of each A and B chart: Basal (T02), BMD (T04), Combo 1 (T06), Combo 2 (T08), Combo 3 (T10) and Combo 4 (T12). P value vs Basal are provided as: *<0.1, <0.01 and *<0.001.

FIG. 17A-17C depicts production efficiency and mortality with NE challenge, particularly European Broiler Index (EBI) and necrotic enteritis (NE) mortality. (A) depicts European Broiler Index (EBI), (B) depicts NE mortality, and (C) charts the results, with better % vs basal indicated by a color coding (blue being better, red being worse). The Diet is noted on the lower axis of each A and B chart: Basal (T02), BMD (T04), Combo 1 (T06), Combo 2 (T08), Combo 3 (T10) and Combo 4 (T12).

Figure 18:
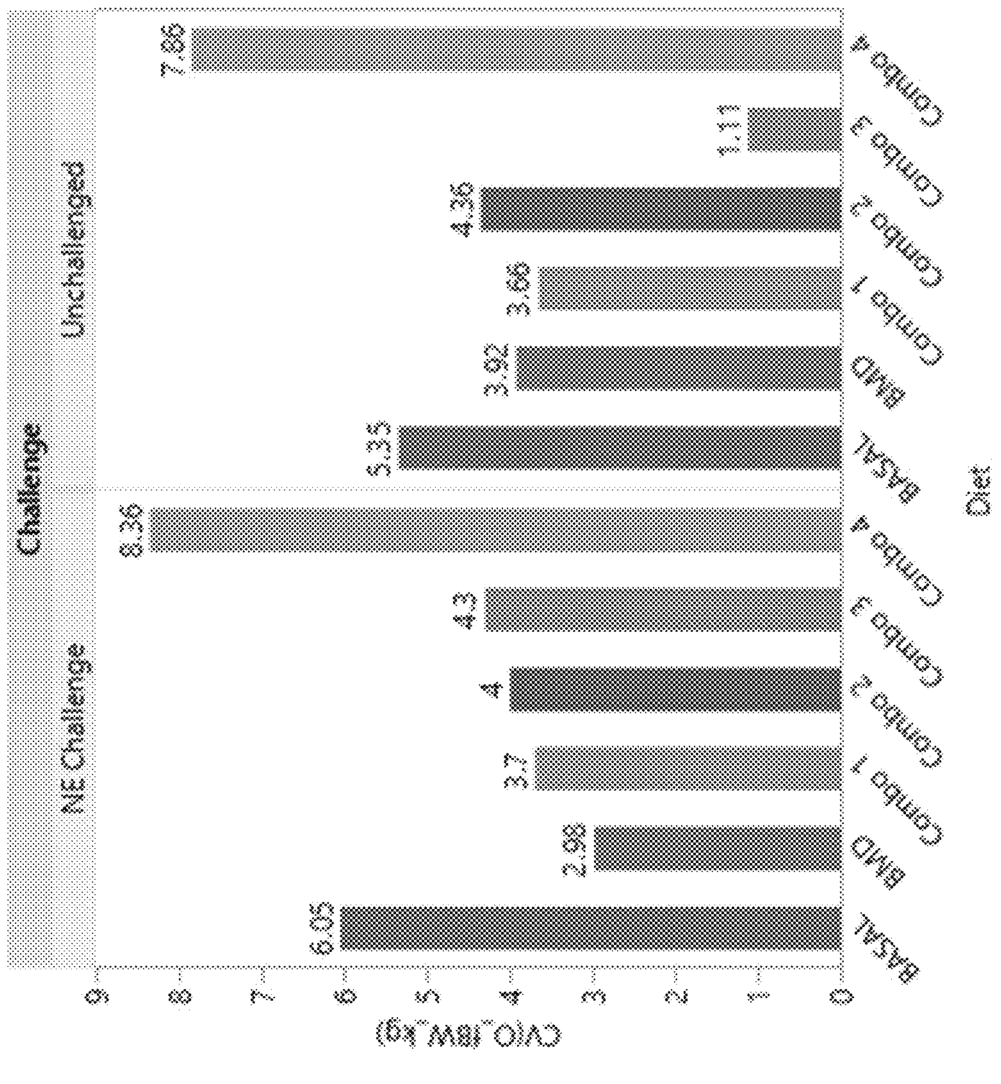
Figure 19:
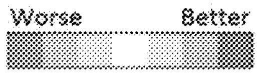

FIG. 18 provides a chart of pen weight uniformity with the left side of the chart results being with NE challenge and the right side of the chart results being unchallenged. The Diet is noted on the lower axis of the chart: Basal (T02), BMD (T04), Combo 1 (T06), Combo 2 (T08), Combo 3 (T10) and Combo 4 (T12), FIG. 19 provides an overall data result comparison of Combo 3 (strains BSUB19105+BAMY20071+BAMY19024) versus BMD and the % difference versus control (Ctrl) which is Basal diet. The results are charted, with better % vs basal indicated by a color coding (blue being better, red being worse).

Figure 20:
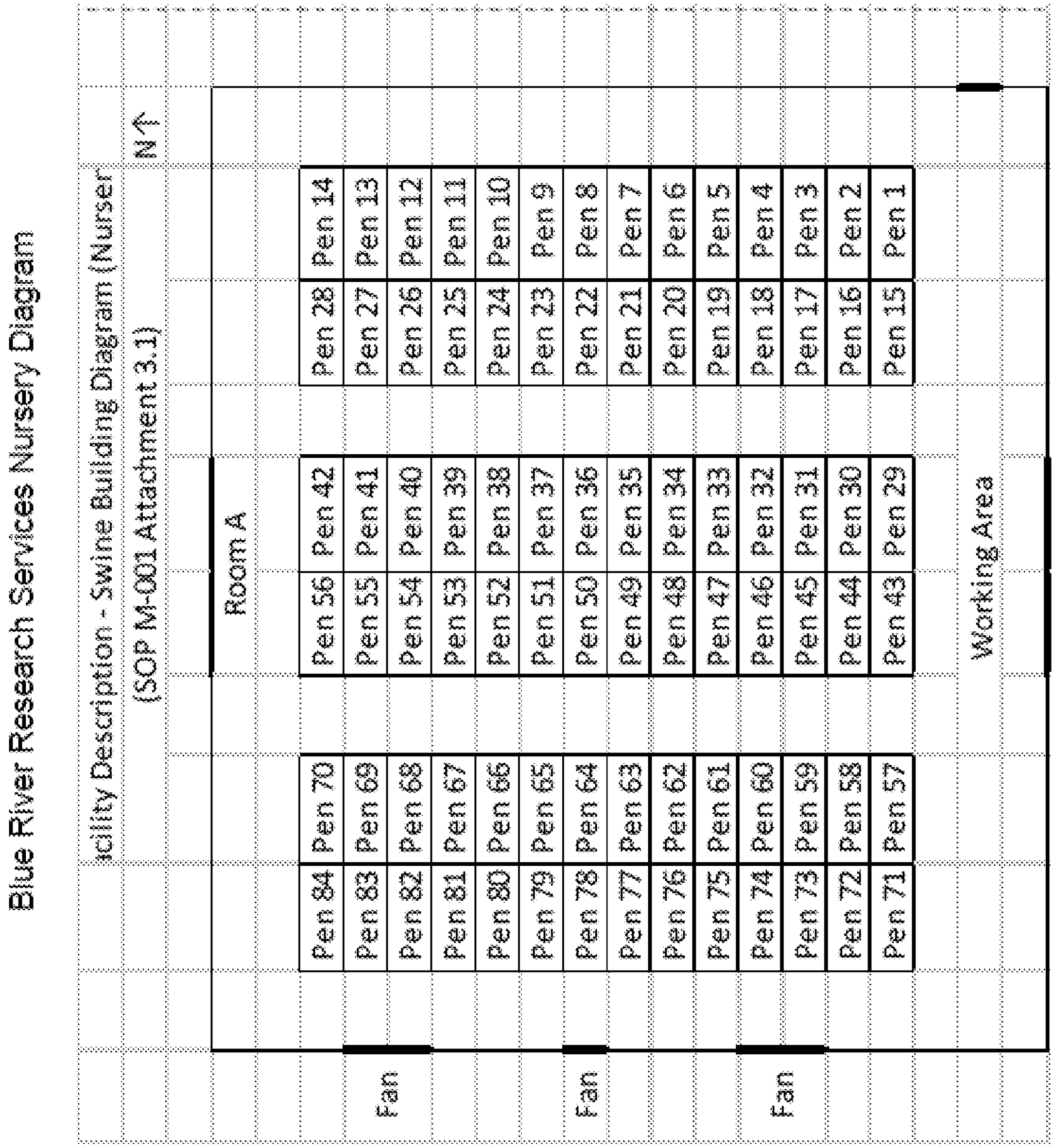

FIG. 20 provides a diagram of the facility where the *Bacillus* probiotic blends study in domestic pigs was conducted.

Figure 21:
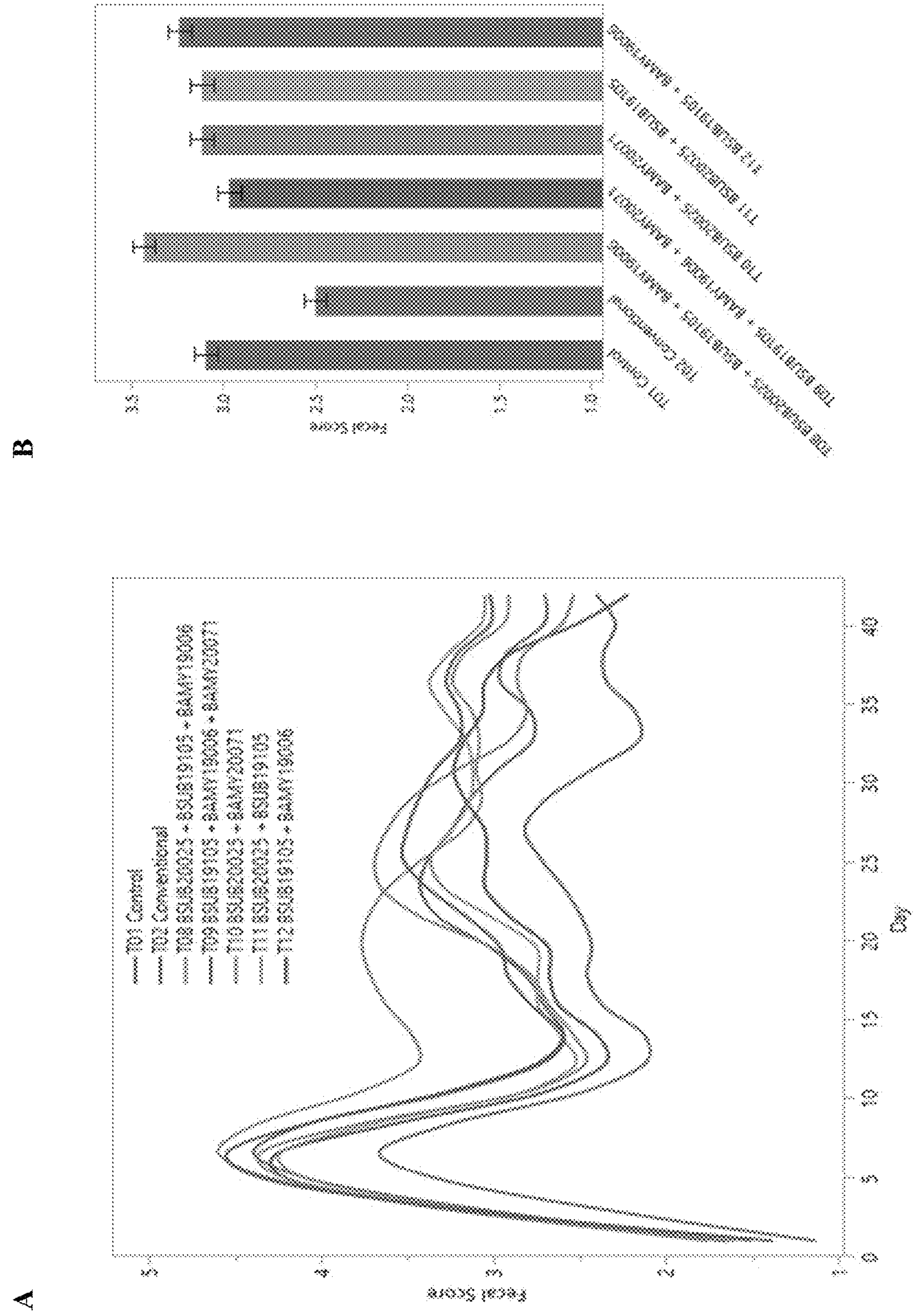

FIG. 21A-21B depicts (A) a graph of fecal scores over the course in days of the study, using a 1 (none) to 5 (severe) scoring system, determined for various treatments and doses, and (B) a chart of the overall average fecal score. Comparisons of each of the following were assessed: T01 (control—no antibiotic), T02 (conventional—Tylan antibiotic), T08 (BSUB20025+BSUB19105+BAMY19006), T09 (BSUB19105+BAMY19006+BAMY20071), T10 (BSUB20025+BAMY20071), T11 (BSUB20025+BSUB19105) and T12 (BSUB19105+BAMY19006). Fecal scoring was as follows: 1=None (normal feces), 2=Minimal (slightly soft feces), 3=Mild (soft, partially formed feces), 4=Moderate (loose, semi-liquid feces), 5=Seever (watery, mucous-like feces).

FIG. 22A-22D depicts pen performance evaluated for several parameters. (A) provides average daily gain (ADG) (B) provides average daily feed intake (ADFI), (C) provides Gain:Feed (GF). (D) charts the final body weight (BW), ADG, ADFI and Gain:Feed ratio versus control, with better % vs control (which is set at 0%) indicated by a color coding (blue being better, red being worse). Comparisons of each of the following were assessed: T01 (control—no antibiotic), T02 (conventional—Tylan antibiotic), T08 (BSUB20025+BSUB19105+BAMY19006 or 25+105+6), T09 (BSUB19105+BAMY19006+BAMY20071 or 105+6+71), T10 (BSUB20025+BAMY20071 or 25+71), T11 (BSUB20025+BSUB19105 or 25+105) and T12 (BSUB19105+BAMY19006 or 105+6).

FIG. 23A-23D depicts individual performance evaluated for several parameters. (A) provides average daily gain (ADG) (B) provides average daily feed intake (ADFI), (C) provides Gain:Feed (GF). (D) charts the final body weight (BW), ADG, ADFI and Gain:Feed ratio versus control (which is set at 0%), with better % vs control indicated by a color coding (blue being better, red being worse). Comparisons of each of the following were assessed: T01 (control—no antibiotic), T02 (conventional—Tylan antibiotic), T08 (BSUB20025+BSUB19105+BAMY19006 or 25+105+6), T09 (BSUB19105+BAMY19006+BAMY20071 or 105+6+71), T10 (BSUB20025+BAMY20071 or 25+71), T11 (BSUB20025+BSUB19105 or 25+105) and T12 (BSUB19105+BAMY19006 or 105+6).

Figure 24:
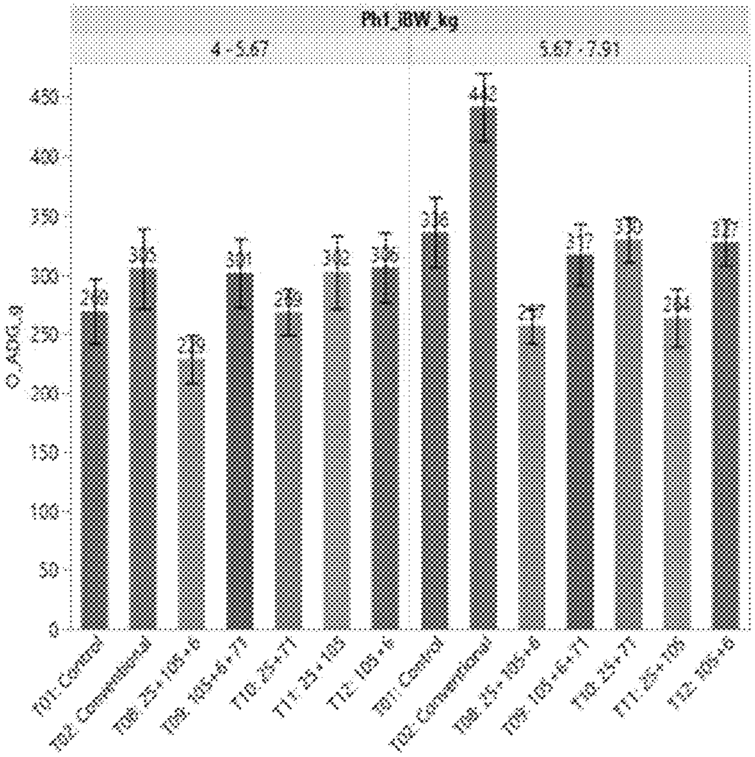

FIG. 24A-24B provides analysis of various parameters on the basis of the size of the animals (piglets). (A) graphs average daily gain (ADG) for two body weight categories of Phase 1 (Phi) body weight: 4-5.67 kg and 5.67-7.91 kg. (B) provides a chart of analysis of parameters, particularly Phase 3 (Ph3) body weight, average daily feed intake (ADFI), average daily gain (ADG) and grain:feed (GF) in smaller piglets (3.9-5.7 kg body weight) (top panels) and in larger piglets (5.7-7.9 kg) (bottom panels) versus control (which is set at 0%), with better % vs control indicated by a color coding (blue being better, red being worse). Comparisons of each of the following were assessed: T01 (control—no antibiotic), T02 (conventional—Tylan antibiotic), T08 (BSUB20025+BSUB19105+BAMY19006 or 25+105+6), T09 (BSUB19105+BAMY19006+BAMY20071 or 105+6+71), T10 (BSUB20025+BAMY20071 or 25+71), T 1 (BSUB20025+BSUB19105 or 25+105) and T12 (BSUB1915+BAMY19006 or 105+6).

Figure 25:
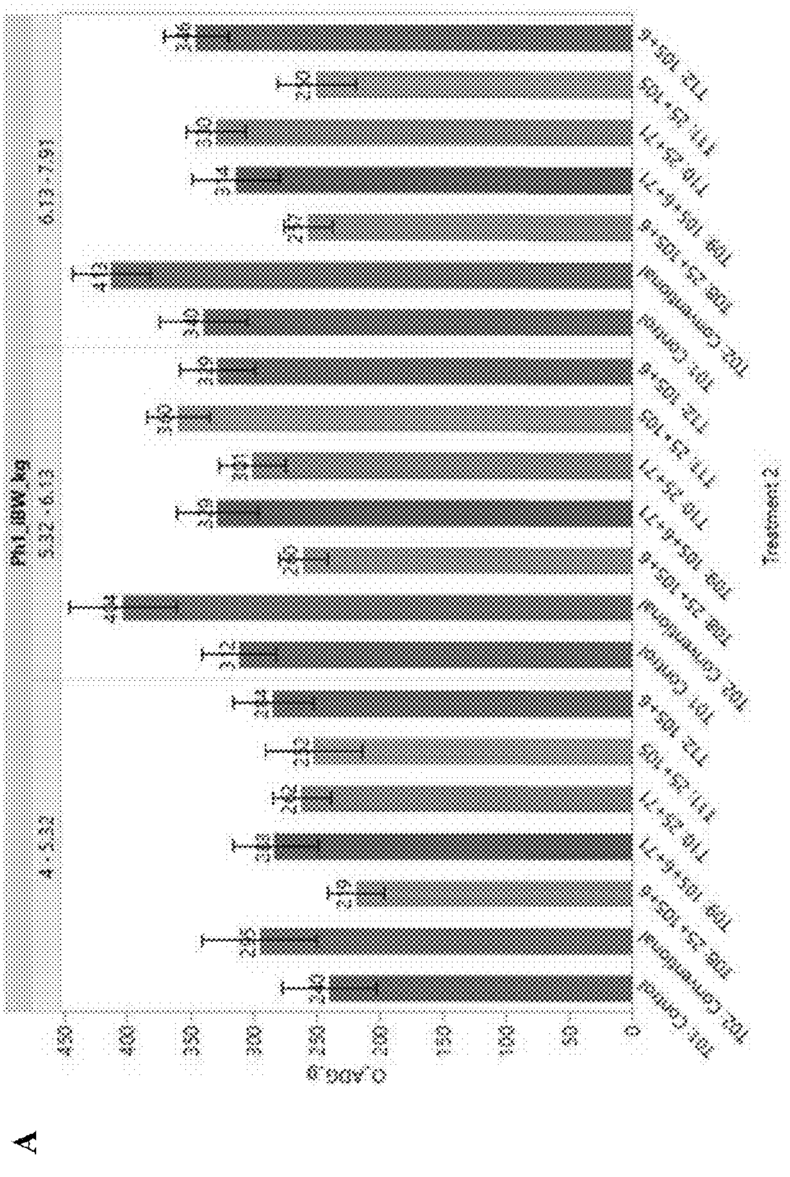

FIG. 25A-25B depicts average daily gain (ADG) for various piglet sizes. (A) graphs ADG for piglets in body weight ranges of 4-5.32 kg (first set), 5.32-6.13 kg (middle set) and 6.13-7.91 kg (right set). Comparisons of each of the following were assessed: TO1 (control—no antibiotic), T02 (conventional—Tylan antibiotic), T08 (BSUB20025+BSUB19105+BAMY 19006 or 25+105+6), T09 (BSUB19105+BAMY19006+BAlMY20071 or 105+6+71), T10 (BSUB20025+BAMY20071 or 25+71), T11 (BSUB20025+BSUB19105 or 25+105) and T12 (BSUB19105+BAMY19006 or 105+6). (B) provides a chart comparison ofADG for small, medium and large piglets according to body weight and compares conventional (conv), 105+6 (T12; BSUB19105+BAMY19006) and 105+6+71 (T09; (BSUB19105+BAMY 19006+BAMY20071).

Figure 26:
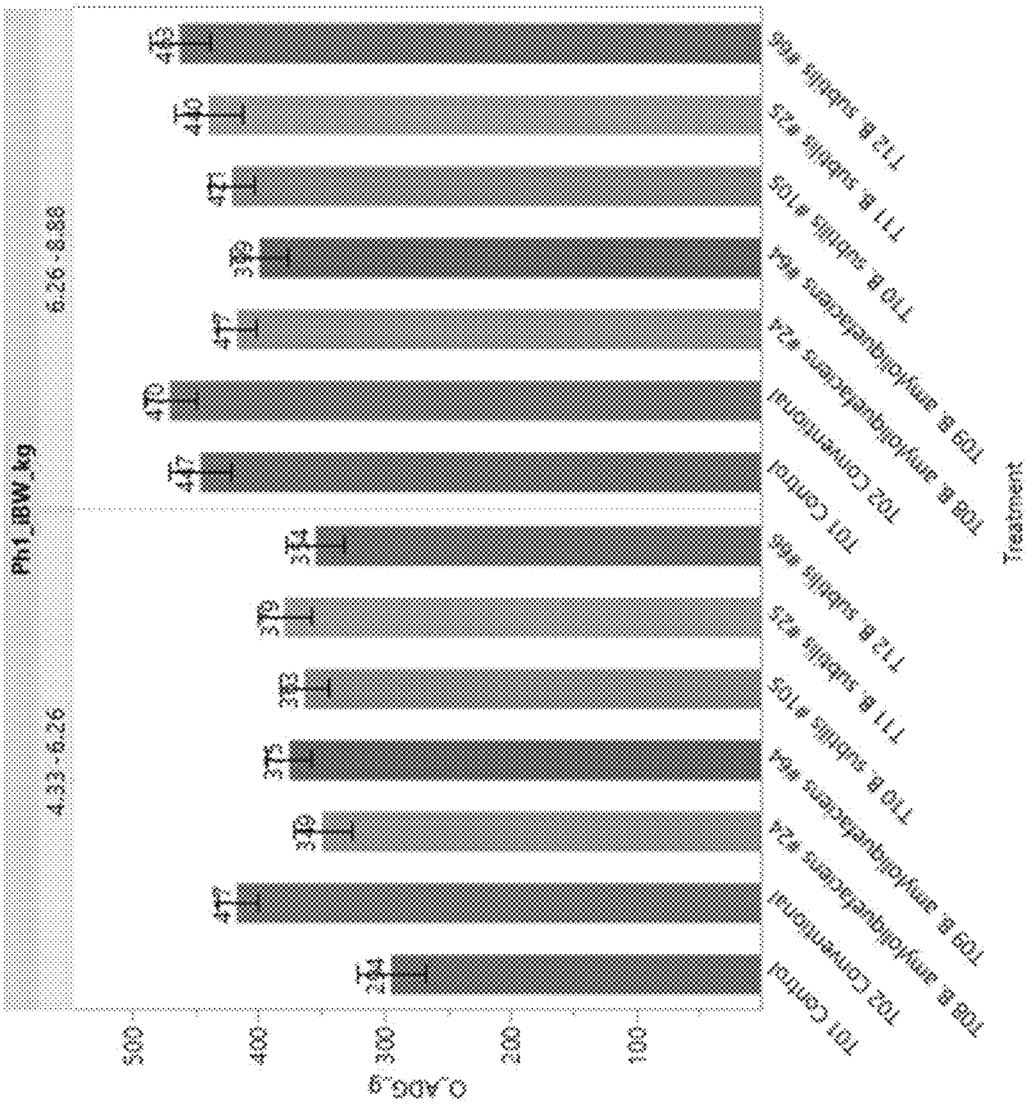

FIG. 26 provides a graph of a separate additional study of average daily gain (ADG) for two body weight categories of Phase 1 (Ph 1) body weight: 4.33-6.26 kg and 6.26-8.88 kg. Treatments compared for each body weight group of animals are T01 (control—no antibiotic), T02 (conventional—Tylan antibiotic), T08 (*B. amyloliquefaciens* #24; strain ELA191024), T09 (*B. amyloliquefaciens* #64), T10 (*B. subtilis* #105; strain BSUB19105 or ELA 191105), T11 (*B. subtilis* #25; strain BSUB20025) and T12 (*B. subtilis* #66). In body weight category 4.33-6.26 kg ADG was increased+18 to +29%, while in body weight category 6.26-8.88 kg ADG was altered −1.8 to +4%.

Figure 27:

FIG. 27 provides details of the dose titration evaluation of the *B. subtilis* plus *B. amyloliquefaciens* strain combination 105+6+71. Phase 1 represents days 0 to 7, Phase 2 represents days 7 to 21 and Phase 3 represents days 21 to 42. Control animals TO1 were without antibiotic or pharmacological levels of Zn and T02 animals were administered Zn from ZnO. In testing T03 through T08, total doses (CFU/g) of Blend A (alternative bacteria) or of Blend B (strains 105+6+71) of either 75K (75,000), 150K (150,000) or 300K (300,000) were administered.

Figure 28:
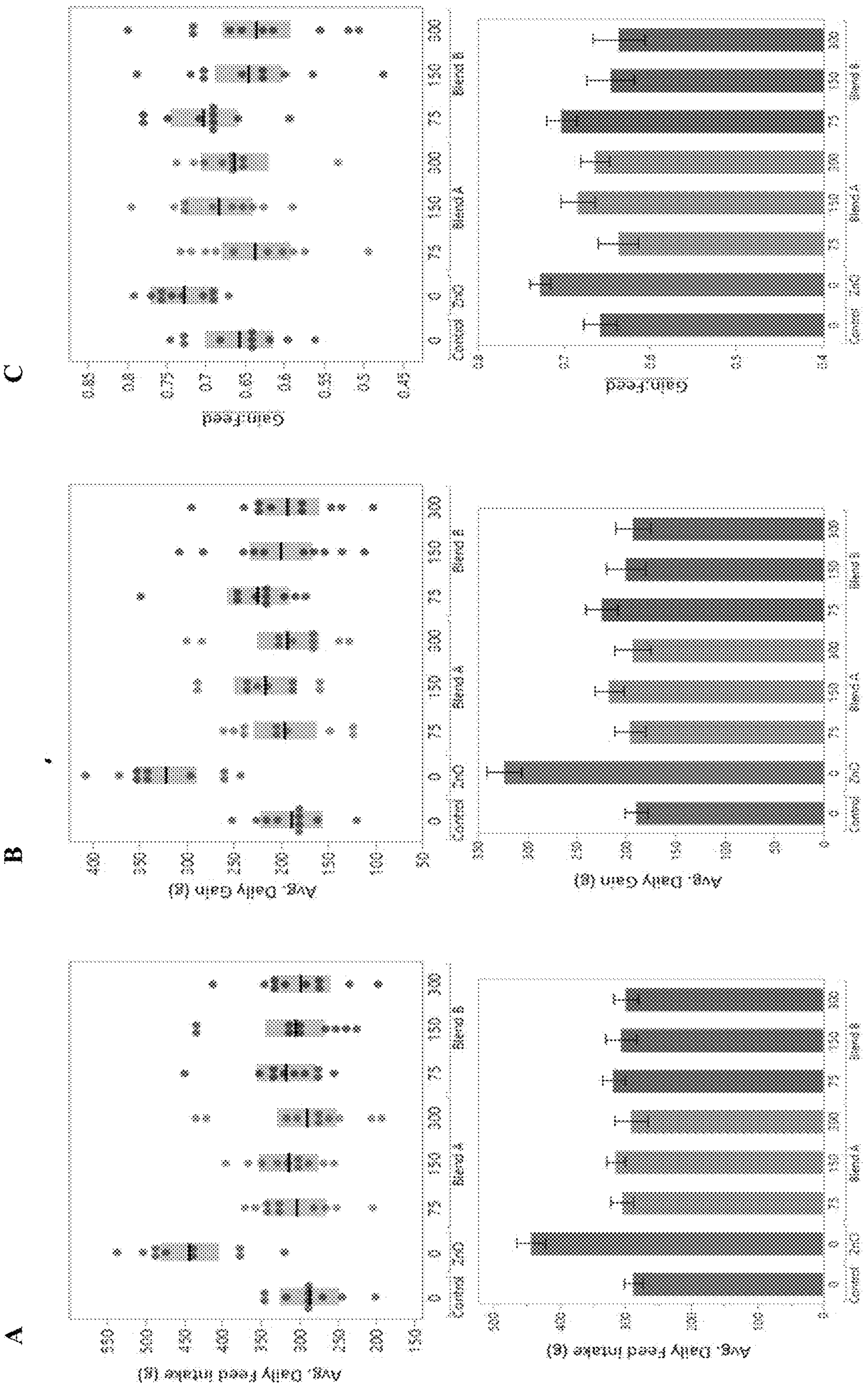

FIG. 28 depicts pen performance days 0 to 21 evaluated for several parameters. (A) upper and lower panels provide average daily feed intake (ADFI) (g), (B) upper and lower panels provide average daily gain (ADG) (g), (C) upper and lower panels provide Gain:Feed (GF). Control, ZnO, Blend A and Blend B (strains 105+6+71). The Blends were assessed with administration of 75, 150 and 300K CFU/g.

Figure 29:
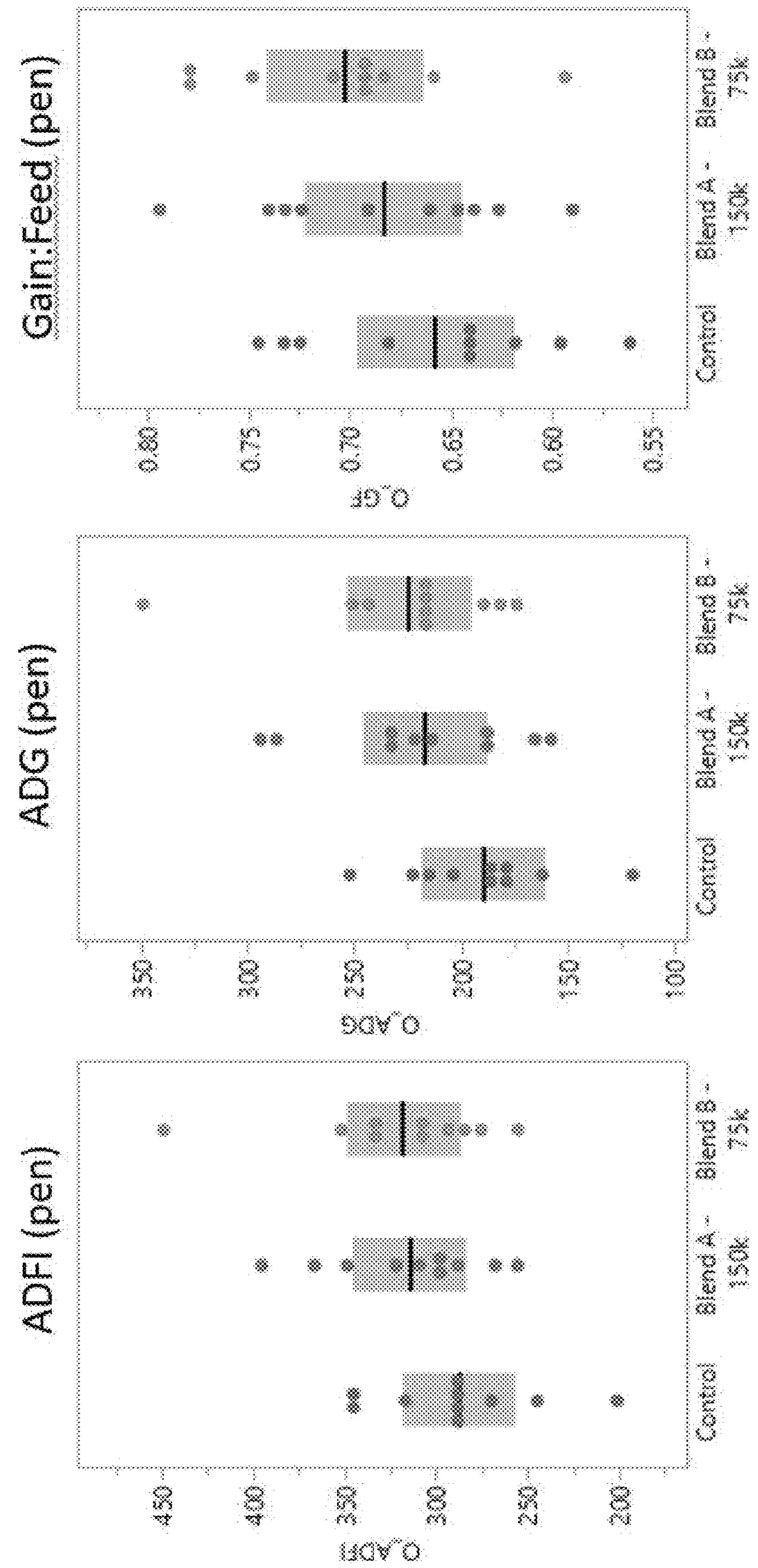

FIG. 29 depicts comparison of optimal doses days 0-21. The Blend B dose of 75K CFU/g was compared directly with the higher optimal dose of 150K of Blend A. (A) provides average daily feed intake (ADFI) for the pen, (B) provides average daily gain (ADG) for the pen in grams (g), (C) depicts gain:feed for the pen, (D) provides a comparison of the ADG for the pigs and (E) shows a quantitative comparison of the results.

Figure 30:
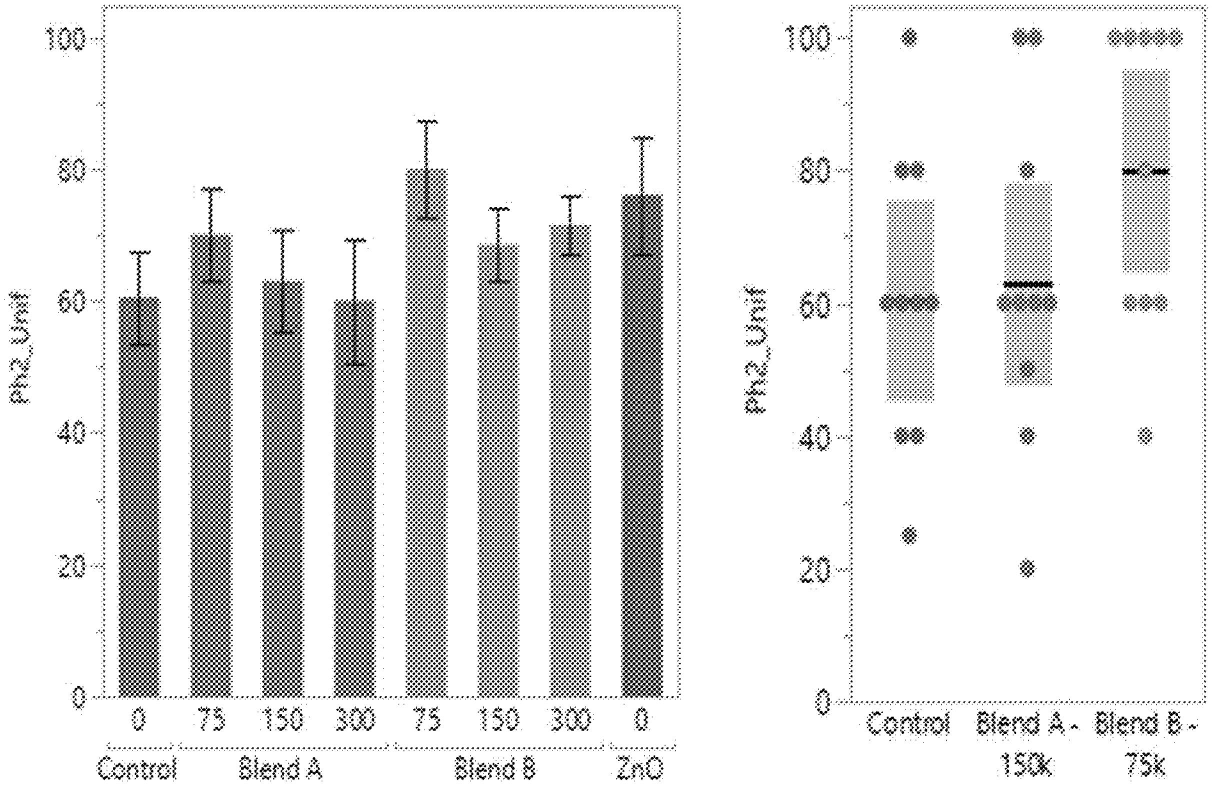

FIG. 30 depicts bodyweight uniformity at Day 21. Blend B and Blend A at each of75K, 150K and 300K doses are assessed versus Control and ZnO feed administration. The percentage (%) of pigs with bodyweight within 15% of pen average is provided in (A). (B) provides a tabulation of the quantitative comparison.

Figure 31:
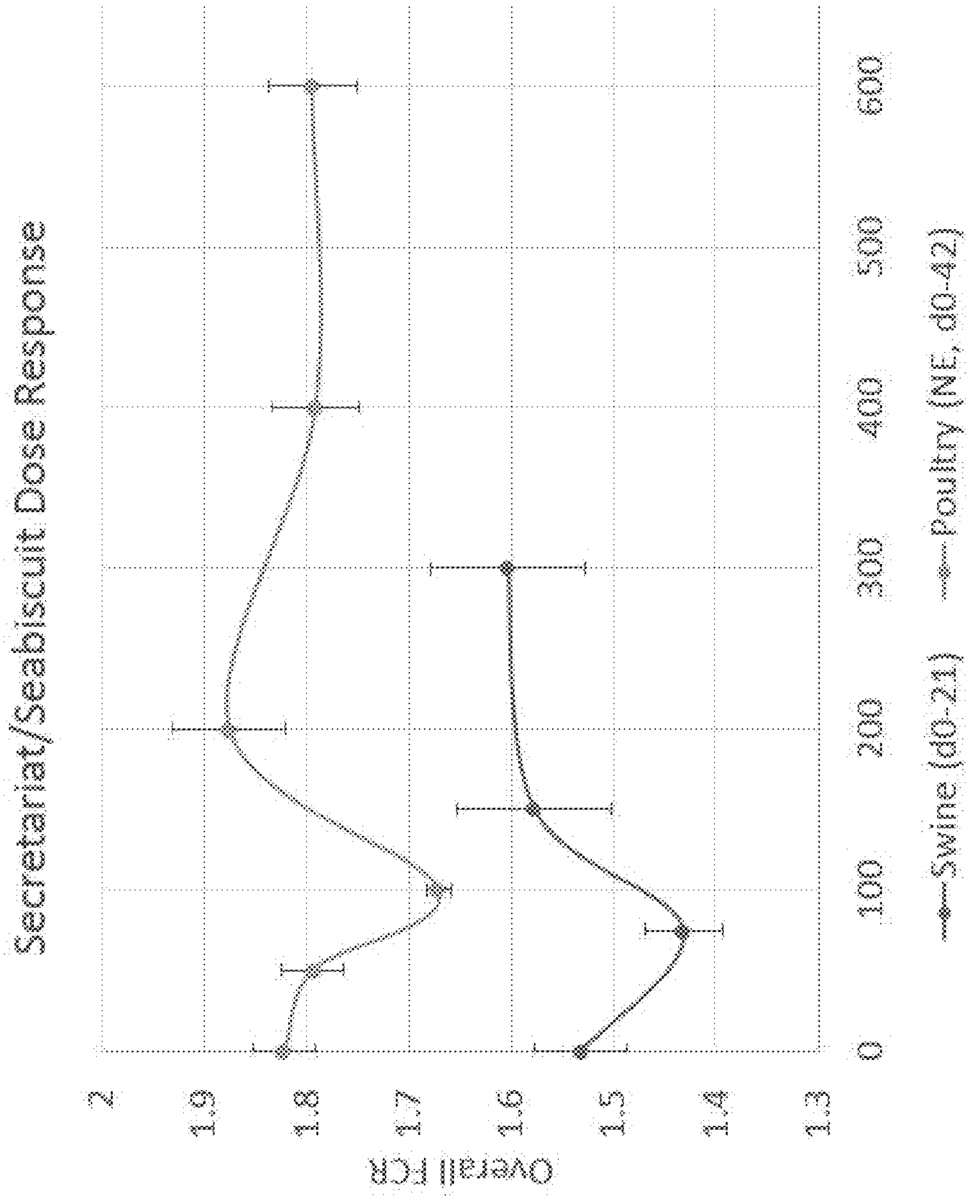

FIG. 31 provides a comparison of the dose response in poultry and swine. Response in swine (d0-21) and Poultry (NE challenge, d0-42) to doses of the *bacillus* strain blend 105+6+71 75K, 100K, 150K, 200K, 300K 400K and 600K are depicted.

Figure 32:
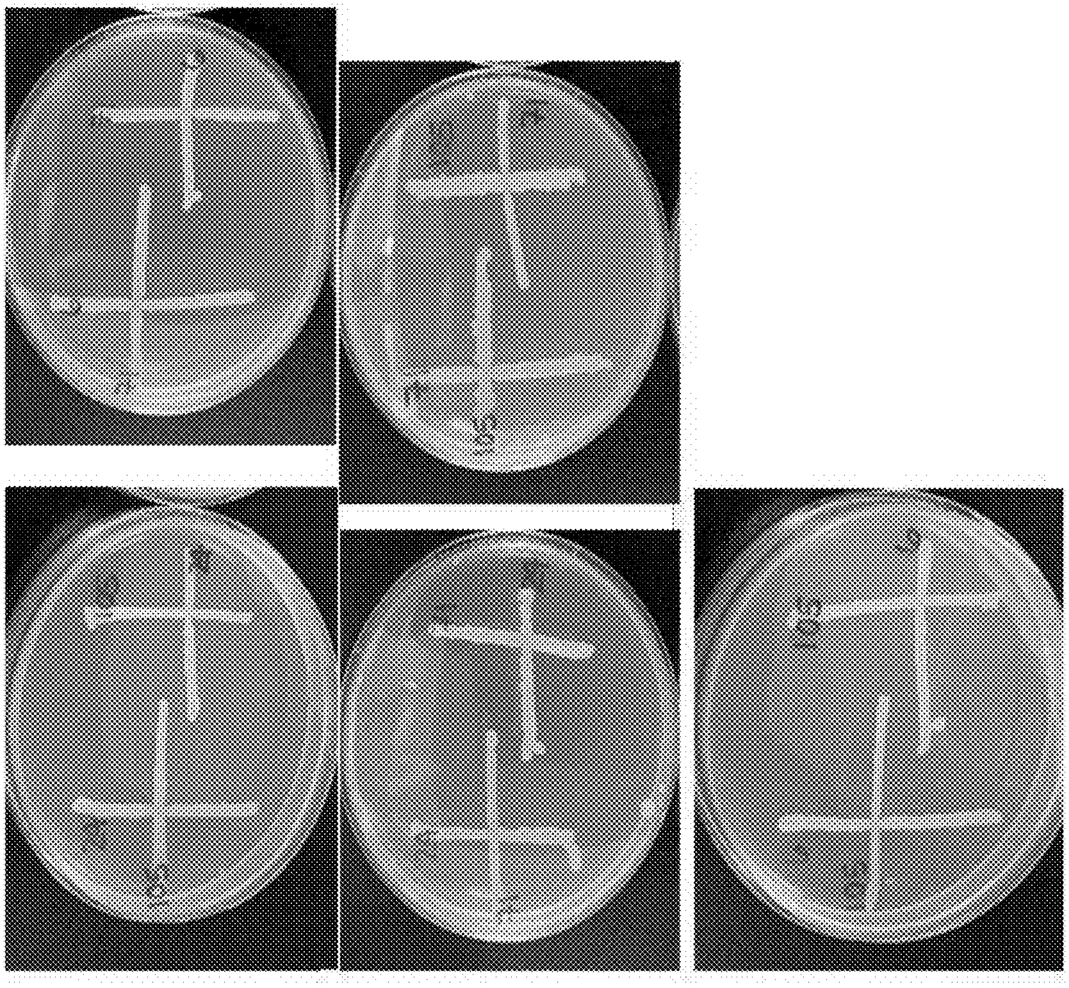

FIG. 32 depicts evaluation of the compatability of the strains *B. subtilis* 105 (BSUB19105), *B. amyloliquefaciens* 6 (BA MY19006), *B. amyloliquefaciens* 24 (strain ELA191024) and *B. amyloliquefaciens* 71 (BAMY20071). Combinations of two of each of the strains (strains indicated and labeled respectively 24 and 105, 6 and 71, 24 and 71, 71 and 105 and 6 and 105) were assessed wherein one strain is streaked perpendicular to the other strain. The absence of a clearance zone at the intersection of each strain combination tested shows that all of the strains are compatible. Each of strains *B. subtilis* 105 (BSUB19105), *B. amyloliquefaciens* 6 (BAMY19006) and *B. amyloliquefaciens* 71 (BAMY20071) are compatible with one another.

FIG. 33 provides results of the evaluation of fecal *E. maxima* oocyts counts on day 23 in an in vivo poultry evaluation. Unchallenged, control, BMD, and strains blend 105+6+71 at doses of 50K, 100K, 200K, 400K and 600K are compared. (A) graphs oocytes per gram of feces. P value vs control is indicated: *<0.1, p<0.01 and *p<0.001. (B) provides a spearman correlation evaluation result.

Figure 34:
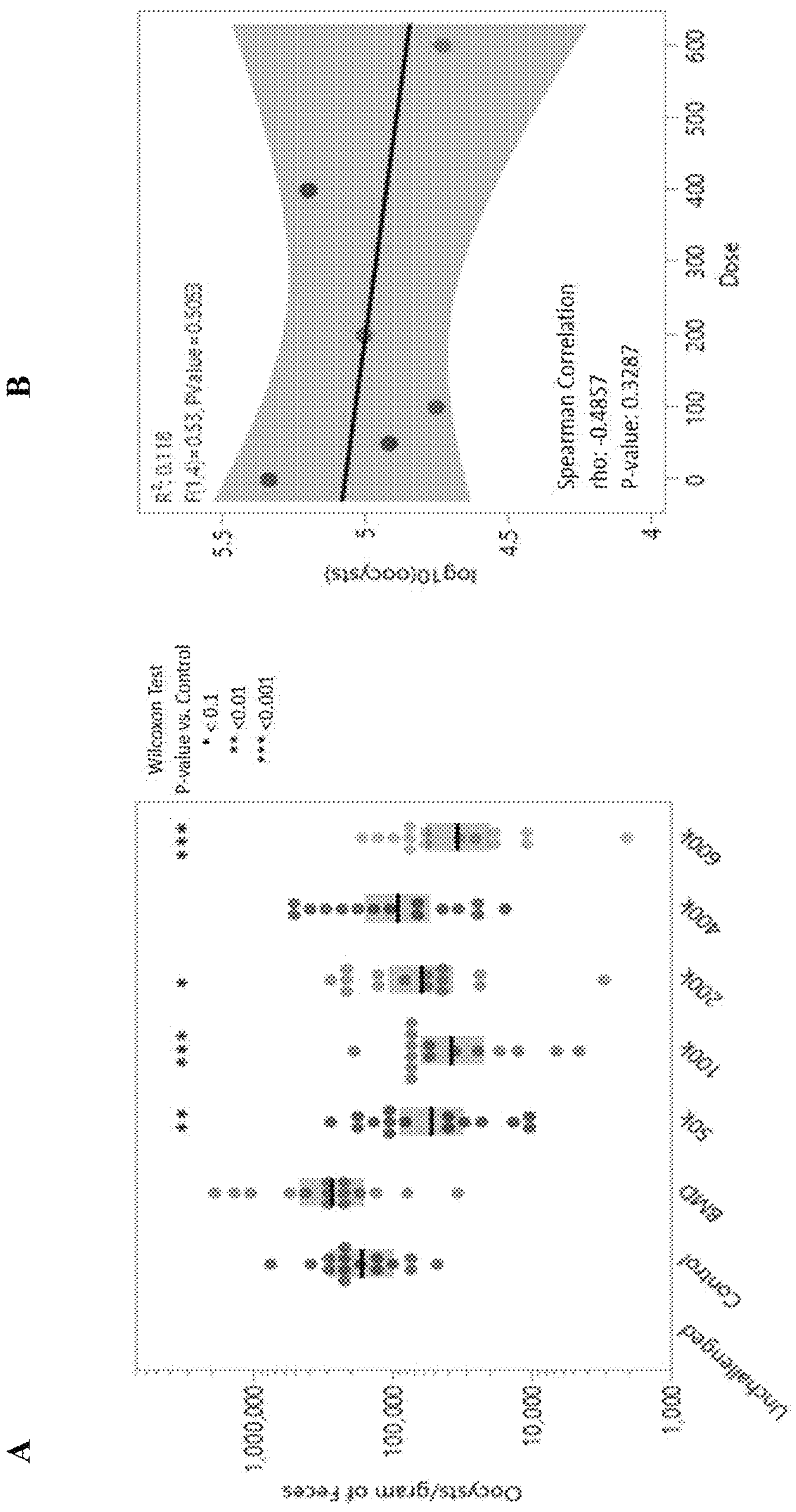

FIG. 34 provides evaluation of necrotic enteritis mortalities at days 22-27, comparing Unchallenged, control, BMD, and strains blend 105+6+71 at doses of 50K, 100K, 200K, 400K and 600K. (A) depicts the number of mortalities, (B) provides the % mortality and (C) provides a spearman correlation result of % mortality.

Figure 35:
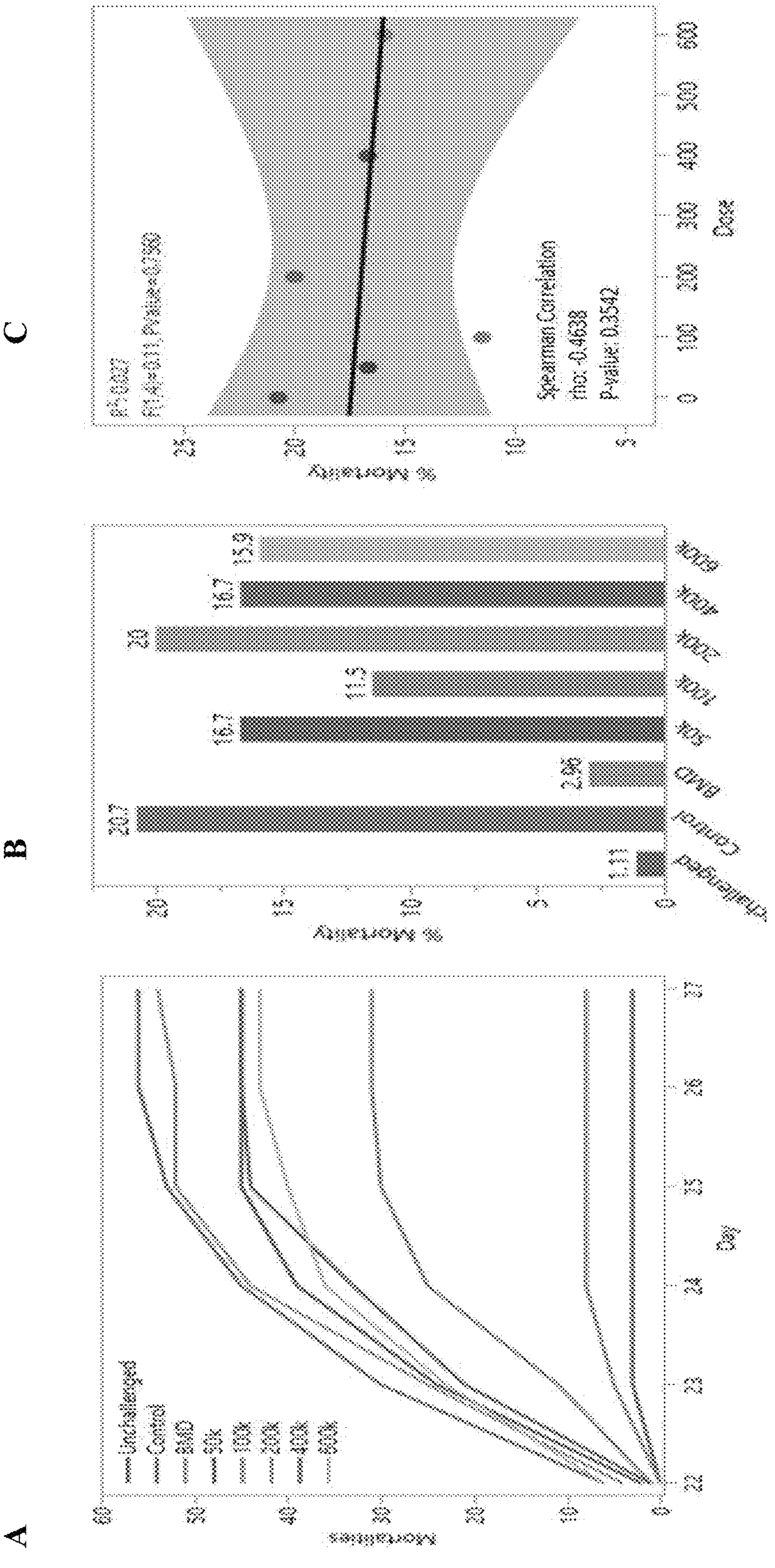

FIG. 35 depicts correlation of oocyte counts with NE mortality. Unchallenged, control, BMD, and strains blend 105+6+71 at doses of 50K, 100K, 200K, 400K and 600K are evaluated and the results of spearman correlation assessment depicted in (A) and (B).

Figure 36:
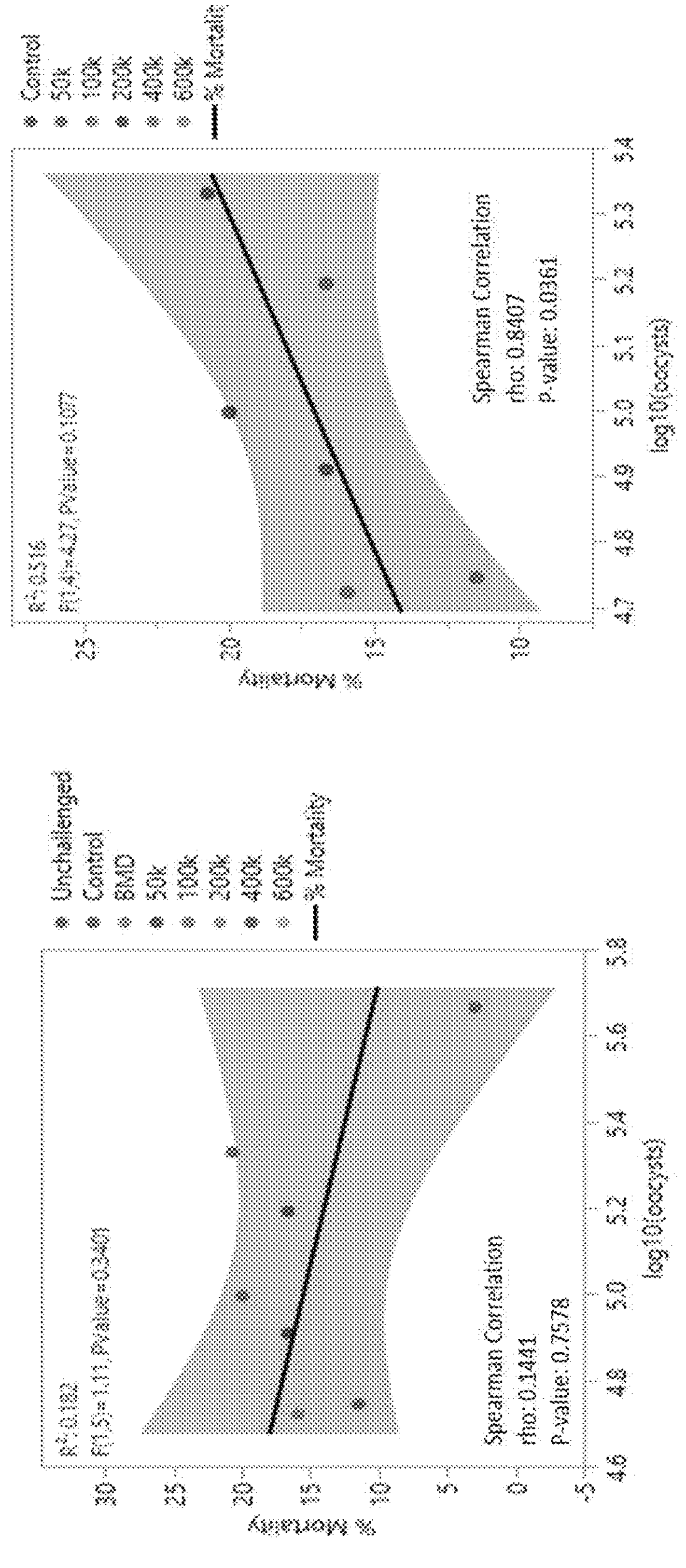

FIG. 36 provides further assessments of the efficacy of the *bacillus* 105+6+71 strain combination at a dose of 100K CFU/g in poultry. Unchallenged, control, BMD, and strains blend 105+6+71 at 100K dose are evaluated. (A) depicts % mortality, (B) depicts feed conversion ratio (FCR), (C) depicts mortality adjusted FCR, (D) provides European Broiler Index (EBI) and (E) tabulates a comparison of the results.

Figure 37:
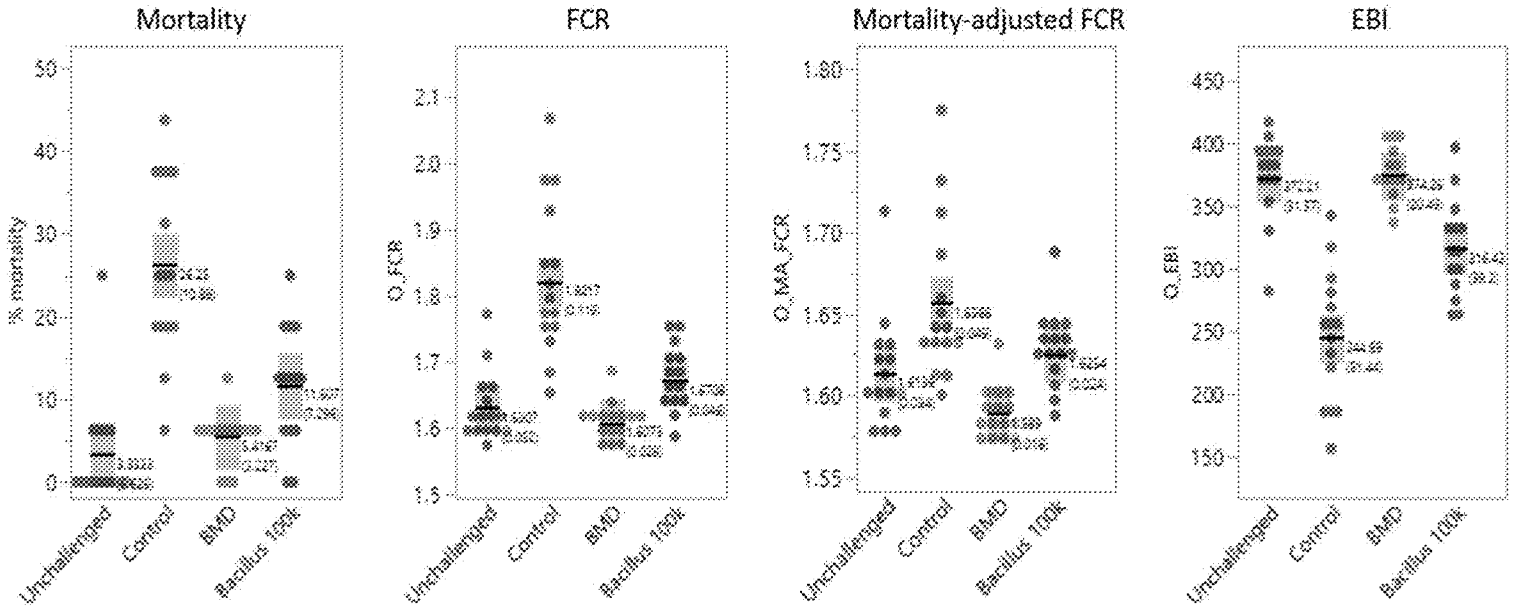

FIG. 37 shows evaluation of unadjusted performance in poultry. Unchallenged, control, BMD, and strains blend 105+6+71 at doses of 50K, 100K, 200K, 400K and 600K were evaluated (A) provides ADFI (average daily feed intake), (B) shows ADG (average daily gain) and (C) depicts FCR (feed conversion ratio).

Figure 38:
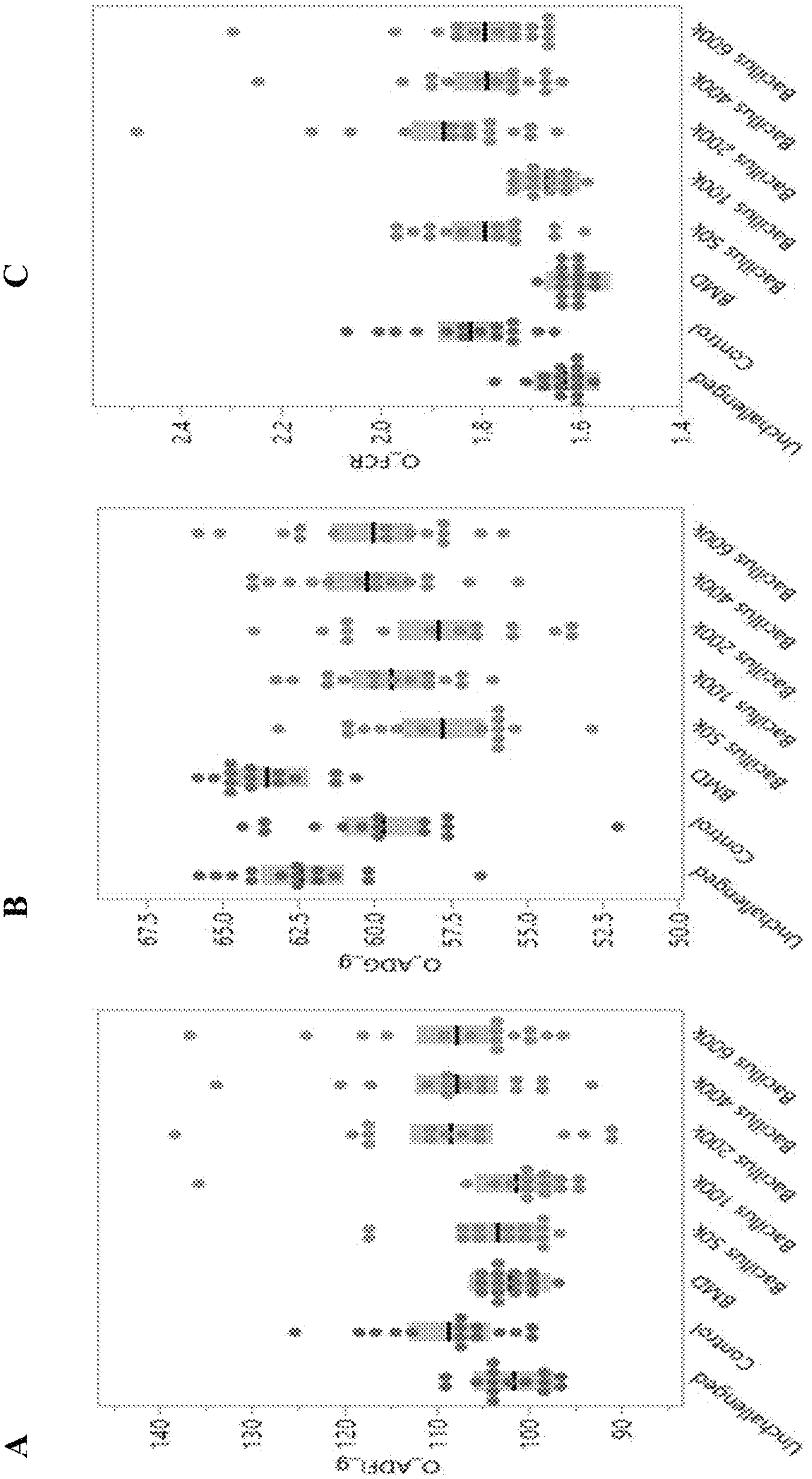

FIG. 38 depicts mortality adjusted performance and compares unchallenged, control, BMD, and strains blend 105+6+71 at doses of 50K, 100K, 200K, 400K and 600K. (A) shows MA-ADFI (average daily feed intake), (B) provides MA-ADG (average daily gain) and (C) depicts MA-FCR (feed conversion ratio).

Figure 39:
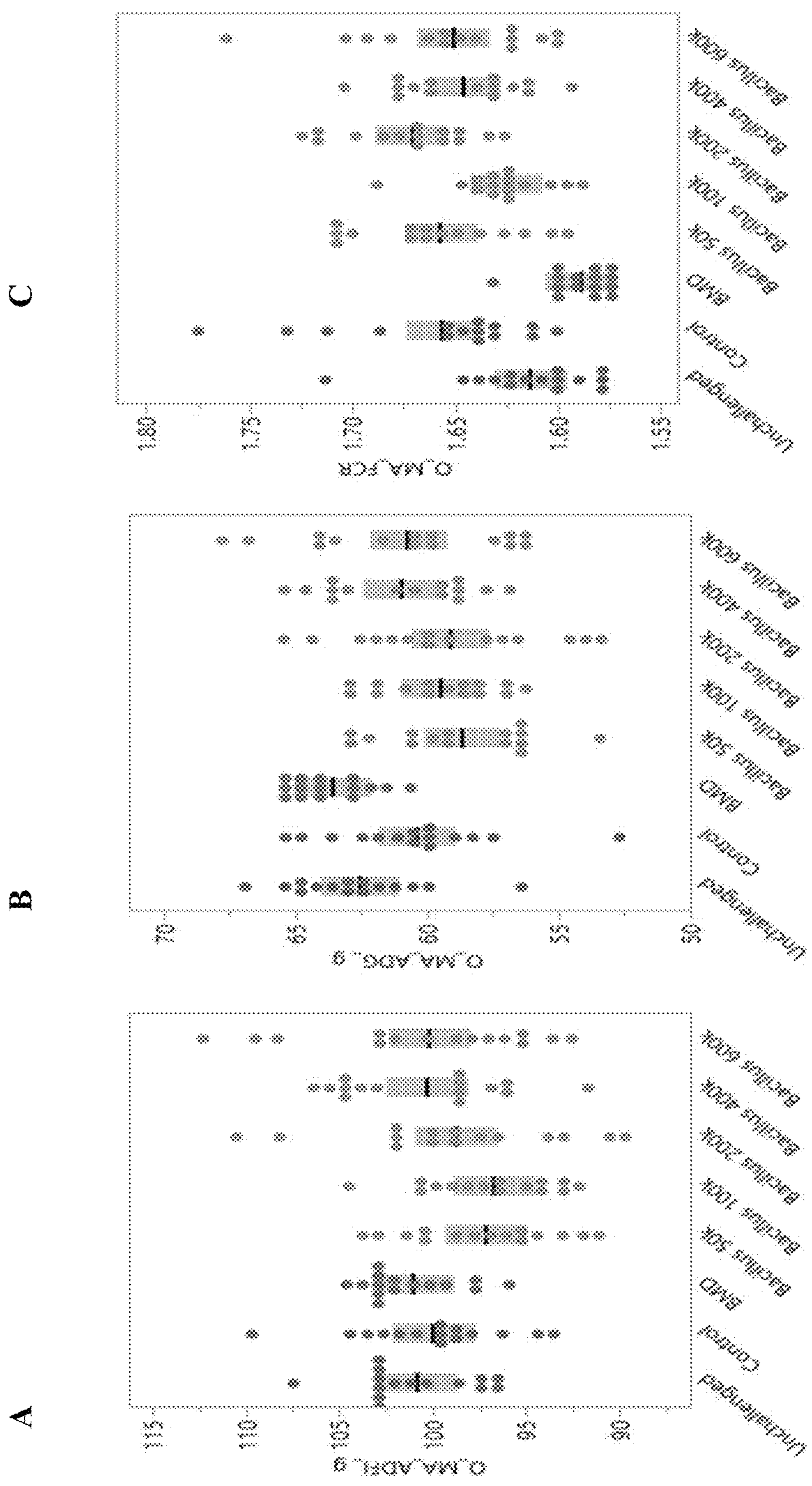

FIG. 39 shows evaluation of unchallenged, control, BMD administered, and the *bacillus* 105+6+71 combination at doses 50K, 100K, 200K, 400K and 600K for total production (A) Total Live Weight and (B) EBI (European Broiler Index).

Figure 40:
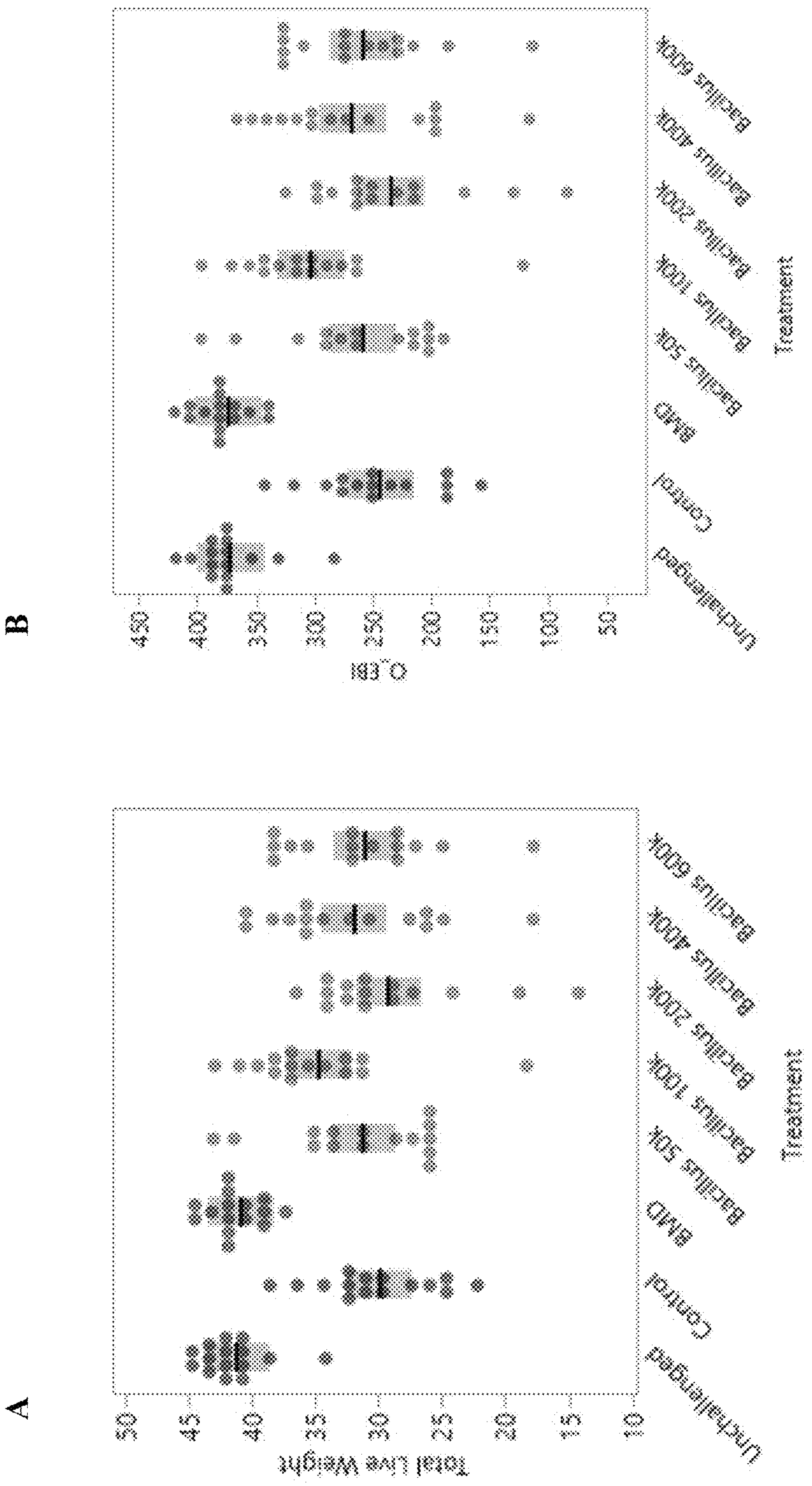

FIG. 40 shows assessment of unadjusted performance for unchallenged, control, BMD administered, and the *bacillus* 105+6+71 combination at doses 50K, 100K, 200K, 400K and 600K. (A) depicts % mortality, (B) shows ADFI, (C) provides ADG and (D) shows feed conversion ratio (FCR).

Figure 41:
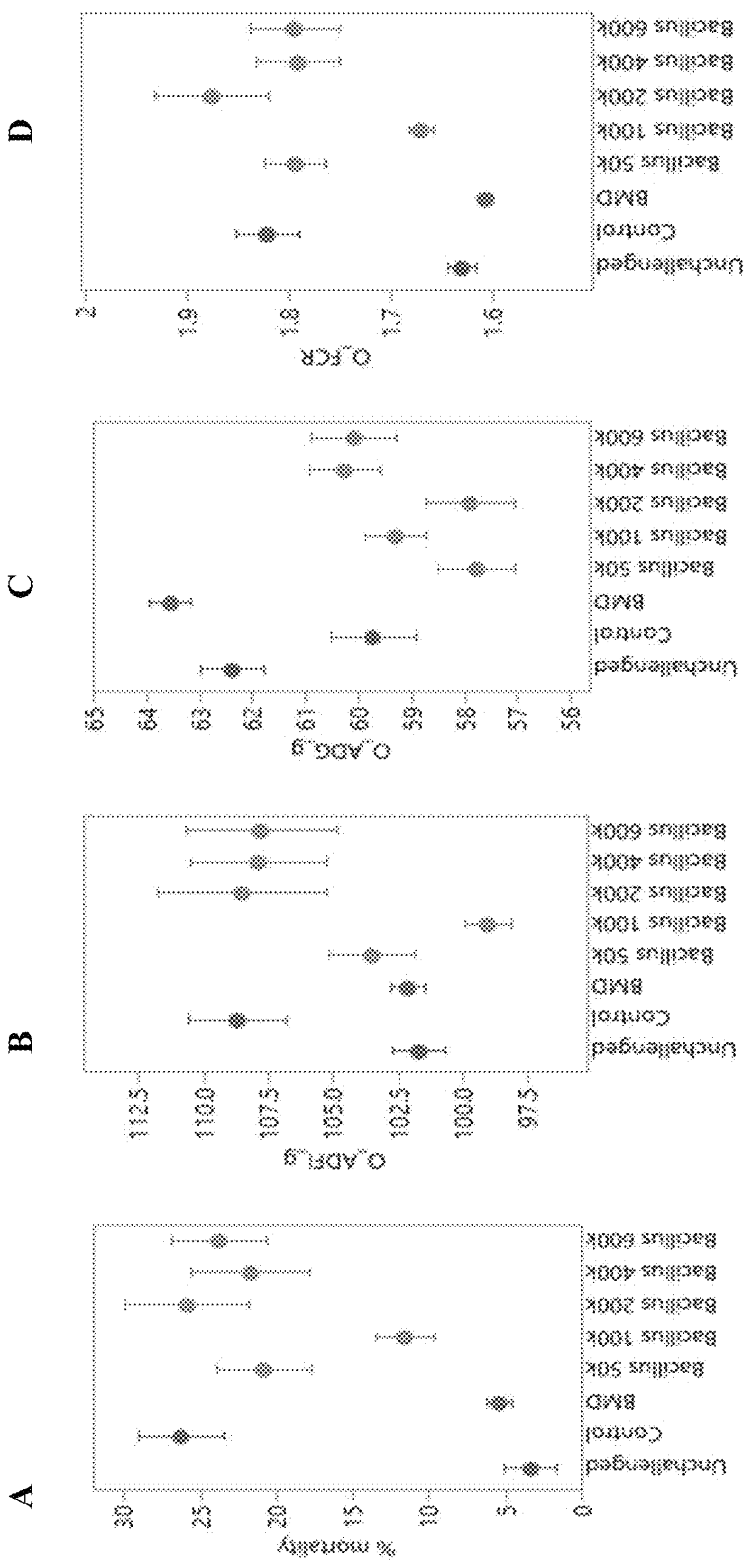

FIG. 41 provides mortality adjusted performance for unchallenged, control, BMD administered, and the *bacillus* 105+6+71 combination at doses 50K, 100K, 200K, 400K and 600K. (A) provides % mortality, (B) shows MA-ADFI, (C) provides MA-ADG and (D) depicts MA-FCR.

Figure 42:
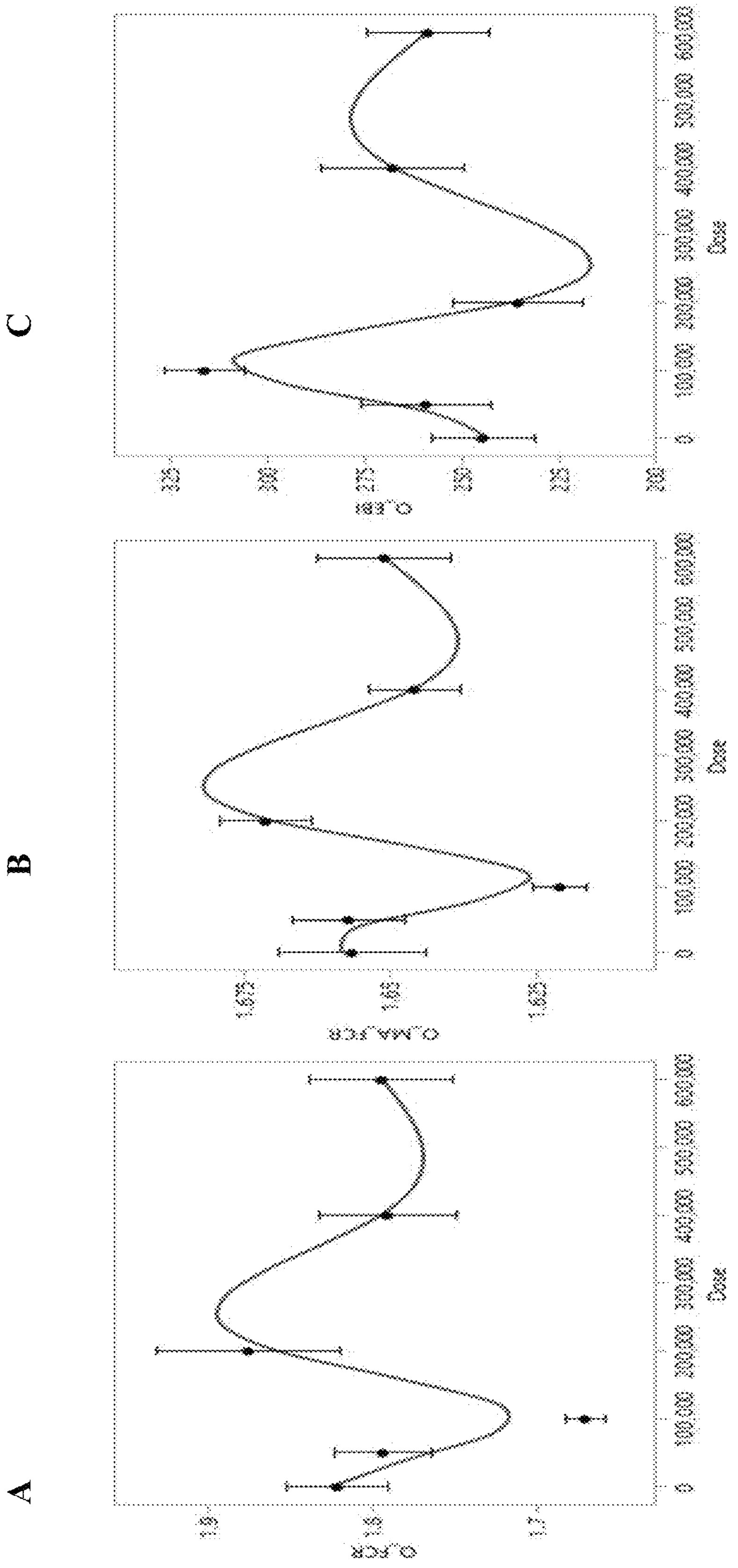
Figure 43:
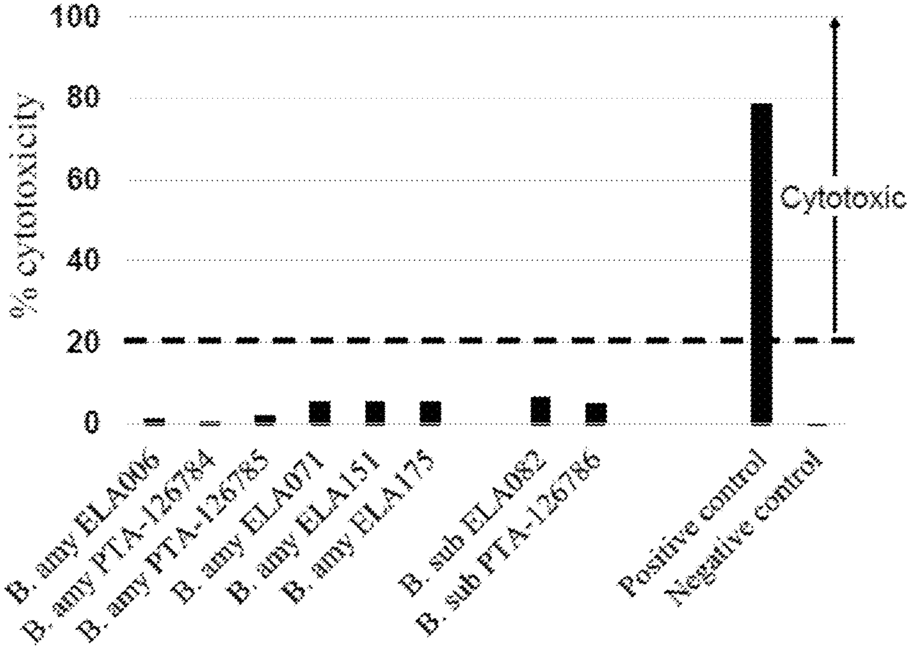

FIG. 42 provides assessment of feed efficiency dose response in poultry at *bacillus* strain 105+6+71 doses of 50K, 100K, 200K, 400K and 600K. (A) provides FCR, (B) provides MA-FCR and (C) shows EBL FIG. 43 provides safety assessment of *Bacillus* spp. DFM candidates. A. Antimicrobial susceptibility tests of *Bacillus* spp. MIC (μg/mL) values for each antibiotic tested of respective *Bacillus* spp. were shown. Nine medically important antibiotics at a concentration range of 0.06-32 μg/mL were tested and the respective antimicrobial susceptibility cut-off concentrations required for *Bacillus* spp. were shown at the top panel. B. Cytotoxicity assessment of *Bacillus* spp. culture supernatant toward Vero cells. Culture supernatant of *B. cereus* ATCC 14579 and *B. licheniformis* ATCC14580 were used as positive and negative controls, respectively. Cytotoxicity level above 20%, dashed line, is considered cytotoxic.

Figure 44:
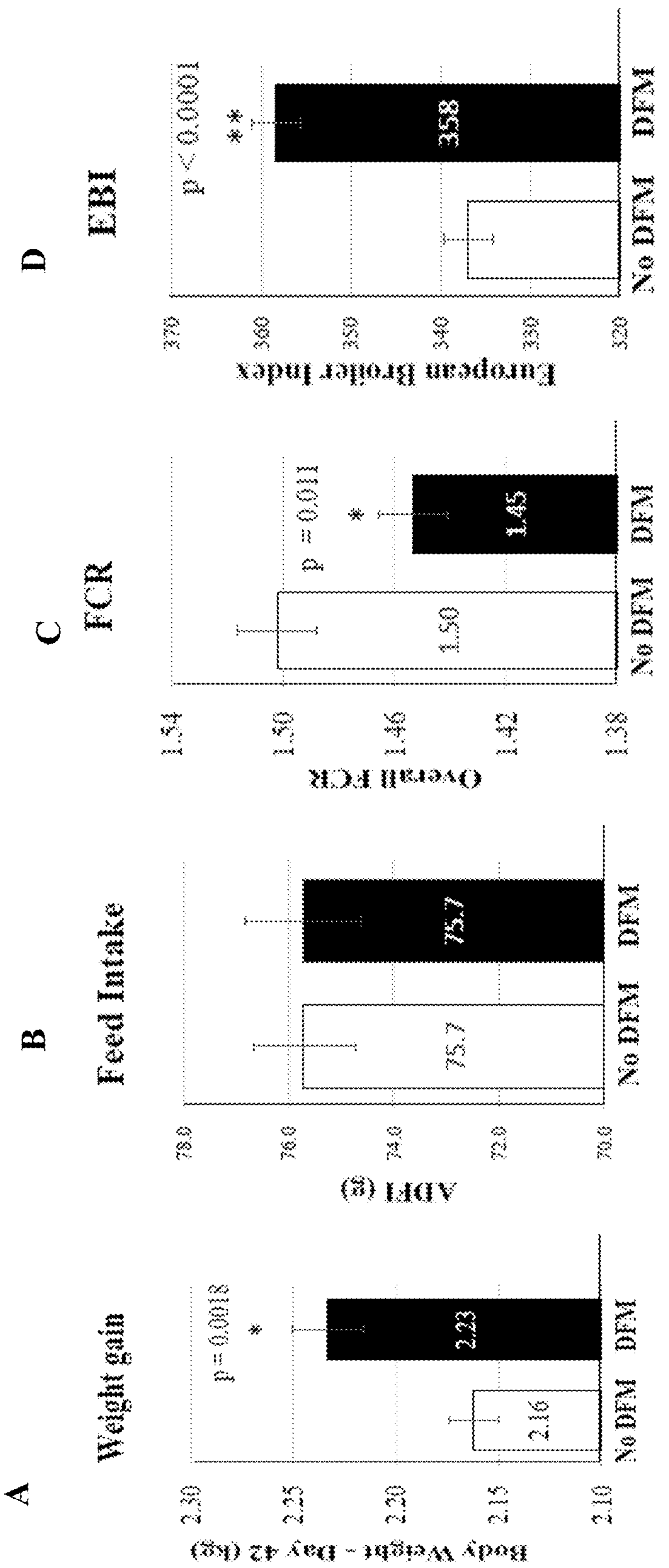

FIG. 44 depicts effect of in-feed administration of Ba PTA-84 (strain ELA191024 or strain 24) on growth performance of broiler chicken. Growth performance as measured by four parameters, A. weight gain, B. feed intake, C. Feed Conversion Ratio (FCR), and D. European Broiler Index (EBI).

Figure 45:
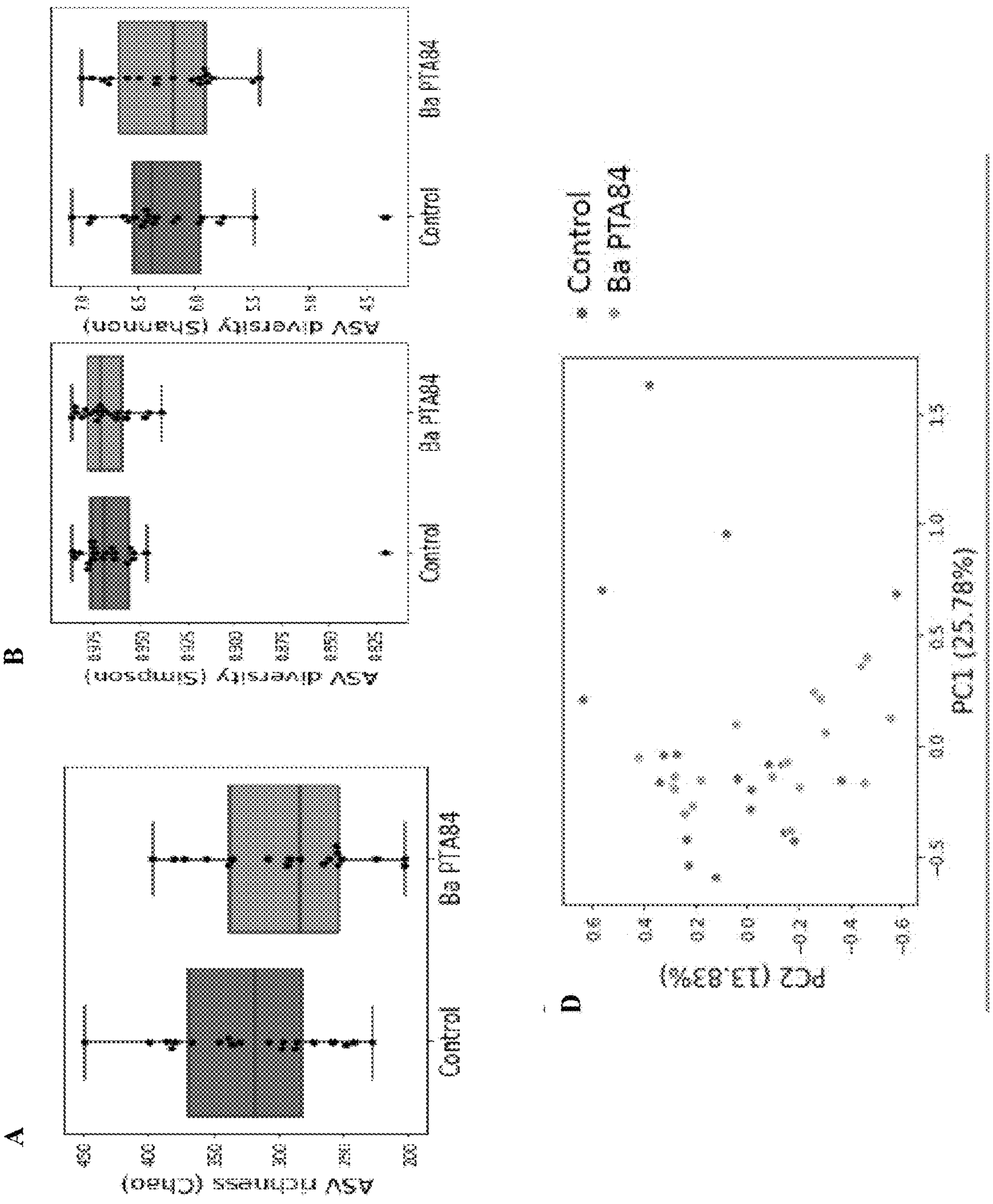

FIG. 45 provides microbiome analysis of cecal content from birds fed with or without Ba PTA84. A, Amplicon Sequence Variants (ASV) richness in the cecum of control birds and birds treated with Ba PTA84 (strain ELA191024 or strain 24). Richness is quantified using the Chao index (Mann Whitney U p-value=0.07). B. ASV diversity quantified with the Simpson (left) and Shannon indexes (right) for control birds and birds treated with Ba PTA84. (p-value=0.44, 0.36). C. Principal component analysis of the Bray-Curtis dissimilarity matrix between microbiome profiles for control birds and birds fed with Ba PTA84, Each dot represents a cecal sample. Numbers in parentheses indicate the variance explained by each principal component.

DETAILED DESCRIPTION

In an embodiment, the disclosure provides for a composition having one or more of an isolated *Bacillus amyloliquefaciens* and an isolated *Bacillus subtilis* strain, wherein the composition includes a carrier that is suitable for animal consumption or use.

In an embodiment, a composition is provided comprising a combination of *Bacillus* strains. In an embodiment, the combination provides at least two or two or more *Bacillus* strains which are compatible but do not naturally occur together and/or are not naturally present in combination in a host or animal. In an embodiment, a composition is provided comprising at least one isolated *Bacillus amyloliquefaciens* strain and one *Bacillus subtilis* strain. In an embodiment, a composition is provided comprising two distinct isolated *Bacillus amyloliquefaciens* strains and one *Bacillus subtilis* strain. In an embodiment, a composition is provided comprising a first isolated *Bacillus amyloliquefaciens* strain, a second isolated *Bacillus amyloliquefaciens* strain, and a *Bacillus subtilis* strain. In an embodiment, a composition is provided comprising a first isolated *Bacillus amyloliquefa-*

*ciens* strain, a second isolated *Bacillus amyloliquefaciens* strain, and one or more *Bacillus subtilis* strain.

In an embodiment the composition disclosed herein includes two different isolated *Bacillus amyloliquefaciens* strains or one isolated *Bacillus amyloliquefaciens* strain, and one *Bacillus subtilis* strain, wherein the composition includes a carrier that is suitable for animal consumption or use. By way of example, the composition may include a first isolated *Bacillus amyloliquefaciens* strain and a second isolated *Bacillus amyloliquefaciens* strain. By way of further example, the composition may include a first isolated *Bacillus amyloliquefaciens* strain or a second isolated *Bacillus amyloliquefaciens* strain, and a first isolated *Bacillus subtilis* strain.

A first isolated *Bacillus amyloliquefaciens* according to the disclosure may be *B. amyloliquefaciens* strain ELA191024 and may be a strain which includes at least one sequence selected from SEQ ID NO: 1-4, 40-42, 47-48, 51-52, 55-56, and 58-132.

The first isolated *Bacillus amyloliquefaciens* strain secretes at least one metabolite selected from glutamine, anthranilate, methionine sulfone, 2-hydroxybutyrate/2-hydroxyisobutyrate, gamma-glutamylphenylalanine, gamma-glutamyltyrosine, azelate (C9-DC), 5-aminoimidazole-4-carboxamide, AMP, adenosine-2',3'-cyclic monophosphate, adenosine, adenine, uridine-2',3'-cyclic monophosphate, cytidine 2',3'-cyclic monophosphate, (3'-5')-uridylyladenosine, nicotinamide ribonucleotide (NMN), 1-kestose, homocysteine, N-acetylcitrulline, alpha-ketoglutarate, succinate, 5-hydroxyhexanoate, inositol 1-phosphate (IP), N6-methyladenosine, 2'-O-methyladenosine, Guanine, 5,6-dihydrouridine, nicotinamide ribonucleotide (NMN), 3-dehydroshikimate, 4-hydroxybenzyl alcohol, and quinate.

An exemplary first isolated *Bacillus amyloliquefaciens* strain includes strain ELA191024, wherein the strain includes a genome having SEQ ID NO: 5. The first isolated *Bacillus amyloliquefaciens* strain may be a strain with a nucleic acid sequence having at least 95%, at least 96%, at least 97%, at least 98%, or at least 99% sequence identity with SEQ ID NO: 1, 2, 3, 4 and/or 5.

A first isolated *Bacillus amyloliquefaciens* according to the disclosure may be *B. amyloliquefaciens* strain ELA191006 and may be a strain which includes at least one sequence selected from a nucleic acid sequence encoding one or more protein of SEQ ID NO: 263-276. The first isolated *Bacillus amyloliquefaciens* strain includes a nucleic acid sequence having at least 95%, at least 96%, at least 97%, at least 98%, or at least 99% sequence identity with SEQ ID NO: 261. The first isolated *Bacillus amyloliquefaciens* strain includes a nucleic acid sequence having least 95%, at least 96%, at least 97%, at least 98%, or at least 99% sequence identity with at least one of a nucleic acid sequence encoding a polypeptide or amino acid sequence SEQ ID NO: 263, 264, 265, 266, 267, 268, 269, 270, 271, 272, 273, 274, 275 and 276.

A second isolated *Bacillus amyloliquefaciens* strain of the present disclosure may be *B. amyloliquefaciens* strain ELA191036 and may be a strain which includes at least one sequence selected from SEQ ID NO: 6-11 and 133-206. The second isolated *Bacillus amyloliquefaciens* strain may be a strain with a nucleic acid sequence having at least 95%, at least 96%, at least 97%, at least 98%, or at least 99% sequence identity with SEQ ID NO: 6, 7, 8, 9, 10 and/or 11.

The second isolated *Bacillus amyloliquefaciens* strain secretes at least one metabolite selected from 2-methylserine, N-acetylaspartate (NAA), N-acetylasparagine, N-acetylglutamate, N-acetylglutamine, 2-pyrrolidinone, S-1-pyrroline-5-carboxylate, trans-urocanate, cis-urocanate, formiminoglutamate, 4-imidazoleacetate, N6-acetyllysine, N-acetylphenylalanine, Phenylpyruvate, phenethylamine, N-acetyltyrosine, tyramine, 4-hydroxyphenylpyruvate, 3-methoxytyramine, 5-hydroxymethyl-2-furoic acid, N-acetylleucine, isovalerate (C5), N-acetylisoleucine, 3-methyl-2-oxovalerate, 2-hydroxy-3-methylvalerate, methylsuccinate, N-acetylvaline, 3-methyl-2-oxobutyrate, N-acetylmethionine, N-acetylmethionine sulfoxide, S-adenosylmethionine (SAM), homocystine, N-acetylarginine, N-acetylcitrulline, N-acetylproline, N-alpha-acetylornithine, hydroxyproline, Acetylagmatine, spermidine, (N(1)+N(8))-acetylspermidine, Spermine, 5-methylthioadenosine (MTA), 4-acetamidobutanoate, 3-phosphoglycerate, phosphoenolpyruvate (PEP), sedoheptulose-7-phosphate, sedoheptulose, sucrose, glucoronate, N-acetyl-glucosamine 1-phosphate, N-acetylglucosamine/N-acetylgalactosamine, citraconate/glutaconate, butyrate/isobutyrate (4:0), 2-hydroxyglutarate, 5-dodecenoylcarnitine (C12:1), 3-hydroxyoctanoate, 5-hydroxyhexanoate, 1-stearoyl-GPE (18:0), glycerol 3-phosphate, Xanthine, xanthosine, 1-methyladenine, N6-methyladenosine, Guanosine, 7-methylguanine, N-carbamoylaspartate, Orotidine, pseudouridine, 5,6-dihydrouridine, 5-5 methylcytidine, thymine, Nicotinate, nicotinate ribonucleoside, pantothenate (Vitamin B5), pterin, benzoate, 3-dehydroshikimate, 2-isopropylmalate, 4-hydroxybenzyl alcohol, 2,4-di-tert-butylphenol, 1-linoleoylglycerol (18:2), guanosine 3'-monophosphate (3-GMP), guanosine-2',3'-cyclic monophosphate, and cytidine 2',3'-cyclic monophosphate.

An exemplary second isolated *Bacillus amyloliquefaciens* strain includes strain ELA191036, wherein the strain includes a genome having SEQ ID NO: 10 and 11. The second isolated *Bacillus amyloliquefaciens* strain may be a strain with a nucleic acid sequence having at least 95%, at least 96%, at least 97%, at least 98%, or at least 99% sequence identity with SEQ ID NO: 6, 7, 8, 9, 10 and/or 11.

A second isolated *Bacillus amyloliquefaciens* according to the disclosure may be *B. amyloliquefaciens* strain ELA202071 and may be a strain which includes at least one sequence selected from a nucleic acid sequence encoding one or more protein of SEQ ID NO: 277-284. The second isolated *Bacillus amyloliquefaciens* strain includes a nucleic acid sequence having at least 95%, at least 96%, at least 97%, at least 98%, or at least 99% sequence identity with SEQ ID NO: 262. The second isolated *Bacillus amyloliquefaciens* strain includes a nucleic acid sequence having least 95%, at least 96%, at least 97%, at least 98%, or at least 99% sequence identity with at least one of a nucleic acid sequence encoding a polypeptide or amino acid sequence SEQ ID NO: 277, 278, 279, 280, 281, 282, 283 or 284.

The first isolated *Bacillus subtilis* strain of the present disclosure may be ELA191105 and comprises at least one sequence selected from SEQ ID NO: 12-15 and 207-258. An exemplary first isolated *Bacillus subtilis* strain includes strain ELA191105, wherein the strain includes a genome having SEQ ID NO: 16. The first isolated *Bacillus subtilis* strain includes a nucleic acid sequence having at least 95%, at least 96%, at least 97%, at least 98%, or at least 99% sequence identity with SEQ ID NO: 12, 13, 14, 15 and/or 16. The first isolated *Bacillus subtilis* strain includes a nucleic acid sequence having least 95%, at least 96%, at least 97%, at least 98%, or at least 99% sequence identity with at least one of a nucleic acid sequence encoding a polypeptide or amino acid sequence SEQ ID NO: 285, 286, 287, 288, 289, 290, 291, 292, 293, 294, 295, 296, 297, 298, 299, 300, 301, 302, 303, 304 or 305.

The first isolated *Bacillus subtilis* strain secretes at least one metabolite selected from: Betaine, carboxyethyl-GABA, 3-methylhistidine, Saccharopine, pipecolate, N,N-dimethyl-5-aminovalerate, N-butyryl-phenylalanine, Tryptophan, N-butyryl-leucine, 2-hydroxy-4-(methylthio) butanoic acid, S-methylcysteine, Ornithine, N-methylproline, N,N,N-trimethyl-alanylproline betaine (TMAP), N-monomethylarginine, Guanidinoacetate, putrescine, Cysteinylglycine, cyclo(gly-phe), Tryptophylglycine, pyruvate, Mannose, N-acetylmuramate, eieosenamide (20:1), Deoxycarnitine, 2S,3R-dihydroxybutyrate, chiro-inositol, choline, glycerophosphorylcholine (GPC), 1-palmitoyl-GPE (16:0), 1-linoleoylglycerol (18:2), 3-hydroxy-3-methylglutarate, 3-ureidopropionate, (3'-5')-uridylyluridine, nicotinamide riboside, trigonelline (N'-methylnicotinate), oxalate (ethanedioate), pyridoxine (Vitamin B6), maltol, histidine betaine (hercynine), 2,6-dihydroxybenzoic acid, pentose acid, N-acetylserine, N-acetylthreonine, N-acetylglutamine, 1-methylhistidine, N-acetylhistidine, trans-urocanate, N6-acetyllysine, N-acetyl-cadaverine, N-acetylphenylalanine, phenyllactate (PLA), 3-(4-hydroxyphenyl) lactate (HPLA), isovalerate (C5), N-acetylisoleucine, N-acetylvaline, N-acetylmethionine, S-adenosylmethionine (SAM), 2-hydroxy-4-(metliylthio)butanoic acid, S-methylcysteine, N-acetylarginine, Acetylagmatine, glutathione, oxidized (GSSG), 2-hydroxybutyrate/2-hydroxyisobutyrate, gamma-glutamylhistidine, glucoronate, aconitate [cis or trans], 2-methylcitrate, 2R,3R-dihydroxybutyrate, 5-aminoinidazole-4-carboxamide, N-carbamoylaspartate, Dihydroorotate, orotidine, Thymine, (3'-5')-adenylylguanosine, nicotinamide riboside, NAD+, pyridoxamine, pyridoxamine phosphate, and homocitrate.

The invention and disclosure provides a probiotic composition comprising a combination of *Bacillus* strains. The invention and disclosure provides a feed additive composition comprising a combination of *Bacillus* strains. In an embodiment, the combination of *Bacillus* strains is a non-natural combination of strains, the strains would not ordinary be present in an animal in combination. The invention and disclosure provides a probiotic composition comprising at least one of: a first isolated *Bacillus amyloliquefaciens* strain, a second isolated *Bacillus amyloliquefaciens* strain, and a first isolated *Bacillus subtilis* strain; and a carrier suitable for animal administration. In a partical embodiment, a probiotic composition is provided comprising at least one of a first isolated *Bacillus amyloliquefaciens* strain, a second isolated *Bacillus amyloliquefaciens* strain, and a first isolated *Bacillus subtilis* strain wherein said composition reduces or inhibits the colonization of an animal by a pathogenic bacterium when an effective amount is administered to an animal, as compared to an animal not administered the composition. In an embodiment, a probiotic composition is provided comprising a first isolated *Bacillus amyloliquefaciens* strain, a second isolated *Bacillus amyloliquefaciens* strain, and a first isolated *Bacillus subtilis* strain wherein said composition reduces or inhibits the colonization of an animal by a pathogenic bacterium when an effective amount is administered to an animal, as compared to an animal not administered the composition.

In an embodiment, a probiotic composition is provided wherein the first isolated *Bacillus amyloliquefaciens* strain comprises a nucleic acid sequence having at least 95%, at least 96%, at least 97%, at least 98%, or at least 99% sequence identity with SEQ ID NO: 59. In an embodiment, the first isolated *Bacillus amyloliquefaciens* strain comprises a nucleic acid sequence having at least 95%, at least 96%, at least 97%, at least 98%, or at least 99% sequence identity with SEQ ID NO: 261. In an embodiment, the second *Bacillus amyloliquefaciens* strain comprises a nucleic acid sequence having at least 95%, at least 96%, at least $9^7$%, at least 98%, or at least 99% sequence identity with SEQ ID NO: 133. In an embodiment, the second isolated *Bacillus amyloliquefaciens* strain comprises a nucleic acid sequence having at least 95%, at least 96%, at least 97%, at least 98%, or at least 99% sequence identity with SEQ ID NO: 262. In an embodiment, the first *Bacillus subtilis* strain comprises a nucleic acid sequence having at least 95%, at least 96%, at least 97%, at least 98%, or at least 99% sequence identity with SEQ ID NO:257. In an embodiment, the first *Bacillus subtilis* strain comprises a nucleic acid sequence having at least 95%, at least 96%, at least 97%, at least 98%, or at least 99% sequence identity with SEQ ID NO: 12, 13, 14, 15 and/or 16.

In some embodiments, the composition includes a first isolated *Bacillus amyloliquefaciens* strain including ELA191024 and a second isolated *Bacillus amyloliquefaciens* strain including ELA191036. In some embodiments, the composition includes a first isolated *Bacillus amyloliquefaciens* strain ELA191024 and a second isolated *Bacillus amyloliquefaciens* strain ELA191036. In some embodiments, the composition includes a first isolated *Bacillus amyloliquefaciens* strain ELA191024 and a second isolated *Bacillus amyloliquefaciens* strain ELA202071. In some embodiments, the composition includes a first isolated *Bacillus amyloliquefaciens* strain ELA191006 and a second isolated *Bacillus amyloliquefaciens* strain ELA202071.

In some embodiments, the composition includes a first isolated *Bacillus amyloliquefaciens* strain including ELA191024 or a second isolated *Bacillus amyloliquefaciens* strain including ELA191036, and a first isolated *Bacillus subtilis* strain including ELA191105. In some embodiments, the composition includes a first isolated *Bacillus amyloliquefaciens* strain including ELA191024 or a second isolated *Bacillus amyloliquefaciens* strain including ELA191006, and a first isolated *Bacillus subtilis* strain including ELA191105. In some embodiments, the composition includes a first isolated *Bacillus amyloliquefaciens* strain ELA191024 or ELA191006, a second isolated *Bacillus amyloliquefaciens* strain including ELA202071, and a first isolated *Bacillus subtilis* strain including ELA191105. In some embodiments, the composition includes a first isolated *Bacillus amyloliquefaciens* strain ELA191024, a second isolated *Bacillus amyloliquefaciens* strain including ELA202071, and a first isolated *Bacillus subtilis* strain including ELA191105. In some embodiments, the composition includes a first isolated *Bacillus amyloliquefaciens* strain ELA191006, a second isolated *Bacillus amyloliquefaciens* strain including ELA202071, and a first isolated *Bacillus subtilis* strain including ELA191105.

In embodiments, a feed additive composition is provided comprising a first isolated *Bacillus amyloliquefaciens* strain ELA191024, a second isolated *Bacillus amyloliquefaciens* strain including ELA202071, and a first isolated *Bacillus subtilis* strain including ELA191105. In some embodiments, a feed additive composition is provided comprising a first isolated *Bacillus amyloliquefaciens* strain ELA19106, a second isolated *Bacillus amyloliquefaciens* strain including ELA202071, and a first isolated *Bacillus subtilis* strain including ELA191105.

In embodiments, a feed additive composition is provided comprising *Bacillus amyloliquefaciens* strain ELA191024, *Bacillus amyloliquefaciens* strain including ELA202071, and *Bacillus subtilis* strain ELA191105 or an active and effective genetic variant thereof. In some embodiments, a feed additive composition is provided comprising *Bacillus amyloliquefaciens* strain ELA191006, *Bacillus amyloliquefaciens* strain including ELA202071, and *Bacillus subtilis* strain ELA191105 or an active and effective genetic variant thereof. In embodiments, the feed additive comprises spores or spore forms of the *Bacillus* strains. In embodiments, the feed additive comprises only spores or spore forms of the *Bacillus* strains. The feed additive composition may additionally or further comprise other components or carriers and may additionally comprise a prebiotic(s).

In some embodiments, the composition includes a first isolated *Bacillus amyloliquefaciens* strain including ELA191024, a second isolated *Bacillus amyloliquefaciens* strain including ELA191036, and a first isolated *Bacillus subtilis* strain including ELA 191105. In some embodiments, the composition includes a first isolated *Bacillus amyloliquefaciens* strain including ELA191006, a second isolated *Bacillus amyloliquefaciens* strain including ELA191036, and a first isolated *Bacillus subtilis* strain including ELA191105.

*Bacillus amyloliquefaciens* strain ELA191024 (also denoted BAMY 19024) was deposited and corresponds to ATCC Patent Deposit Number PTA-126784. *Bacillus amyloliquefaciens* strain ELA191036 (also denoted BAMY 19036) was deposited and corresponds to ATCC Patent Deposit Number PTA-126785. *Bacillus amyloliquefaciens* strain ELA 191006 (also denoted BAMY 19006) was deposited and corresponds to ATCC Patent Deposit Number PTA-127065. *Bacillus amyloliquefaciens* strain ELA202071 (also denoted BAMY 20071) was deposited and corresponds to ATCC Patent Deposit Number PTA-127064. *Bacillus* subtillis strain ELA191105 (also denoted ELA11901105 and BSUB 19105) was deposited and corresponds to ATCC Patent Deposit Number PTA-126786.

The genome nucleic acid sequence of *Bacillus amyloliquefaciens* strain ELA191024 (also denoted BAMY 19024) is provided in sequences SEQ ID NO:s 1-4 and in SEQ ID NO:5. The genome nucleic acid sequence of *Bacillus amyloliquefaciens* strain ELA 191036 (also denoted BAMY 19036) is provided in sequences SEQ ID NO:s 6-9 and in SEQ ID NO:10 and 11. The genome nucleic acid sequence of *Bacillus amyloliquefaciens* strain ELA191006 (also denoted BAMY 19006 or BAMY 006) is provided in sequences SEQ ID NO: 261. The genome nucleic acid sequence of *Bacillus amyloliquefaciens* strain ELA202071 (also denoted BAMY 202071 or BAMY 071) is provided in sequences SEQ ID NO: 262. The genome nucleic acid sequence of *Bacillus subtilis* strain ELA 191105 (also denoted ELA1901105 and BSUB 19105 and BSUB 105) is provided in sequences SEQ ID NO:s 12-15 and in SEQ ID NO:16. Genomically related or variant *Bacillus amyloliquefaciens* strains having at least 80%, at least 85%, at least 90% at least 95%, at least 97%, at least 98%, at least 99% nucleic acid sequence identity to the genome sequence of SEQ ID NOs: 1-4, or of SEQ ID NO:5, or of SEQ ID NOs: 6-9, or of SEQ ID NO: 10 and 11, or of *Bacillus* strains of SEQ ID NOs:12-15, or of SEQ ID NO:16 are provided and contemplated as embodiments of the invention. Genomically related or variant *Bacillus amyloliquefaciens* strains having at least 80%, at least 85%, at least 90% at least 95%, at least 97%, at least 98%, at least 99% nucleic acid sequence identity to the genome sequence of SEQ ID NO: 261 or of SEQ ID NO: 262 are provided and contemplated as embodiments of the invention. Genomically related or variant *Bacillus subtilis* strains having at least 80%, at least 85%, at least 90% at least 95%, at least 97%, at least 98%, at least 99% nucleic acid sequence identity to the genome sequence of SEQ ID NO: 12, 13, 14, 15 and/or 16 are provided and contemplated as embodiments of the invention. Such genomically related or variant *bacillus* strains are comparably capable of inproving animal health and animal production performance. Such genomically related or variant *bacillus* strains are capable of use and application in probiotic compositions in accordance with the invention. In an embodiment, such genomically related sequences include nucleic acid encoding one or more proteins provided herein as unusual genes or proteins of the respective strains. For example and illustratively, such proteins include SEQ ID NOs: 263-276 for strain BAMY 006, include proteins SEQ ID NOs: 277-284 for strain BAMY 071, and include proteins SEQ ID NOs: 285-305 for strain BSUB 105.

In embodiments, a feed additive of the probiotic composition is provided. In an embodiment, the feed additive comprises a combination of the spore forms of at least two of the *Bacillus* strains provided herein.

In some embodiments, the ratio of the first isolated *Bacillus amyloliquefaciens* strain and the second isolated *Bacillus amyloliquefaciens* strain is about 0.75-1.5:1. In some embodiments, the ratio of the first isolated *Bacillus amyloliquefaciens* strain, the second isolated *Bacillus amyloliquefaciens* strain, and the first isolated *Bacillus subtilis* strain is about 0.75-1.5:1:0.75-1.5. In a preferred embodiment, the composition contains equal amounts of the strains disclosed herein and above. The amount or ratio can be determined or characterized by any known method. For example, the ratio or amount can be characterized by the number of viable spores per gram dry weight of the probiotic composition.

In some embodiments, bacterial strains of the present disclosure include those that include polynucleotide sequences that share at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity with at least one of: SEQ ID NOs:1-39, 48, 50, 52, 54, 56, 58, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, and 257. In a further embodiments, bacterial strains of the present disclosure include those that comprise polypeptide sequences that share at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity with at least one of: SEQ ID NOs:40-47, 49, 51, 53, 55, 57, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 10 238, 240, 242, 244, 246, 248, 250, 252, 254, 256, and 258. In a further embodiment, bacterial strains of the present disclosure include those that comprise polypeptide sequences that share at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity with at least one of: SEQ ID NOs: 263, 264, 265, 266, 267, 268, 269, 270, 271, 272, 273, 274, 275 and 276. In a further embodiment, bacterial strains of the present disclosure include those that comprise polypeptide sequences that share at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity with at least one of: SEQ ID NOs: 277, 278, 279, 280, 281, 282, 283 and 284.

In a further embodiments, bacterial strains of the present disclosure include those that comprise polynucleotide sequences that encodes for a polypeptide sequence that share at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity with at least one of: SEQ ID NOs: 40-47, 49, 51, 53, 55, 57, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 20 250, 252, 254, 256, and 258. In a further embodiments, bacterial strains of the present disclosure include those that comprise polynucleotide sequences that encodes for a polypeptide sequence that share at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity with at least one of: SEQ ID NOs: 285, 286, 287, 288, 289, 290, 291, 292, 293, 294, 295, 296, 297, 298, 299, 300, 301, 302, 303, 304 and 305.

Without wishing to be bound by theory, it is believed that the consortia of strains described above have a unique secretion profile that provides health benefits to an animal when they colonize the gastrointestinal tract of an animal. Furthermore, it is believed that the combination of a first isolated *Bacillus amyloliquefaciens* strain and a second isolated *Bacillus* amyloliquefacien strain, as described above, provide a unique combined metabolite secretion profile that provides health benefits to an animal when they colonize the gastrointestinal tract of an animal.

Even further, it is believed that the combination of a first isolated *Bacillus amyloliquefaciens* strain, a second isolated *Bacillus amyloliquefaciens* strain, and a first isolated *Bacillus subtilis* strain, as described above, provide a unique combined metabolite secretion profile that provides health benefits to an animal when they colonize the gastrointestinal tract of an animal.

It has been unexpectedly discovered that the combination of two different *Bacillus amyloliquefaciens* strains described above and herein result in the secretion of unique metabolites, when grown together. Such secreted metabolites include at least one of: histidine, N-acetylhistidine, phenyllactate (PLA), 1-carboxyethyltyrosine, 3-(4-hydroxyphenyl) lactate (HPLA), tryptophan, N-acetyltryptophan, anthranilate, indolelactate, isovalerylglycine, N-acetylisoleucine, N-acetylmethionine, urea, ornithine, spermidine, spermine, cysteinylglycine, pyruvate, sucrose, fumarate, deoxycarnitine, 2R,3R-dihydroxybutyrate, chiro-inositol, glycerophosphorylcholine (GPC), 5-aminoimidazole-4-carboxamide, xanthine, AMP, 2'-deoxyadenosine, dihydroorotate, UMP, uridine, CMP, cytidine, (3'-5')-adenylyluridine, (3'-5')-cytidylyladenosine, (3'-5')-cytidylylcytidine, (3'-5')-cytidylyluridine, (3'-5')-guanylylcytidine, (3-5')-guanylyluridine, (3-5')-uridylylcytidine, (3-5')-uridylyluridine, (3'-5')-uridylyladenosine, NAD+, oxalate (ethanedioate), maltol, 1-methylhistidine, N6,N6-dimethyllysine, S-15 methylcysteine, and 2-methylcitrate.

Furthermore, it has been unexpectedly discovered that the combination of two different *Bacillus amyloliquefaciens* strains and one *Bacillus subtilis* strain described above and herein result in the secretion of unique metabolites, when grown together. Such secreted metabolites include at least one of: N-carbamoylserine, beta-citrylglutamate, N6-methyllysine, N6,N6-dimethyllysine, N6,N6,N6-trimethyllysine, saccharopine, cadaverine, N-succinyl-phenylalanine, 2-hydroxyphenylacetate, 3-(4-hydroxyphenyl)lactate (HPL A), N-acetyltryptophan, indolelactate, N-acetylleucine, 4-methyl-2-oxopentanoate, homocitrulline, dimethylarginine (ADMA 4 SDMA), N-monomethylarginine, guanidinoacetate, N(l)-acetylspermine, glucose 6-phosphate, Isobar: hexose diphosphates, ribitol, arabonate/xylonate, ribulonate/xylulonate/lyxonate, fructose, galactonate, isocitric lactone, fumarate, malate, 3-hydroxyhexanoate, 5-hydroxyhexanoate, rnyo-inositol, chiro-inositol glycerophosphoethanolamine, glycerophosphoinositol, 3-hydroxy-3-methylglutarate. Mevalonate, 5-aminoinidazole-4-carboxamide, 2'-AMP, 2-O-methyladenosine, N6-succinyladenosine, guanosine 2'-monophosphate (2'-GMP), 2'-O-methyluridine, uridine 2'-monophosphate (2'-UMP), 5-methylcytosine, pantoate, pantothenate (Vitamin B5), glucarate (saccharate), hippurate, histidinol, homocitrate, pyrraline, 2-keto-3-deoxy-gluconate, pentose acid, N,N-dimethylalanine, Isobar: hexose diphosphates, 2-methylcitrate, and (3'-5')-adenylylguanosine.

As used herein and in the context of bacterial consortia, "unique metabolites" include metabolites that are secreted at least 1.5, at least 2 fold, at least 3 fold, at least 5 fold, or at least 10 fold greater as compared to secretion of the respective metabolite by the bacterial strain grown individually. By way of example, the combination of a first isolated *Bacillus amyloliquefaciens* strain and a second isolated *Bacillus amyloliquefaciens* strain described above and herein secrete at least 2 fold more ornithine as compared to the two strains grown individually. By way of further example, the combination of a first isolated *Bacillus amyloliquefaciens* strain, a second isolated *Bacillus amyloliquefaciens* strain, and a first *Bacillus subtilis* strain described above and herein secrete at least 2 fold more glucose 6-phosphate, as compared to the three strains grown individually.

Combinations of two *Bacillus amyloliquefaciens* strains and a *Bacillus subtilis* strain, including strains 02, 036 and 105, or strains 06, 071 and 105 have been evaluated by metabolite and genome analysis and information is pwovided herein with regard to and which provides characteristics and the presence/absence of certain metabolites, enzymes, protins etc present, secreted, predicted to be encoded or absent in each strain or wth a combination of the strains. This data and information is provided in the Examples and Tables herein and may be references for these characteristics, proteins, metabolites, enzymes etc. Table 37 provides natural antibiotics or bacteriocins present or absent. Table 39 and 52 provides predicted proteins and secondary metabolites present or absent. Table 42 provides predicted antioxidants. Table 56 provides predicted antioxidants. Table 43 provides toxins or antitoxins. Table 44 provides digestive enzymes. Table 54 provides digestive enzymes. Table 45 provides antimicrobial resistance genes. Table 55 provides antimicrobial resistance genes. Table 48 provides metabolites uniquely secreted. Table 53 provides antimicrobial peptides.

In some embodiments, the composition includes a first isolated *Bacillus amyloliquefaciens* strain and second isolated *Bacillus amyloliquefaciens* strain, and does not contain a *Bacillus subtilis* strain.

In some embodiments, the composition does not include *Lactobacillus*. An example of a *Lactobacillus* species includes *Lactobacillus reuteri* and *Lactobacillus* crispatus, *Lactobacillus vaginalis, Lactobacillus helviticus*, and *Lactobacillus johnsonii.*

In some embodiments, the composition does not include non-*Bacillus* strains. Examples of non-*Bacillus* strains include *Lactobacillus, Leuconostoc* (e.g., *Leuconostoc mesenteroides*).

The composition may include or comprise live bacteria or bacterial spores, or a combination thereof.

In some embodiments, the composition does not include antibiotics, Exemplary antibiotics include tetracycline, bacitracin, tylosin, salinomycin, virginiamycin and bambermycin.

In some embodiments, the *Bacillus* strains of the present disclosure are not genetically engineered or genetically modified and do not contain heterologous genetic sequences.

The compositions described above may include a carrier suitable for animal consumption or use. Examples of suitable carriers include edible food grade material, mineral mixture, gelatin, cellulose, carbohydrate, starch, glycerin, water, glycol, molasses, corn oil, animal feed, such as cereals (barley, maize, oats, and the like), starches (tapioca and the like), oilseed cakes, and vegetable wastes. In some embodiments, the compositions include vitamins, minerals, trace elements, emulsifiers, aromatizing products, binders, colorants, odorants, thickening agents, and the like.

In some embodiments, the compositions include one or more biologically active molecule or therapeutic molecule. Examples of the aforementioned include ionophore; vaccine; antibiotic; antihelmintic; virucide; nematicide; amino acids such as methionine, glycine, and arginine; fish oil; krill oil; and enzymes.

In some embodiments, the compositions or combinations may additionally include one or more prebiotic. In some embodiments, the compositions may be administered along with or may be coadministered with one or more prebiotic. Prebiotics may include organic acids or non-digestible feed ingredients that are fermented in the lower gut and may serve to select for beneficial bacteria. Prebiotics may include mannan-oligosaccharides, fructo-oligosaccharides, galacto-oligosaccharides, chito-oligosaccharides, isomalto-oligosaccharides, pectic-oligosaccharides, xylo-oligosaccharides, and lactose-oligosaccharides.

The composition may be formulated as animal feed, feed additive, food ingredient, water additive, water-mixed additive, consumable solution, consumable spray additive, consumable solid, consumable gel, injection, or combinations thereof. The composition may be formulated and suitable for use as or in one or more of animal feed, feed additive, food ingredient, water additive, water-mixed additive, consumable solution, consumable spray additive, consumable solid, consumable gel, injection, or combinations thereof. The composition may be suitable and prepared for use as animal feed, feed additive, food ingredient, water additive, water-mixed additive, consumable solution, consumable spray additive, consumable solid, consumable gel, injection, or combinations thereof.

Methods and Methods of Use

In some embodiments, the disclosure provides for the use of any of the compositions described above to improve a phenotypic trait of interest in an animal. As used herein, a probiotic is a composition that improves a phenotypic trait of interest in an animal.

In embodiments ofthe invention, an animal may include a farmed animal or livestock or a domesticated animal. Livestock or farmed animal may include cattle (e.g. cows or bulls (including calves)), poultry (including broilers, chickens and turkeys), pigs (including piglets), birds, aquatic animals such as fish, agastric fish, gastric fish, freshwater fish such as salmon, cod, trout and carp, e.g. koi carp, marine fish such as sea bass, and crustaceans such as shrimps, mussels and scallops), horses (including race horses), sheep (including lambs). A domesticated animal may be a pet or an animal maintained in a zoological environment and may include any relevant animal including canines (e.g. dogs), felines (e.g. cats), rodents (e.g. guinea pigs, rats, mice), birds, fish (including freshwater fish and marine fish), and horses.

The animal may be a pregnant or breeding animal, such as a pregnant sow or a pregnant pig.

Examples of improving a phenotypic trait includes decreasing pathogen-associated lesion formation in the gastrointestinal tract, decreasing colonization of pathogens, increasing feed digestibility, increasing meat quality, increasing milk quality, increasing egg quality, modulating microbiome, increasing short chain fatty acids, improving laying performance, increasing milk yield, and increasing gut health or characteristic (reducing permeability and inflammation).

Examples of pathogens include *Eimeria* spp., *Salmonella Typhimurium, Salmonella Infantis, Salmonella Hadar, Salmonella Enteritidis, Salmonella* Newport, *Salmonella* Kentucky, *Clostridium perfringens, Staphylococcus aureus, Streptoccus uberis, Streptococcus suis, Escherichia coli, Campylobacter jejuni, Fusobacterium necrophorum*, Avian pathogenic *Escherichia coli* (APEC), Piscricketsia *salmonis*, Tenacibaculum spp., *Salmonella* Lubbock, Trueperella *pyogenes*, shiga toxin producing *E. coli*, enterotoxigenic *E. coli, Campylobacter coli*, and Lawsonia intracellularis.

A pathogen may be a bacteria or a virus. The virus may include a pathogenic virus infecting animals, including livestock animals or domesticated animals and may be specific for a particular animal such as a poultry virus or a swine virus.

The compositions may be used to treat an infection particularly a bacterial infection. In some aspects, the compositions described above are used to treat an infection from at least one of *Eimeria* spp., *Salmonella Typhimurium, Salmonella Infantis, Salmonella* Hadar, *Salmonella Enteritidis, Salmonella* Newport, *Salmonella* Kentucky, *Clostridium perfringens, Staphylococcus aureus, Streptoccus uberis, Streptococcus suis, Escherichia coli, Campylobacter jejuni, Fusobacterium necrophorum*, Avian pathogenic *Escherichia coli* (APEC), *Salmonella* Lubbock, Trueperella *pyogenes*, shiga toxin producing *E. coli*, enterotoxigenic *E. coli, Campylobacter coli*, and Lawsonia intracellularis. The compositions may be used to inhibit infection, particularly a bacterial infection. Infection may be by one or more of *Eimeria* spp., *Salmonella Typhimurium, Salmonella Infantis, Salmonella* Hadar, *Salmonella Enteritidis, Salmonella* Newport, *Salmonella* Kentucky, *Clostridium perfringens, Staphylococcus aureus, Streptoccus uberis, Streptococcus suis, Escherichia coli, Campylobacter jejuni, Fusobacterium necrophorum*, Avian pathogenic *Escherichia coli* (APEC), *Salmonella* Lubbock, Trueperella *pyogenes*, shiga toxin producing *E. coli*, enterotoxigenic *E. coli, Campylobacter coli*, and Lawsonia intracellularis.

In some aspects, the compositions described above are used to reduce colonization by or inhibit colonization by a bacteria in an animal, particularly in a herd or group of animals, particularly of pathogenic bacteria. In some aspects, the compositions described above are used to reduce colonization by or inhibit colonization of at least one of *Eimeria* spp., *Salmonella Typhimurium, Salmonella Infantis, Salmonella* Hadar, *Salmonella Enteritidis, Salmonella* Newport, *Salmonella* Kentucky, *Clostridium perfringens, Staphylococcus aureus, Streptoccus uberis, Streptococcus suis, Escherichia coli, Campylobacter jejuni, Fusobacterium necrophorum*, Avian pathogenic *Escherichia coli* (APEC), *Salmonella* Lubbock, Trueperella *pyogenes*, shiga toxin producing *E. coli*, enterotoxigenic *E. coli, Campylobacter coli*, and Lawsonia intracellularis.

In some aspects, the compositions described above are used to reduce transmission of bacteria, particularly pathogenic bacteria, in an animal pen or in a group or herd of animals. In some aspects, the compositions described above are used to reduce transmission in an animal pen or in a group or herd of animals of at least one of *Eimeria* spp., *Salmonella Typhimurium, Salmonella Infantis, Salmonella* Hadar, *Salmonella Enteritidis, Salmonella* Newport, *Salmonella* Kentucky, *Clostridium perfringens, Staphylococcus aureus, Streptoccus uberis, Streptococcus suis, Escherichia coli, Campylobacter jejuni, Fusobacterium necrophorum*, Avian pathogenic *Escherichia coli* (APEC), *Salmonella* Lubbock, Trueperella *pyogenes*, shiga toxin producing *E. coli*, enterotoxigenic *E. coli, Campylobacter coli*, and Lawsonia intracellularis.

In some aspects, the compositions described above are used to reduce bacterial load, particularly pathogenic bacteria or clinically significant bacteria, including the number or amount of bacteria in the gut or gastrointestinal tract of an animal. The bacteria may be selected from at least one of *Eimeria* spp., *Salmonella Typhimurium, Salmonella Infantis, Salmonella* Hadar, *Salmonella Enteritidis, Salmonella* Newport, *Salmonella* Kentucky, *Clostridium perfringens, Staphylococcus aureus, Streptoccus uberis, Streptococcus suis, Escherichia coli, Campylobacter jejuni, Fusobacterium necrophorum*, Avian pathogenic *Escherichia coli* (APEC), *Salmonella* Lubbock, Trueperella *pyogenes*, shiga toxin producing *E. coli*, enterotoxigenic *E. coli, Campylobacter coli*, and Lawsonia intracellularis.

In some aspects, the compositions described above are used to treat at least one of inflammatory bowel disease, obesity, liver abscess, ruminal acidosis, leaky gut syndrome, piglet diarrhea, necrotic enteritis, coccidiosis, salmon rickettsial septicemia, and foodborne diseases.

In one embodiment, examples of phenotypic traits of interest in animals include decreased feed conversion ratio, increased weight, increased lean body mass, decreased pathogen-associated lesion formation in the gastrointestinal tract, decreased colonization of pathogens, modulated microbiome, increased egg quality, increased feed digestibility, and decreased mortality rate, as compared to animals not administered the composition.

In one embodiment, examples of phenotypic traits of interest in poultry include decreased feed conversion ratio, increased weight, increased lean body mass, decreased pathogen-associated lesion formation in the gastrointestinal tract, decreased colonization of pathogens, modulated microbiome, increased egg quality, increased feed digestibility, and decreased mortality rate, as compared to poultry not administered the composition.

In one embodiment, examples of phenotypic traits of interest in swine include decreased feed conversion ratio, increased weight, increased lean body mass, decreased pathogen-associated lesion formation in the gastrointestinal tract, decreased colonization of pathogens, modulated microbiome, increased feed digestibility, prevention of or reduction of post-weaning diarrhea in piglets, reduction of fecal scores, increased piglet body weight or weight gain, reduced unconsumed feed, increased daily feed intake, improved weight gain to feed ratio and decreased mortality rate, as compared to swine not administered the composition.

Methods are provided herein for reduction of post-weaning diarrhea in an animal. Methods are provided herein for reduction of fecal scores in a herd or group or pen of animals. Methods are provided herein for increase in body weight, for weight gain, for reducing unconsumed feed, for increasing daily feed intake, or for improving weight gain to feed ratio in a animal or in a herd or group or pen of animals.

In some aspects, the animal administered an effective amount of the composition disclosed herein exhibits a decrease in the feed conversion ratio by at least 1%, at least 5%, at least 6%, at least 7%, at least 8%, at least 9%, at least 10%, or at least 15%. In some aspects, the poultry administered an effective amount of the composition disclosed herein exhibits a decrease in the feed conversion ratio by at least 1%, at least 5%, at least 6%, at least 7%, at least 8%, at least 9%, at least 10%, or at least 15%. In some aspects, the swine or pigs/piglets administered an effective amount of the composition disclosed herein exhibits a decrease in the feed conversion ratio by at least 1%, at least 5%, at least 6%, at least 7%, at least 8%, at least 9%, at least 10%, or at least 15%.

In some aspects, the animal administered an effective amount of the composition disclosed herein exhibits an increase in animal weight by at least 1%, at least 5%, at least 25%, 20 or at least 50%. In some aspects, the poultry administered an effective amount of the composition disclosed herein exhibits an increase in poultry weight by at least 1%, at least 5%, at least 25%, 20 or at least 50%. In some aspects, the swine or piglet administered an effective amount of the composition disclosed herein exhibits an increase in swine or piglet weight by at least 1%, at least 5%, at least 25%, 20 or at least 50%.

In some aspects, the animal administered an effective amount of the composition disclosed herein exhibits a decrease in pathogen-associated lesion formation in the gastrointestinal tract by at least 1%, at least 5%, at least 25%, or at least 50%. In some aspects, the poultry administered an effective amount of the composition disclosed herein exhibits a decrease in pathogen-associated lesion formation in the gastrointestinal tract by at least 1%, at least 5%, at least 25%, or at least 50%. In some aspects, the swine or piglet administered an effective amount of the composition disclosed herein exhibits a decrease in pathogen-associated lesion formation in the gastrointestinal tract by at least 1%, at least 5%, at least 25%, or at least 50%.

In some aspects, the animal administered an effective amount of the composition disclosed herein exhibits decrease in the mortality rate by at least 1%, at least 5%, at least 25%, or at least 50%. In some aspects, the poultry administered an effective amount of the composition disclosed herein exhibits decrease in the mortality rate by at least 1%, at least 5%, at least 25%, or at least 50%. In some aspects, the swine, piglet administered an effective amount of the composition disclosed herein exhibits decrease in the mortality rate by at least 1%, at least 5%, at least 25%, or at least 50%.

In some aspects, the poultry administered an effective amount of the composition exhibits an increase in production efficiency (European Broiler Index, EBI) by at least 6.0%, by at least 7%, by at least 10%, or by at least 15%.

The compositions may further include one or more component or additive. The one or more component or additive may be a component or additive to facilitate administration, for example by way of a stabilizer or vehicle, or by way of an additive to enable administration to an animal such as by any suitable administrative means, including in aerosol or spray form, in water, in feed or in an injectable form. Administration to an animal may be by any known or standard technique. These include oral ingestion, gastric intubation, or broncho-nasal spraying. The compositions disclosed herein may be administered by immersion, intranasal, intramammary, topical, mucosally, or inhalation. When the animal is a bird the treatment may be administered in ovo or by spray inhalation.

Compositions may include a carrier in which the bacterium or any such other components is suspended or dissolved. Such carrier(s) may be any solvent or solid or encapsulated in a material that is non-toxic to the inoculated animal and compatible with the organism. Suitable pharmaceutical carriers include liquid carriers, such as normal saline and other non-toxic salts at or near physiological concentrations, and solid carriers, such as talc or sucrose and which can also be incorporated into feed for farm animals. When used for administering via the bronchial tubes, the composition is preferably presented in the form of an aerosol. A dye may be added to the compositions hereof, including to facilitate chacking or confirming whether an animal has ingested or breathed in the composition.

When administering to animals, including farm animals, administration may include orally or by injection. Oral administration can include by bolus, tablet or paste, or as a powder or solution in feed or drinking water. The method of administration will often depend on the species being feed or administered, the numbers of animals being fed or administered, and other factors such as the handling facilities available and the risk of stress for the animal.

The dosages required will vary and need be an amount sufficient to induce an immune response or to effect a biological or phenotypic change or response expected or desired. Routine experimentation will establish the required amount. Increasing amounts or multiple dosages may be implemented and used as needed.

In an embodiment of the invention, the bacterial strains are administered in doses indicated as CFU/g or colony forming units of bacteria per gram. In an embodiment, the dose is in the range of $1\times10^3$ to $1\times10^9$ CFU/g. In an embodiment, the dose is in the range of $1\times10^3$ to $1\times10^7$. In an embodiment, the dose is in the range of $1\times10^4$ to $1\times10^6$. In an embodiment, the dose is in the range of $5\times10^4$ to $1\times10^6$. In an embodiment, the dose is in the range of $5\times10^4$ to $6\times10^5$. In an embodiment, the dose is in the range of $7\times10^4$ to $3\times10^5$. In an embodiment, the dose is approximately 50K, 75K, 100K, 125K, 150K, 200K, 300K, 400K. 500K, 600K CFU/g.

Administration of the compositions disclosed herein may include co-administration with a vaccine or therapeutic compound. Administration of the vaccine or therapeutic compound includes administration prior to, concurrently, or after the composition disclosed herein.

Suitable vaccines in accordance with this embodiment include a vaccine that aids in the prevention of coccidiosis.

In some embodiments, the methods described above are administered to an animal in the absence of antibiotics.

Definitions

As used herein, "isolated" means that the subject isolate has been separated from at least one of the materials with which it is associated in a particular environment, for example, its natural environment.

Thus, an "isolate" does not exist in its naturally occurring environment; rather, it is through the various techniques known in the art that the microbe has been removed from its natural setting and placed into a non-naturally occurring state of existence. Thus, the isolated strain or isolated microbe may exist as, for example, a biologically pure culture in association with an acceptable carrier.

As used herein, "individual isolates" should be taken to mean a composition, or culture, comprising a predominance of a single species, or strain, of microorganism, following separation from one or more other microorganisms. The phrase should not be taken to indicate the extent to which the microorganism has been isolated or purified. However, "individual isolates" can include substantially only one species, or strain, of microorganism.

In certain aspects of the disclosure, the isolated *Bacillus* strain exists as isolated and biologically pure cultures. It will be appreciated by one of skill in the art, that an isolated and biologically pure culture of a particular *Bacillus* strain, denotes that said culture is substantially free (within scientific reason) of other living organisms and contains only the individual *bacillus* strain in question. The culture can contain varying concentrations of said isolated *bacillus* strain. The present disclosure notes that isolated and biologically pure microbes often necessarily differ from less pure or impure materials.

In some embodiments of the present invention, the composition includes a combination of two isolated *Bacillus* strains. In some embodiments of the present invention, the composition includes a combination of three isolated *Bacillus* strains.

As used herein, the term "bacterial consortia", "bacterial consortium", "microbial consortia" or "microbial consortium" refers to a subset of a microbial community of individual microbial species, or strains of a species, which can be described as carrying out a common function, or can be described as participating in, or leading to, or correlating with, a recognizable parameter, such as a phenotypic trait of interest (e.g. increased feed efficiency in poultry). The community may comprise two or more species, or strains of a species, of microbes. In some instances, the microbes coexist within the community symbiotically.

As used herein, "spore" or "spores" refer to structures produced by bacteria that are adapted for survival and dispersal. Spores are generally characterized as dormant structures; however, spores are capable of differentiation through the process of germination. Germination is the differentiation of spores into vegetative cells that are capable of metabolic activity, growth, and reproduction. The germination of a single spore results in a single bacterial vegetative cell. Bacterial spores are structures for surviving conditions that may ordinarily be nonconductive to the survival or growth of vegetative cells.

As used herein, the terms "colonize" and "colonization" include "temporarily colonize" and "temporary colonization".

As used herein, "microbiome" refers to the collection of microorganisms that inhabit the gastrointestinal tract of an animal and the microorganisms' physical environment (i.e., the microbiome has a biotic and physical component). The microbiome is fluid and may be modulated by numerous naturally occurring and artificial conditions (e.g., change in diet, disease, antimicrobial agents, influx of additional microorganisms, etc.). The modulation of the gastrointestinal microbiome can be achieved via administration of the compositions of the disclosure can take the form of: (a) increasing or decreasing a particular Family, Genus, Species, or functional grouping of a microbe (i.e., alteration of the biotic component of the gastrointestinal microbiome) and/or (b) increasing or decreasing gastrointestinal pH, increasing or decreasing volatile fatty acids in the gastrointestinal tract, increasing or decreasing any other physical parameter important for gastrointestinal health (i.e., alteration of the abiotic component of the gut microbiome).

As used herein, "probiotic" refers to a substantially pure microbe (i.e., a single isolate) or a mixture of desired microbes, and may also include any additional components (e.g., carrier) that can be administered to an animal to provide a beneficial health effect. Probiotics or microbial compositions of the invention may be administered with an agent or carrier to allow the microbes to survive the environment of the gastrointestinal tract, i.e., to resist low pH and to grow in the gastrointestinal environment.

The term "growth medium" as used herein, is any medium which is suitable to support growth of a microbe. By way of example, the media may be natural or artificial including gastrin supplemental agar, minimal media, rich media, LB media, blood serum, and tissue culture gels. It should be appreciated that the media may be used alone or in combination with one or more other media. It may also be used with or without the addition of exogenous nutrients.

As used herein, "improved" should be taken broadly to encompass improvement of a characteristic of interest, as compared to a control group, or as compared to a known average quantity associated with the characteristic in question. For example, "improved" feed efficiency associated with application of a beneficial microbe, or microbial ensemble, of the disclosure can be demonstrated by comparing the feed efficiency of poultry treated by the microbes taught herein to the feed efficiency of poultry not treated. In the present disclosure, "improved" does not necessarily demand that the data be statistically significant (i.e. $p<0.05$); rather, any quantifiable difference demonstrating that one value (e.g. the average treatment value) is different from another (e.g. the average control value) can rise to the level of "improved."

As used herein, the term "metabolite" refers to an intermediate or product of metabolism. In some embodiments, a metabolite includes a small molecule. Metabolites have various functions, including in fuel, structural, signaling, stimulatory and inhibitory effects on enzymes, as a cof actor to an enzyme, in defense, and in interactions with other organisms (such as pigments, odorants and pheromones). A primary metabolite is directly involved in normal 5 growth, development and reproduction. A secondary metabolite is not directly involved in these processes but usually has an important ecological function. Examples of metabolites include but are not limited to antibiotics and pigments such as resins and terpenes, etc. Metabolites, as used herein, include small, hydrophilic carbohydrates; large, hydrophobic lipids and complex natural compounds.

As used herein, "carrier", "acceptable carrier", or "pharmaceutical carrier" are used interchangeably and refer to a diluent, adjuvant, excipient, or vehicle with which the compound is administered. Such carriers can be sterile liquids, such as water and oils, including those of petroleum, animal, vegetable, or synthetic origin; such as peanut oil, soybean oil, mineral oil, sesame oil, and the like. Water or aqueous solution saline solutions and aqueous dextrose and glycerol solutions are preferably employed as carriers, in some embodiments as injectable solutions. Alternatively, the carrier can be a solid dosage form carrier, including but not limited to one or more of a binder (for compressed pills), a glidant, an encapsulating agent, a flavorant, and a colorant. The choice of carrier can be selected with regard to the intended route of administration and standard pharmaceutical practice. See Handbook of Pharmaceutical Excipients, (Sheskey, Cook, and Cable) 2017, 8th edition, Pharmaceutical Press; Remington's Pharmaceutical Sciences, (Remington and Gennaro) 1990, 18th edition, Mack Publishing Company; Development and Formulation of Veterinary Dosage Forms (Hardee and Baggot), 1998, 2nd edition, CRC Press.

As used herein, "delivery" or "administration" means the act of providing a beneficial activity to a host. The delivery may be direct or indirect. An administration could be by an oral, nasal, or mucosal route. For example without limitation, an oral route may be an administration through drinking water, a nasal route of administration may be through a spray or vapor, and a mucosal route of administration may be through direct contact with mucosal tissue. Mucosal tissue is a membrane rich in mucous glands such as those that line the inside surface of the nose, mouth, esophagus, trachea, lungs, stomach, gut, intestines, and anus. In the case of birds, administration may be in ovo, i.e. administration to a fertilized egg. In ovo administration can be via a liquid which is sprayed onto the egg shell surface, or an injected through the shell.

As used herein, the terms "treating", "to treat", or "treatment", include restraining, slowing, stopping, inhibiting, reducing, ameliorating, or reversing the progression or severity of an existing symptom, disorder, condition, or disease. A treatment may also be applied prophylactically to prevent or reduce the incidence, occurrence, risk, or severity of a clinical symptom, disorder, condition, or disease.

As used herein, "animal" includes bird, poultry, a human, or a non-human mammal. Specific examples include chickens, turkey, dogs, cats, cattle, salmon, fish, swine and horse. The chicken may be a broiler chicken, egg-laying, or egg-producing chicken. As used herein, the term "poultry" includes domestic fowl, such as chickens, turkeys, ducks, and geese.

As used herein, "gut" refers to the gastrointestinal tract including stomach, small intestine, and large intestine. The term "gut" may be used interchangeably with "gastrointestinal tract".

Any examples or illustrations given herein are not to be regarded in any way as restrictions on, limits to, or express definitions of any term or terms with which they are utilized. Instead, these examples or illustrations are to be regarded as being described with respect to one particular embodiment and as being illustrative only. Those of ordinary skill in the art will appreciate that any term or terms with which these examples or illustrations are utilized will encompass other embodiments which may or may not be given therewith or elsewhere in the specification and all such embodiments are intended to be included within the scope of that term or terms. Language designating such nonlimiting examples and illustrations includes, but is not limited to: "for example," "for instance," "e.g.," and "in one embodiment." In this specification, groups of various parameters containing multiple members are described. Within a group of parameters, each member may be combined with any one or more of the other members to make additional sub-groups. For example, if the members of a group are a, b, c, d, and e, additional sub-groups specifically contemplated include any one, two, three, or four of the members, e.g., a and c; a, d, and e; b, c, d, and e; etc.

Throughout this specification, quantities are defined by ranges, and by lower and upper boundaries of ranges. Each lower boundary can be combined with each upper boundary to define a range. The lower and upper boundaries should each be taken as a separate element. Two lower boundaries or two upper boundaries may be combined to define a range.

Deposit Information

*Bacillus amyloliquefaciens* strain "ELA191024" was deposited on 19 Jun. 2020 according to the Budapest Treaty in the American Type Culture Collection (ATCC), ATCC Patent Depository, 10801 University Boulevard, Manassas, Va., 20110, USA. The deposit has been assigned ATCC Patent Deposit Number PTA-126784.

*Bacillus amyloliquefaciens* strain "ELA191036" was deposited on 19 Jun. 2020 according to the Budapest Treaty in the American Type Culture Collection (ATCC), ATCC Patent Depository, 10801 University Boulevard, Manassas, Va., 20110, USA. The deposit has been assigned ATCC Patent Deposit Number PTA-126785.

*Bacillus amyloliquefaciens* strain "ELA191006" was deposited on 11 May 2021 according to the Budapest Treaty in the American Type Culture Collection (ATCC), ATCC Patent Depository, 10801 University Boulevard, Manassas, Va., 20110, USA. The deposit has been assigned ATCC Patent Deposit Number PTA-127065.

*Bacillus amyloliquefaciens* strain "ELA202071" was deposited on 11 May 2021 according to the Budapest Treaty in the American Type Culture Collection (ATCC), ATCC Patent Depository, 10801 University Boulevard, Manassas, Va., 20110, USA. The deposit has been assigned ATCC Patent Deposit Number PTA-127064.

*Bacillus subtillis* strain "ELA191105" was deposited on 19 Jun. 2020 according to the Budapest Treaty in the American Type Culture Collection (ATCC), ATCC Patent Depository, 10801 University Boulevard, Manassas, Va., 20110, USA. The deposit has been assigned ATCC Patent Deposit Number PTA-126786.

Access to the deposits will be available during the pendency of this application to persons determined by the Commissioner of Patents and Trademarks to be entitled thereto under 37 C.F.R. § 1.14 and 35 U.S.C. 122. Upon allowance of any embodiments in this application, all restrictions on the availability to the public of the variety will be irrevocably removed.

The deposits will be maintained in the ATCC depository, which is a public depository, for a period of 30 years, or 5 years after the most recent request, or for the effective life of the patent, whichever is longer, and will be replaced if a deposit becomes nonviable during that period.

The present disclosure may be better understood with reference to the examples, set forth below. The following examples are put forth so as to provide those of ordinary skill in the art with a complete disclosure and description of how the compounds, compositions, and/or methods claimed herein are made and evaluated, and are intended to be purely exemplary and are not intended to limit the disclosure. It will be appreciated that other embodiments and uses will be apparent to those skilled in the art and that the invention is not limited to these specific illustrative examples or preferred embodiments.

EXAMPLES

Example 1. Isolation of *Bacillus* Strains

Samples are isolated from chicken cecal samples. The samples are either heated to 90° C. for 10 minutes or treated with ethanol to a final concentration of 50% for 1 hour for spore isolation. The treated samples are plated on LB medium and the resulting colonies are purified by three sequential transferred onto LB agar plates. Identity of isolates is determined by amplification of 16S-rRNA gene followed by DNA Sanger sequencing of the PCR amplicon.

Example 2. Strain Characterization and Selection

Inhibition of bacterial strains by ELA191024, ELA191036, and ELA191105 is tested. Table 2 summarizes the results of inhibition of isolated strains.

TABLE 2

| Strain ID | Origin | ID | APEC O2 | APEC O78 | APEC O18 | CP 15 | *Salmonella Thypimurium* | *C. jejuni* |
|---|---|---|---|---|---|---|---|---|
| 14 | Poultry cecum, BRRS | *B. amyloliquefaciens* | ++ | + | ++ | ++ | x | x |
| 42 | Poultry cecum, BRRS | *B. amyloliquefaciens* | +++ | + | + | ++ | x | x |
| 64 | Poultry cecum, BRRS | *B. amyloliquefaciens* | + | | | | +++ | ++++ |
| 80 | Poultry cecum, BRRS | *B. amyloliquefaciens* | +++ | + | ++ | ++ | x | x |
| 30 | Poultry cecum, CQR | *B. amyloliquefaciens* | ++ | + | ++ | ++ | ++ | +++ |
| 44 | Poultry cecum, CQR | *Bacillus licheniformis* | + | + | + | + | + | + |
| 65 | Poultry cecum, BRRS | *B. amyloliquefaciens* | ++ | ++ | ++ | ++ | x | x |
| 7 | Poultry cecum, BRRS | *Bacillus pumilus* | + | – | – | – | – | – |
| 36 | Poultry cecum, BRRS | *B. amyloliquefaciens* | +++ | + | +++ | ++ | + | ++ |
| 84 | Poultry cecum, BRRS | *Bacillus subsilis* | ++ | + | + | + | + | x |
| 105 | Poultry cecum, BRRS | *Bacillus subsilis* | +++ | + | +++ | ++ | + | – |
| 114 | Poultry cecum, BRRS | *Bacillus pumilus* | + | – | – | – | x | x |

TABLE 2-continued

| Strain ID | Origin | ID | APEC O2 | APEC O78 | APEC O18 | CP 15 | *Salmonella Thypimurium* | *C. jejuni* |
|---|---|---|---|---|---|---|---|---|
| 121 | Poultry cecum, BRRS | *Bacillus pumilus* | + | − | − | − | x | x |
| 4 | Poultry cecum, BRRS | *Bacillus licheniformis* | +++ | ++ | ++ | ++ | ++ | + |
| 25 | Poultry cecum, BRRS | *B. amyloliquefaciens* | +++ | ++ | ++ | ++ | x | x |
| 137 | Poultry cecum, BRRS | *B. amyloliquefaciens* | +++ | ++ | ++ | ++ | ++ | + |
| 139 | Poultry cecum, BRRS | *B. amyloliquefaciens* | +++ | + | + | ++ | x | x |
| 153 | Poultry cecum, BRRS | *B. amyloliquefaciens* | +++ | ++ | ++ | ++ | x | x |
| 160 | Poultry cecum, BRRS | *B. amyloliquefaciens* | +++ | + | ++ | ++ | x | x |
| 165 | Poultry cecum, BRRS | *B. amyloliquefaciens* | +++ | ++ | ++ | ++ | x | x |
| 24 | Poultry cecum, BRRS | *B. amyloliquefaciens* | ++ | ++ | ++ | ++ | ++ | ++ |

Note:
*Clostridium perfringens* strain 15
Strain ID 24 is ELA191024, Strain ID 36 is ELA191036, and Strain ID 105 is ELA191105.

Figure 3:
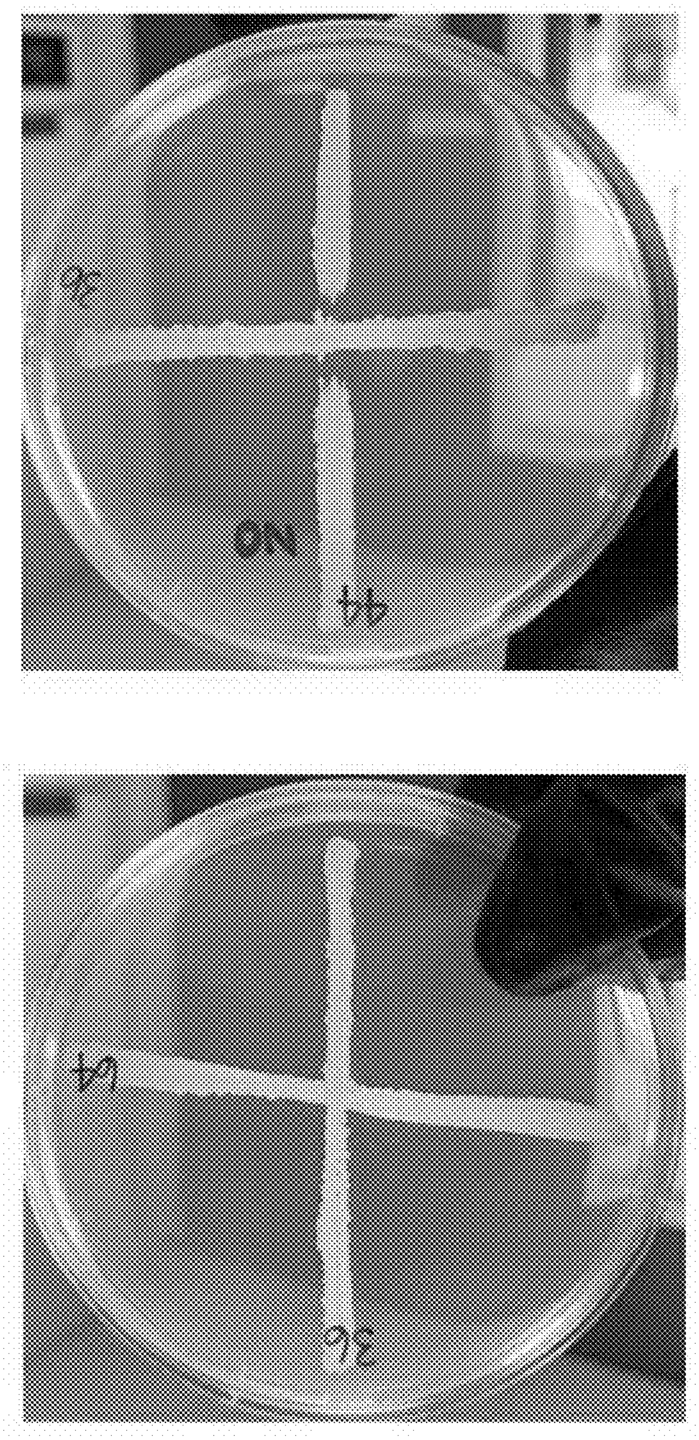
FIG. 3A-3B prov ides examples of a compatibility test for compatibility of isolated strains. One strain is streaked perpendicular to the other strain. (A) shows compatibility of the two strains tested. (B) shows a clearance zone in the intersection of the strains, suggesting strain incompatibility.

Compatibility of isolated strains are tested (compatibility test). One strain is streaked perpendicular to the other strain on LB agar plate. See FIGS. 3A and 3B for an exemplary compatibility test. Clearance zone in the intersection suggest strain incompatibility. The data from the compatibility test are summarized in Table 3.

TABLE 3

| Isolate # | 4 | 7 | 24 | 30 | 36 | 44 | 64 | 105 | 137 |
|---|---|---|---|---|---|---|---|---|---|
| 4 | X | x | x | x | x | x | x | x | x |
| 7 | YES | x | x | x | x | x | x | x | x |
| 24 | YES | YES | x | x | x | x | x | x | x |
| 30 | YES | YES | YES | x | x | x | x | x | x |
| 36 | YES | YES | YES | YES | x | x | x | x | x |
| 44 | NO | YES | NO | NO | NO | x | x | x | x |
| 64 | YES | YES | YES | YES | YES | NO | x | x | x |
| 105 | SLIGHT | YES | SLIGHT | SLIGHT | SLIGHT | YES | SLIGHT | x | x |
| 137 | YES | YES | YES | YES | YES | NO | YES | YES | x |

YES-compatible; NO-incompatible; SLIGHT-slight inhibition. Strain key: 4-*Bacillus licheniformis*, 7-*Bacillus licheniformis*, 24-*B. amyloliquefaciens* (ELA191024), 30-*B. amyloliquefaciens*, 36-*B. amyloliquefaciens* ELA191036, 44-*Bacillus licheniformis*, 64-*B. amyloliquefaciens*, 105-*Bacillus licheniformis Bacillus licheniformis* (ELA191105), and 137-*B. amyloliquefaciens*.

Examples 3-10. Characterization of Strains ELA191024, ELA191036, and ELA191105

Example 3. Antibiotic Susceptibility

Antibiotic susceptibility of Strains ELA191024 and ELA191105 are tested. ELA191024 and ELA191105 are susceptible to chloramphenicol, gentamicin, tetracycline, erythromycin, clindamycin, streptomycin, kanamycin, and vancomycin.

Example 4. Growth Media

Growth on arbinoxylan and banana starch as the sole growth media are tested. ELA191024, ELA191036, and ELA191105 are capable of growth on the aforementioned as the sole growth substrates.

Example 5. Sporulation

Sporulation of ELA191024, ELA191036, and ELA191105 is tested. ELA191024, ELA191036, and ELA191105 formed spores in tested sporulation medium (Difco Sporulation Medium, DSM) and the culture is grown at 37° C. for 72 h.

Example 6. Digestive Enzyme Analysis

Figure 2:
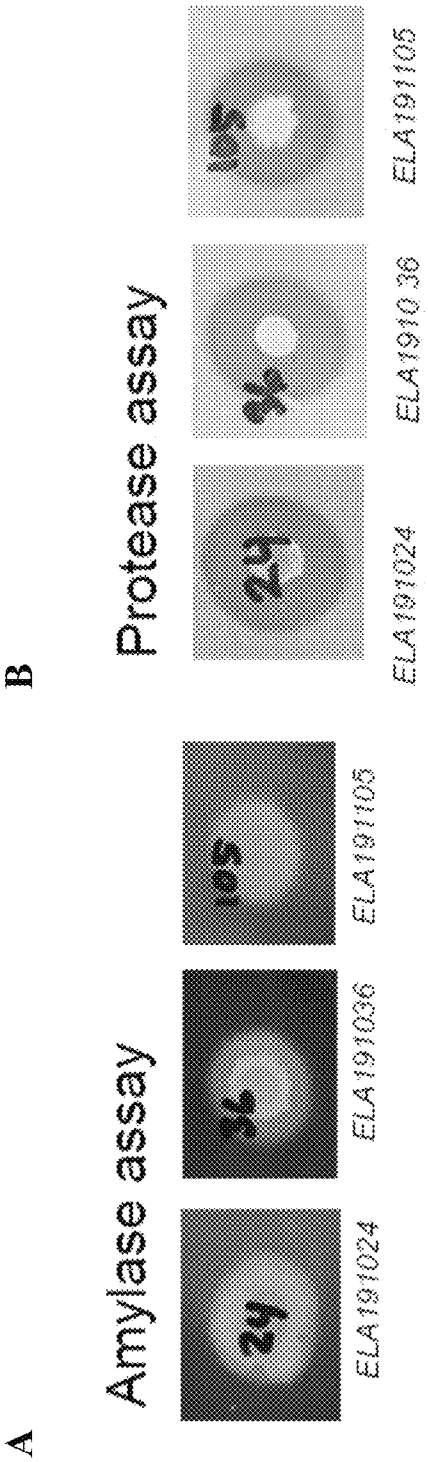
FIG. 2 depicts digestive enzyme activity of *Bacillus amyloliquefaciens* ELA191024, *Bacillus amyloliquefaciens* ELA191036, and *Bacillus subtilis* ELA191105. Amylase assay (left) and Protease assay (right).

Amylase and protease activities of ELA191024, ELA191036, and ELA191105 are tested following protocol as described by Latorre, J D, 2016. Briefly, overnight culture of *Bacillus* isolate is spotted onto agar plate containing soluble starch and skim milk for amylase and protease assay, respectively. The plates are incubated at 37° C. for 48 h. The zone of clearance due to protease activity is observed directly whereas zone of clearance from amylase activity was visualized by flooding the surface of the plates with 5 mL of Gram's iodine solution. Protease activity of ELA191024, ELA191036, and ELA191105 are tested by way of protease assay. See FIG. 2. Amylase and protease activity are observed.

Beta-mannanase activity for ELA191024, ELA191036, and ELA191105 are tested. The strains are capable of digesting galactomannan.

Example 7. Cytotoxicity Assay

Cytotoxicity of ELA191024, ELA191036, and ELA191105 are tested against Vero cells. Cytotoxicity is measured by LDH cytotoxicity test. Positive control: *Bacillus cereus* DSM 31 (ATCC 14579) (78.6% cytotoxicity); Negative control: *Bacillus licheniformis* ATCC 14580 (−0.1% cytotoxicity); Test control: *Subtilis* 747 (Correlink™ strain) (8.7% cytotoxicity; non-toxic). ELA191024, ELA191036, and ELA191105 strains are not cytotoxic to Vero cells. The percent cytotoxicity is less than 10.

Example 8. Genomic Analysis

ELA191024, ELA191036, and ELA191105 are sequenced and some genomic features are described in Table 4.

TABLE 4

| Features | *B. amyloliquefaciens* 24 (ELA191024) | *B. amyloliquefaciens* 36 (ELA191036) | *B. subtilis* 105 (ELA191105) |
|---|---|---|---|
| Contigs | 1 | 2 | 1 |
| Coverage | 214x | 188x<br>500x | 117x |
| % GC | 45 | 44 | 43 |
| Length (Mbp) | 4.09 | 4.31 | 4.089 |

ELA191105 possesses over 150 genes that are absent in ELA191024 and ELA191036. Some of the unique genes include Metabolic enzymes (Phosphosulfolactate synthase, ethanolamine/propanediol utilization, Malate/lactate dehydrogenase); Antioxidant (Prokaryotic glutathione synthetase); Transporters (Organic Anion Transporter Polypeptide (OATP) family); and Digestive enzymes (alpha-amylase).

Example 9. Genomic Analysis

Strains ELA191024, ELA191036, and ELA191105 are sequenced and the genomes are analyzed. Table 5 summarizes some of the digestive enzyme identified in genomic analysis of the strains.

TABLE 5

| Digestive enzymes | ELA191024 | ELA191036 | ELA191105 |
|---|---|---|---|
| Lipase | Present | Present | Present |
| 3-Phytase | Present | Present | Present |
| Endo-1,4-beta-mannosidase (Beta-D-mannanase) | Present | Present | Present |
| 1,4-α-glucan branching enzyme GlgB | Absent | Absent | Present |

TABLE 5-continued

| Digestive enzymes | ELA191024 | ELA191036 | ELA191105 |
|---|---|---|---|
| 6-phospho-beta-galactosidase | Present | Present | Absent |
| Alpha-amylase | Present | Present | Present |
| Alpha-galactosidase | Present | Present | Present |
| Beta-glucanase | Present | Present | Present |
| Beta-hexosaminidase | Present | Present | Present |
| Endo-1,4-beta-xylanase A | Present | Present | Present |
| Endoglucanase | Present | Present | Present |
| L-Ala--D-Glu endopeptidase | Present | Present | Present |
| Maltose-6' phosphate glucosidase | Present | Present | Present |
| Oligo-1,6-glucosidase | Present | Present | Present |
| Oligo-1,6-glucosidase 1 | Absent | Absent | Present |
| Pectate lyase | Present | Present | Present |
| Pectate lyase C | Absent | Absent | Present |
| Pectin lyase | Present | Present | Present |
| Pullulanase | Absent | Absent | Present |
| putative 6-phospho-beta- glucosidase | Present | Present | Present |
| putative oligo-1,6-glucosidase2 | Present | Present | Present |

Table 6 summarizes some of exemplary antimicrobial peptide and secondary metabolite genes identified in genomic analysis of the strains.

TABLE 6

| Features | Remark | ELA191024 | ELA191036 | ELA191105 |
|---|---|---|---|---|
| A. Bacteriocins<br>Ribosomally synthesized | | | | |
| Lichenicidin A | Active against Gram-positive pathogens, *Listeria monocytogenes*, MRSA, Vancomycine-resistant *Enterococcus* | Present | Present | Absent |
| Circularin | Active against *Streptococci*, *Listeria*, *enterococci*, *Micrococcus* and *Staphylococcus* | Present | Present | Absent |

TABLE 6-continued

| Features | Remark | ELA191024 | ELA191036 | ELA191105 |
|---|---|---|---|---|
| LCI | Highly potent against *Xanthomonas* | Present | Present | Absent |
| Subtilosin A | Active against Gram positive bacteria | Absent | Absent | Present |
| | Non-ribosomally synthesized | | | |
| Plipastatin | Potent antifungal | Present | Present | Present |
| Surfactin | Antibacterial, antifungal, antiviral, anti-mycoplasma | Present | Present | Present |
| Bacillibactin | Cathecolic siderophore for iron acquisition | | | |
| Bacilysin | Active against broad range of bacteria and fungi | Present | Present | Present |
| Gramicidin/Tyrocidine | Antimicrobial (Gram positive and negative) | Present | Present | Absent |
| | B. Secondary metabolites | | | |
| Terpene-derived metabolites | Terpenoid isoprenoids-cell signalling associated with antagonistic interactions. Volatile terpenes-antibacterial, antifungal, and antinematodes | 2 clusters | 2 clusters | 2 clusters |
| Polyketide-derived metabolites | Antimicrobial activities | 3 clusters | 3 clusters | 1 cluster |

Example 10. Global Metabolomics Analysis

A global metabolomics analysis of strains *B. amyloliquefaciens* (ELA 191024), *B. amyloliquefaciens* strain (ELA191036), and strain *B. subtilis* (ELA191105) is conducted. The strains are grown individually and in combination, and the resulting cell pellet and supernatant are analyzed to identify metabolites, Strains are grown at 37° C. for 24 hours in minimal media or rich media. Fresh media (no cells) were used as control samples. The metabolites in the supernatant represent molecules that are secreted by the cell.

Minimal medium: M9 salts with 0.5 g casamino acids/L and 1% glucose. M9 salts contains Disodium Phosphate (anhydrous) 6.78 g/L, Monopotassium Phosphate 3 g/L, Sodium Chloride 0.5 g/L, Ammonium Chloride Ig/L. Rich medium: *Bacillus* broth (per liter): Peptone 30 g; Sucrose 30 g; Yeast extract 8 g; KH2PO4 4 g; MgSO4 1.0 g; MnSO4 25 mg.

Samples are prepared using the automated MicroLab STAR® system from Hamilton Company. Several recovery standards are added prior to the first step in the extraction process for QC purposes. Samples are extracted with methanol under vigorous shaking for 2 min (Glen Mills GenoGrinder 2000) to precipitate protein and dissociate small molecules bound to protein or trapped in the precipitated protein matrix, followed by centrifugation to recover chemically diverse metabolites. The resulting extract is divided into five fractions: two for analysis by two separate reverse phase (RP)/UPLC-MS/MS methods using positive ion mode electrospray ionization (ESI), one for analysis by RP/UPLC-MS/MS using negative ion mode ESI, one for analysis by HILIC/UPLC-MS/MS using negative ion mode ESI, and one reserved for backup. Samples are placed briefly on a TurboVap® (Zymark) to remove the organic solvent. The sample extracts are stored overnight under nitrogen before preparation for analysis.

Ultrahigh Performance Liquid Chromatography-Tandem Mass Spectroscopy (UPLC-MS/MS): All methods utilize a Waters ACQUITY ultra-performance liquid chromatography (UPLC) and a Thermo Scientific Q-Exactive high resolution/accurate mass spectrometer interfaced with a heated electrospray ionization (HESI-II) source and Orbitrap mass analyzer operated at 35,000 mass resolution. The sample extract is dried then reconstituted in solvents compatible to each of the four methods. Each reconstitution solvent contains a series of standards at fixed concentrations to ensure injection and chromatographic consistency. One aliquot is analyzed using acidic positive ion conditions, chromatographically optimized for more hydrophilic compounds. In this method, the extract is gradient-eluted from a C18 column (Waters UPLC BEI-H C18-2.1×100 mm, 1.7 μm) using water and methanol, containing 0.05% perfluoropentanoic acid (PFPA) and 0.1% formic acid (FA). A second aliquot is also analyzed using acidic positive ion conditions, but is chromatographically optimized for more hydrophobic compounds. In this method, the extract is gradient eluted from the aforementioned C18 column using methanol, acetonitrile, water, 0.05% PFPA, and 0.01% FA, and is operated at an overall higher organic content. A third aliquot is analyzed using basic negative ion optimized conditions using a separate dedicated C18 column. The basic extracts are gradient-eluted from the column using methanol and water, however with 6.5 mM Ammonium Bicarbonate at pH 8. The fourth aliquot is analyzed via negative ionization following elution from a HILIC column (Waters UPLC BEH Amide 2.1×150 mm, 1.7 μm) using a gradient consisting of water and acetonitrile with 10 mM Ammonium Formate, pH 10.8. The MS analysis alternates between MS and data-dependent MSn scans using dynamic exclusion. The scan range covers approximately 70-1000 m/z.

Data are subject to global untargeted metabolic profiling. Welch t-test and Principal Component Analysis (PCA) are used to analyze the data. Principal component analysis (PCA) is a mathematical procedure that reduces the dimensionality of the data while retaining most of the variation in a dataset. This approach allows visual assessment of the similarities and differences between samples (growth conditions, including media type and strains present). Populations that differ are expected to group separately and vice versa. See FIGS. 5A and 5B.

Metabolite Quantification and Block Correction: Peaks are quantified as area-under-the-curve detector ion counts.

For studies spanning multiple days, a data adjustment step is performed to correct block variation resulting from instrument inter-day tuning differences, while preserving intraday variance. Essentially, each compound is corrected in balanced run-day blocks by registering the daily medians to equal one (1.00), and adjusting each data point proportionately (termed the "block correction"). For studies that do not require more than one day of analysis, no adjustment of raw data is necessary, other than scaling for purposes of data visualization.

Metabolite is identified as unique to a single strain if the value for the secreted metabolite is at least 1.5-fold greater than those of the other two single isolates. Unique metabolites for strain consortia are determined using>1.5-fold cut off compared to values of respective metabolites secreted by single isolates of the consortium. Table 7 summarizes the total number of metabolites identified as being secreted into the growth media. Total indicates the total number of metabolites detected both growth conditions. The column marked Unique indicates the total number of non-duplicate metabolites between each growth condition.

TABLE 7

| Category | ELA191024 | ELA191036 | ELA191105 |
|---|---|---|---|
| Metabolites in rich medium | 151 | 204 | 231 |
| Metabolites in minimal medium | 112 | 102 | 111 |
| Total metabolites | 206 | 248 | 272 |

Table 8 summarizes the number of unique metabolites of single *Bacillus* and *Bacillus* in consortia with 1.5 fold threshold. Numbers in parenthesis indicate a 2-fold threshold.

TABLE 8

| *Bacillus* isolates | Number of unique metabolites |
|---|---|
| ELA191024 | 30 (15) |
| ELA191036 | 84 (48) |
| ELA191105 | 77 (45) |
| ELA191024 and ELA191036 | 49 (34) |
| ELA191024, ELA191036, and ELA191105 | 57 (19) |

Strains ELA191024, ELA191036, and ELA91105 are cultured individually in minimal media and the supernatant is analyzed for secreted metabolites. Table 9 provides an exemplary list of metabolites secreted by each strain. Unless otherwise noted, the metabolite is at least 1.5 fold greater than the media control.

TABLE 9

| METABOLITE | ELA191024 | ELA191036 | ELA191105 |
|---|---|---|---|
| N-acetyl-cadaverine | No | Yes | No |
| isovalerate (C5) | No | Yes[A,B,C] | Yes[A] |
| N-acetylisoleucine | Yes[A] | Yes[A,B,C] | Yes[A,B,C] |
| Homocysteine | Yes[A,B,C] | Yes[A,B,C] | Yes[A,B,C] |
| Homocystine | Yes[A,B,C] | Yes[A,B,C] | Yes[A,B,C] |
| N-acetylcitrulline | Yes[A,B,C] | Yes[A,B,C] | Yes[A,B,C] |
| Glucoronate | No | Yes[A] | No |
| alpha-ketoglutarate | Yes[A,B,C] | Yes[A,B,C] | Yes[A,B,C] |
| 5-hydroxyhexanoate | Yes[A] | Yes[A,B,C] | Yes[A,B] |
| glycerol 3-phosphate | No | Yes[A,B] | Yes[A] |
| 5-aminoimidazole-4-carboxamide | Yes | No | No |

TABLE 9-continued

| METABOLITE | ELA191024 | ELA191036 | ELA191105 |
|---|---|---|---|
| Hypoxanthine | Yes[A,B,C] | Yes[A,B,C] | Yes[A,B,C] |
| Guanine | Yes[A,B,C] | Yes[A,B,C] | Yes[A,B,C] |
| Orotate | Yes[A,B,C] | Yes[A,B,C] | Yes[A,B,C] |
| Orotidine | No | Yes[A] | No |
| 5,6-dihydrouridine | Yes[A] | Yes[A,B,C] | Yes[A,B] |
| 3-dehydroshikimate | Yes[A,B] | Yes[A,B,C] | Yes[A,B] |
| Kynurenate | No | Yes | No |
| Indolactate | No | No | Yes |
| Cyclo(gly-pro) | No | No | Yes |
| Cyclo(his-phe) | Yes[A,B] | Yes[A,B,C] | Yes[A,B,C] |
| Cyclo(phe-pro) | No | Yes | No |
| Cyclo(phe-pro) (L,D) | No | Yes | Yes |
| 1-kestose | Yes[A,B,C] | No | Yes[A,B] |
| Thioproline | Yes[A,B,C] | Yes[A,B,C] | Yes[A,B,C] |
| N-acetylaspartate (NAA) | No | Yes[A,B,C] | Yes[A,B] |
| Glutamine | Yes[A] | No | Yes |
| Tryptophan | Yes[A,B,C] | Yes[A,B] | Yes[A,B,C] |
| Cysteine | Yes[A,B,C] | Yes[A,B,C] | Yes[A,B,C] |
| Pyridoxamine | Yes[A,B,C] | Yes[A,B,C] | Yes[A,B,C] |
| Pyridoxamine phosphate | No | Yes[A] | Yes[A] |
| pantothenate (Vitamin B5) | Yes[A,B] | Yes[A,B,C] | Yes[A,B,C] |
| pyridoxine (Vitamin B6) | No | No | Yes[A] |
| 2R,3R-dihydroxybutyrate | Yes[A,B,C] | Yes[A,B,C] | Yes[A,B,C] |
| Choline | Yes[A,B] | No | Yes[A,B,C] |
| 5-aminoimidazole-4-carboxamide | | | No |
| trigonelline (N'-methylnicotinate) | Yes[A,B,C] | Yes[A,B,C] | Yes[A,B,C] |
| Mevalonolactone | Yes[A,B,C] | Yes[A,B,C] | Yes[A,B,C] |
| Tricarballylate | Yes[A] | Yes | No |

[A]metabolite is secreted at least 2 fold greater than media control;
[B]metabolite is secreted at least 3 fold greater than media control;
[C]metabolite is secreted at least 5 fold greater than media control.

Strains ELA191024, ELA191036, and ELA191105 are cultured individually in rich media and the supernatant is analyzed for secreted metabolites. Table 10 provides an exemplary list of metabolites secreted by each strain. Unless otherwise noted, the metabolite is at least 1.5 fold greater than the media control.

TABLE 10

| METABOLITE | ELA191024 | ELA191036 | ELA191105 |
|---|---|---|---|
| N-acetyl-cadaverine | No | No | Yes[A,B] |
| isovalerate (C5) | No | No | Yes[A] |
| N-acetylisoleucine | Yes[A] | No | Yes[A,B,C] |
| Homocystine | Yes[A,B] | No | No |
| Homocysteine | Yes[A,B,C] | Yes[A,B,C] | Yes[A,B,C] |
| N-acetylcitrulline | Yes[A,B,C] | No | No |
| Glucoronate | No | No | Yes[A,B,C] |
| alpha-ketoglutarate | Yes[A,B,C] | Yes[A,B,C] | No |
| 5-hydroxyhexanoate | Yes[A,B,C] | Yes[A,B] | No |
| 2R,3R-dihydroxybutyrate | No | No | Yes[A,B] |
| glycerol 3-phosphate | Yes[A,B] | Yes[A] | Yes |
| 5-aminoimidazole-4-carboxamide | No | No | Yes[A,B,C] |
| Hypoxanthine | Yes[A,B,C] | Yes[A,B] | No |
| Guanine | Yes[A,B,C] | Yes[A,B] | No |
| Orotate | Yes[A,B,C] | Yes[A,B,C] | No |
| Orotidine | No | Yes[A] | No |

TABLE 10-continued

| METABOLITE | ELA191024 | ELA191036 | ELA191105 |
|---|---|---|---|
| 5,6-dihydrouridine | No | No | Yes[A,B,C] |
| 3-dehydroshikimate | Yes[A,B,C] | Yes[A,B,C] | No |
| Indolactate | Yes[A,B,C] | Yes[A,B,C] | Yes[A,B,C] |
| Indoleacetate | Yes[A] | Yes[A,B] | Yes[A,B] |
| 1-kestose | Yes[A,B,C] | Yes[A,B,C] | Yes[A,B,C] |
| Thioproline | Yes[A,B,C] | Yes[A,B,C] | Yes[A,B,C] |
| N-acetylaspartate (NAA) | Yes[A] | No | Yes[A] |
| Glutamine | Yes[A,B,C] | Yes[A,B,C] | Yes[A,B,C] |
| Cysteine | Yes[A,B,C] | Yes[A,B,C] | Yes[A,B,C] |
| Pyridoxamine | No | No | Yes[A] |

TABLE 10-continued

| METABOLITE | ELA191024 | ELA191036 | ELA191105 |
|---|---|---|---|
| Pyridoxamine phosphate | No | No | Yes[A] |
| 5-aminoimidazole-4-carboxamide | No | No | Yes[A,B,C] |
| Tricarballylate | No | No | Yes |

[A]metabolite is at least 2 fold greater than media control;
[B]metabolite is at least 3 fold greater than media control;
[C]metabolite is at least 5 fold greater than media control.

Strains ELA191024, ELA191036, and ELA191105 are cultured individually in minimal media and rich media, and the supernatants are analyzed for secreted metabolites. Table 11 provides an exemplary list of metabolites uniquely secreted by each strain. Unless otherwise noted, the listed metabolite in the media is at least 1.5 fold greater than the other two strains.

TABLE 11

| ELA191024 | ELA191036 | ELA191105 |
|---|---|---|
| Glutamine | 2-methylserine | betaine[A] |
| anthranilate[A] | N-acetylaspartate (NAA)[A,B] | carboxyethyl-GABA[A] |
| methionine sulfone | N-acetylasparagine | 3-methylhistidine[A] |
| 2-hydroxybutyrate/ | N-acetylglutamate[A,B] | saccharopine |
| 2-hydroxyisobutyrate | N-acetylglutamine[A] | pipecolate |
| gamma- | 2-pyrrolidinone[A] | N,N-dimethyl-5- |
| glutamylphenylalanine[A,B] | S-1-pyrroline-5- | aminovalerate[A,B] |
| gamma-glutamyltyrosine[A,B] | carboxylate | N-butyryl-phenylalanine[A] |
| azelate (C9-DC) | trans-urocanate[A,B,C] | tryptophan[A] |
| 5-aminoimidazole-4- | cis-urocanate[A,B,C] | N-butyryl-leucine |
| carboxamide | formiminoglutamate[A,B,C] | 2-hydroxy-4- |
| AMP[A] | 4-imidazoleacetate | (methylthio)butanoic acid[A] |
| adenosine-2',3'-cyclic | N6-acetyllysine | S-methylcysteine[A] |
| monophosphate | N-acetylphenylalanine[A] | ornithine |
| adenosine[A] | phenylpyruvate[A] | N-methylproline[A] |
| adenine[A] | phenethylamine | N,N,N-trimethyl-alanylproline |
| uridine-2',3'-cyclic | N-acetyltyrosine[A] | betaine (TMAP)[A] |
| monophosphate | tyramine | N-monomethylarginine[A] |
| cytidine 2',3'-cyclic | 4-hydroxyphenylpyruvate[A,B] | guanidinoacetate |
| monophosphate[A] | 3-methoxytyramine[A] | putrescine |
| (3'-5')-uridylyladenosine[A] | 5-hydroxymethyl-2-furoic | cysteinylglycine[A,B,C] |
| nicotinamide | acid[A] | cyclo(gly-phe) |
| ribonucleotide (NMN)[A,B] | N-acetylleucine | tryptophylglycine |
| 1-kestose[A] | isovalerate (C5)[A,B] | pyruvate[A,B] |
| homocystine[R,A] | N-acetylisoleucine[A,B,C] | mannose |
| N-acetylcitrulline[R,A,B,C] | 3-methyl-2-oxovalerate | N-acetylmuramate[A] |
| alpha-ketoglutarate [R] | 2-hydroxy-3- | eicosenamide (20:1)[A,B,C] |
| succinate[R,A,B] | methylvalerate | deoxycarnitine[A] |
| 5-hydroxyhexanoate[R] | methylsuccinate[A] | 2S,3R-dihydroxybutyrate |
| inositol 1-phosphate (I1P)[R] | N-acetylvaline[A,B,C] | chiro-inositol[A,B] |
| N6-methyladenosine[R] | 3-methyl-2-oxobutyrate[A] | choline |
| 2'-O-methyladenosine[R] | N-acetylmethionine | glycerophosphorylcholine |
| guanine[R,A] | N-acetylmethionine | (GPC)[A] |
| 5,6-dihydrouridine[R] | sulfoxide[A] | 1-palmitoyl-GPE (16:0)[A] |
| nicotinamide | S-adenosylmethionine | 1-linoleoylglycerol (18:2) |
| ribonucleotide (NMN)[R] | (SAM)[A,B] | 3-hydroxy-3-methylglutarate |
| 3-dehydroshikimate[R,A] | homocystine[A,B] | 3-ureidopropionate |
| 4-hydroxybenzyl alcohol[R] | N-acetylarginine | (3'-5')-uridylyluridine |
| quinate[R] | N-acetylcitrulline[A,B,C] | nicotinamide riboside |
| | N-acetylproline[A] | trigonelline (N'- |
| | N-alpha-acetylornithine | methylnicotinate) |
| | hydroxyproline | oxalate (ethanedioate)[A] |
| | acetylagmatine[A] | pyridoxine (Vitamin B6) |
| | spermidine[A,B] | maltol |
| | (N(1) + N(8)- | histidine betaine (hercynine) |
| | acetylspermidine[A] | 2,6-dihydroxybenzoic acid |
| | spermine[A] | pentose acid |
| | 5-methylthioadenosine | N-acetylserine[R,A] |
| | (MTA)[A,B] | N-acetylthreonine[R] |
| | 4-acetamidobutanoate[A,B,C] | N-acetylglutamine[R,A] |
| | 3-phosphoglycerate[A] | 1-methylhistidine[R,A,B] |
| | phosphoenolpyruvate | N-acetylhistidine[R,A] |
| | (PEP)[A,B,C] | trans-urocanate[R,A] |
| | sedoheptulose-7- | N6-acetyllysine[R] |
| | phosphate | N-acetyl-cadaverine[R,A,B] |
| | sedoheptulose | N-acetylphenylalanine[R,A] |

TABLE 11-continued

| ELA191024 | ELA191036 | ELA191105 |
|---|---|---|
| | sucrose | phenyllactate (PLA)$^{R,A}$ |
| | glucuronate$^{A}$ | 3-(4-hydroxyphenyl)lactate (HPLA)$^{R,A,B}$ |
| | N-acetyl-glucosamine 1-phosphate$^{A,B}$ | isovalerate (C5)$^{R,A,B}$ |
| | N-acetylglucosamine/N-acetylgalactosamine$^{A}$ | N-acetylisoleucine$^{R,A,B,C}$ |
| | citraconate/glutaconate$^{A,B,C}$ | N-acetylvaline$^{R,A}$ |
| | butyrate/isobutyrate (4:0)$^{A,B}$ | N-acetylmethionine$^{R}$ |
| | 2-hydroxyglutarate | S-adenosylmethionine (SAM)$^{R}$ |
| | 5-dodecenoylcarnitine (C12:1)$^{A}$ | 2-hydroxy-4-(methylthio)butanoic acid$^{R}$ |
| | 3-hydroxyoctanoate | S-methylcysteine$^{R,A}$ |
| | 5-hydroxyhexanoate | N-acetylarginine$^{R}$ |
| | 1-stearoyl-GPE (18:0) | acetylagmatine$^{R,A}$ |
| | glycerol 3-phosphate | glutathione,oxidized (GSSG) $^{R,A}$ |
| | xanthine | 2-hydroxybutyrate/2-hydroxyisobutyrate$^{R,A}$ |
| | xanthosine | gamma-glutamylhistidine$^{R,A}$ |
| | 1-methyladenine$^{A}$ | glucuronate |
| | N6-methyladenosine | aconitate [cis or trans]$^{R}$ |
| | guanosine | 2-methylcitrate$^{R}$ |
| | 7-methylguanine$^{A}$ | 2R,3R-dihydroxybutyrate$^{R,A,B}$ |
| | N-carbamoylaspartate | 5-aminoimidazole-4-carboxamide$^{R,A,B,C}$ |
| | orotidine | N-carbamoylaspartate$^{R,A}$ |
| | pseudouridine | dihydroorotate$^{R}$ |
| | 5,6-dihydrouridine | orotidine$^{R,A,B,C}$ |
| | 5-methylcytidine | thymine$^{R,A,B}$ |
| | thymine | (3'-5')-adenylylguanosine$^{R,A,B,C}$ |
| | nicotinate$^{A}$ | nicotinamide riboside$^{R}$ |
| | nicotinate ribonucleoside$^{A,B}$ | NAD+$^{R,A}$ |
| | pantothenate (Vitamin B5) | Pyridoxamine |
| | pterin$^{A}$ | pyridoxamine phosphate$^{A}$ |
| | benzoate | homocitrate |
| | 3-dehydroshikimate$^{A}$ | |
| | 2-isopropylmalate$^{A,B,C}$ | |
| | 4-hydroxybenzyl alcohol | |
| | 2,4-di-tert-butylphenol | |
| | 1-linoleoylglycerol (18:2)$^{R,A}$ | |
| | guanosine 3'-monophosphate (3'-GMP)$^{R}$ | |
| | guanosine-2',3'-cyclic monophosphate$^{R,A}$ | |
| | cytidine 2',3'-cyclic monophosphate$^{R}$ | |

$^{R}$metabolite secreted when grown in rich media;
$^{A}$metabolite is at least 2 fold greater than the two other strains;
$^{B}$metabolite is at least 3 fold greater than the two other strains;
$^{C}$metabolite is at least 5 fold greater than the two other strains.

Strains ELA191024 and ELA191036 are co-cultured in minimal media and rich media, and the supernatant is analyzed for secreted metabolites. Table 12 lists unique metabolites secreted by the consortium. Unless otherwise noted, the metabolite is secreted in minimal media and the amount in the media is at least 1.5 fold greater than strains grown individually.

TABLE 12

| | | |
|---|---|---|
| histidine | Pyruvate$^{A,B}$ | (3'-5')-cytidylyladenosine$^{A,B}$ |
| N-acetylhistidine$^{A}$ | Sucrose$^{A,B}$ | (3'-5')-cytidylylcytidine$^{A}$ |
| phenyllactate (PLA)$^{A,B}$ | Fumarate | (3'-5')-cytidylyluridine$^{A,B}$ |
| 1-carboxyethyltyrosine | Deoxycarnitine$^{A}$ | (3'-5')-guanylylcytidine |
| 3-(4-hydroxyphenyl) lactate (HPLA)$^{A,B}$ | 2R,3R-dihydroxybutyrate$^{A}$ | (3'-5')-guanylyluridine$^{A,B,C}$ |
| Tryptophan$^{A}$ | chiro-inositol$^{A}$ | (3'-5')-uridylylcytidine$^{A,B,C}$ |
| N-acetyltryptophan$^{A}$ | glycerophosphorylcholine (GPC)$^{A,B}$ | (3'-5')-uridylyluridine$^{A,B}$ |
| Anthranilate$^{A,B}$ | 5-aminoimidazole-4-carboxamide$^{A,B,C}$ | (3'-5')-uridylyladenosine$^{A}$ |
| Indolelactate | Xanthine$^{A}$ | NAD+$^{A,B,C}$ |
| Isovalerylglycine | AMP$^{A,B,C}$ | oxalate (ethanedioate) $^{A}$ |
| N-acetylisoleucine | 2'-deoxyadenosine$^{A}$ | maltol |
| N-acetylmethionine | dihydroorotate | 1-methylhistidine$^{R,A,B}$ |
| Urea | UMP$^{A,B,C}$ | N6,N6-dimethyllysine$^{R}$ |
| Ornithine$^{A}$ | urinde | S-methylcysteine$^{R}$ |
| Spermidine$^{A}$ | | 2-methylcitrate$^{R}$ |

TABLE 12-continued

| | |
|---|---|
| Spermine[A,B] | CMP[A,B,C] |
| Cysteinylglycine[A] | cytidine[A] |
| | (3'-5')-adenylyluridine[A,B,C] |

[R]metabolite secreted when grown in rich media;
[A]metabolite is at least 2 fold greater than the two strains grown individually;
[B]metabolite is at least 3 fold greater than the two strains grown individually;
[C]metabolite is at least 5 fold greater than the two strains grown individually.

Strains ELA191024, ELA191036, and ELA191105 are co-cultured and the supernatant is analyzed for secreted metabolites. Table 13 lists unique metabolites secreted by the consortium. Unless otherwise noted, the metabolite is secreted in minimal media and is at least 1.5 fold greater than strains grown individually.

TABLE 13

| | | |
|---|---|---|
| N-carbamoylserine[A] | Isobar: hexose diphosphates | N6-succinyladenosine |
| beta-citrylglutamate | ribitol | guanosine 2'-monophosphate |
| N6-methyllysine | arabonate/xylonate | (2'-GMP |
| N6,N6-dimethyllysine[A] | ribulonate/xylulonate/lyxonate | 2'-O-methyluridine |
| N6,N6,N6- | fructose[A] | uridine 2'-monophosphate (2'- |
| trimethyllysine | galactonate[A] | UMP)[A] |
| Saccharopine | isocitric lactone | 5-methylcytosine[A] |
| cadaverine | fumarate[A,B] | pantoate |
| N-succinyl-phenylalanine | malate[A,B] | pantothenate (Vitamin B5) |
| 2-hydroxyphenylacetate | 3-hydroxyhexanoate | glucarate (saccharate)[A] |
| 3-(4-hydroxyphenyl) | 5-hydroxyhexanoate | Hippurate |
| lactate (HPLA) | myo-inositol[A] | histidinol |
| N-acetyltryptophan | chiro-inositol | homocitrate[A] |
| indolelactate[A] | glycerophosphoethanolamine | pyrraline[A] |
| N-acetylleucine | glycerophosphoinositol | 2-keto-3-deoxy-gluconate |
| 4-methyl-2- | 3-hydroxy-3-methylglutarate | pentose acid |
| oxopentanoate | Mevalonate[A] | N,N-dimethylalanine |
| homocitrulline[A] | 5-aminoimidazole-4- | Isobar: hexose diphosp |
| dimethylarginine (ADMA + | carboxamide[A] | 2-methylcitrate[R] |
| SDMA) | 2'-AMP | (3'-5')-adenylylguanosine[R] |
| N-monomethylarginine | 2'-O-methyladenosine | |
| guanidinoacetate | | |
| N(1)-acetylspermine[A] | | |
| glucose 6-phosphate[A,B] | | |

[R]metabolite secreted when grown in rich media;
*secreted in both minimal media and rich media;
[A]metabolite is at least 2 fold greater than the three strains grown individually;
[B]metabolite is at least 3 fold greater than the three strains grown individually;
[C]metabolite is at least 5 fold greater than the three strains grown individually.

Example 11. In Vivo Evaluation of Bacterial Strains

Strain ELA191024 is administered to broiler chickens at a dose of approximately 1.5x$10^5$ CFU/g of feed. Control: n=30 pens (1,500 total birds); Test: *B. amyloliquefaciens* strain ELA 191024: n=20 pens (1,000 total birds). Starter feed is administered until day 12, 10 grower feed is administered until day 25, finisher feed is administered until day 42. ELA191024 is present at all feed stages.

Figure 4:
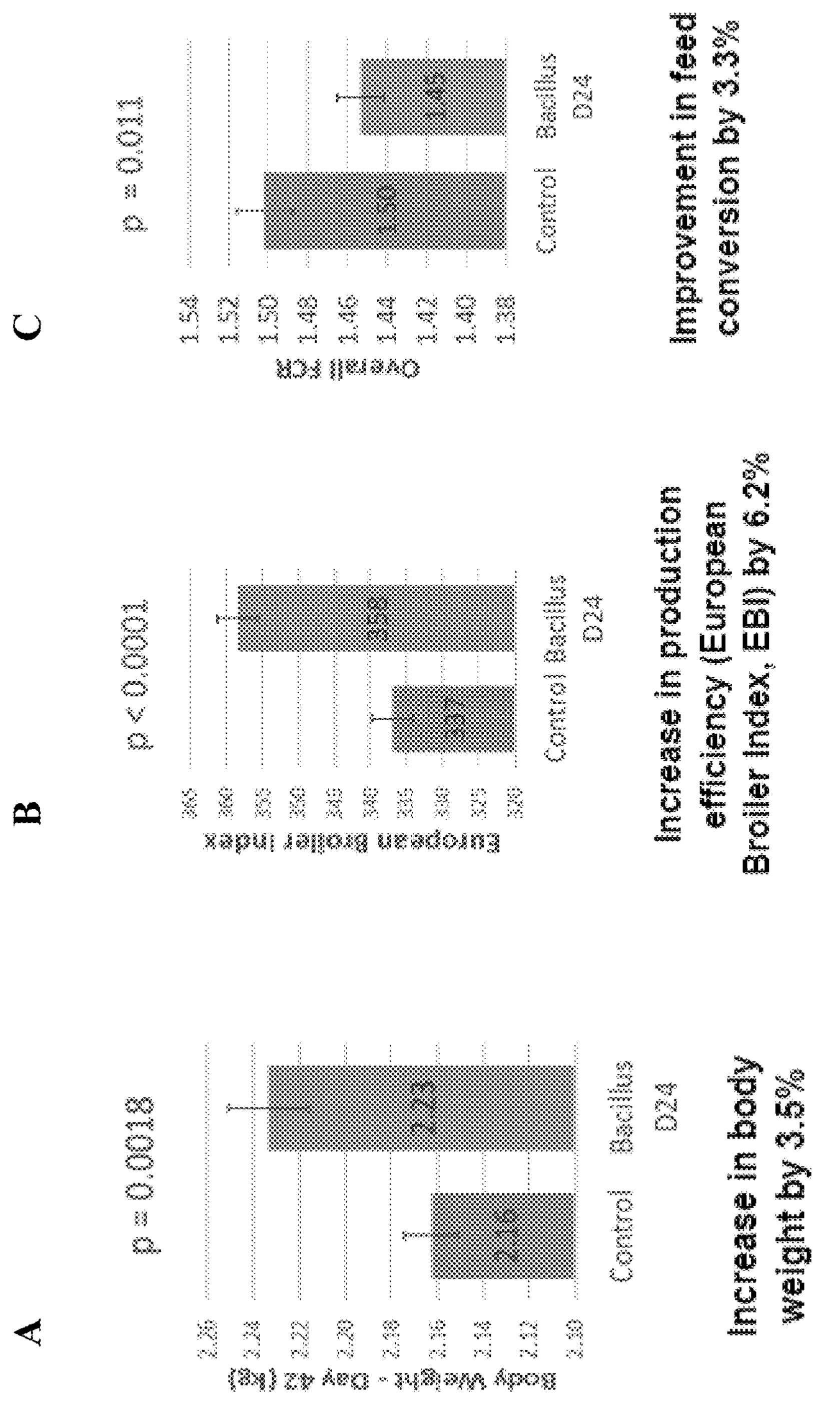
FIG. 4A-4C depicts the data from in-vivo efficacy study on broiler chickens with strain ELA191024 (*Bacillus* D24). The following was observed: (A) increase in body weight by 3.5%; (B) increase in production efficiency (European Broiler Index, EBI) by 6.2%; and (C) improvement in feed conversion by 3.3%.

In broiler chickens, the following was observed: increase in body weight by 3.5%; increase in production efficiency (European Broiler Index, EBI) by 6.2%; and improvement in feed conversion by 3.3%. See FIG. 4.

ELA191024, ELA191036, and ELA 191105 are administered individually and in combination to poultry and gut permeability is measured.

ELA191024, ELA1036, and ELA191105 are administered individually and in combination to poultry and feed conversion ratio is measured.

ELA191024, ELA191036, and ELA191105 are administered individually and in combination to poultry and structure and function of poultry GIT microbiome is analyzed.

ELA191024, ELA191036, and ELA191105 are administered individually and in combination to poultry and mortality rate is measured.

ELA191024, ELA191036, and ELA191105 are administered individually and in combination to poultry and the number of pathogen-associated lesion is measured.

ELA191024, ELA191036, and ELA191105 are administered individually and in combination to poultry and pathogens load (C. *Perfringens*, APEC and *Salmonella*) in poultry GIT is measured.

ELA 191024, ELA191036, and ELA191105 are administered individually and in combination to poultry and expression of tight junction proteins is measured.

ELA191024, ELA1191036, and ELA1191105 are administered individually and in combination to poultry and pro-inflammatory/anti-inflamatory cytokines level is measured.

ELA191024, ELA191036, and ELA191105 are administered individually and in combination to poultry and gut permeability is measured.

ELA191024, ELA191036, and ELA191105 are administered individually and in combination to swine and gut permeability is measured.

The 16S rRNA sequences of each of the ELA191024, ELA191036, and ELA191105 bacteria strains are provided below:

```
Full 16S-rRNA sequences
>Bacillus amyloliquefaciens ELA191024
(BAMY_00429)
                                          (SEQ ID NO: 17)
TCGGAGAGTTTGATCCTGGCTCAGGACGAACGCTGGCGGCGTGCCTAAT
ACATGCAAGTCGAGCGGACAGATGGGAGCTTGCTCCCTGATGTTAGCGG
CGGACGGGTGAGTAACACGTGGGTAACCTGCCTGTAAGACTGGGATAAC
TCCGGGAAACCGGGGCTAATACCGGATGGTTGTCTGAACCGCATGGTTC
AGACATAAAAGGTGGCTTCGGCTACCACTTACAGATGGACCCGCGGCGC
ATTAGCTAGTTGGTGAGGTAACGGCTCACCAAGGCGACGATGCGTAGCC
GACCTGAGAGGGTGATCGGCCACACTGGGACTGAGACACGGCCCAGACT
CCTACGGGAGGCAGCAGTAGGGAATCTTCCGCAATGGACGAAAGTCTGA
CGGAGCAACGCCGCGTGAGTGATGAAGGTTTTCGGATCGTAAAGCTCTG
TTGTTAGGGAAGAACAAGTGCCGTTCAAATAGGGCGGCACCTTGACGGT
ACCTAACCAGAAAGCCACGGCTAACTACGTGCCAGCAGCCGCGGTAATA
CGTAGGTGGCAAGCGTTGTCCGGAATTATTGGGCGTAAAGGGCTCGCAG
GCGGTTTCTTAAGTCTGATGTGAAAGCCCCCGGCTCAACCGGGGAGGGT
CATTGGAAACTGGGGAACTTGAGTGCAGAAGAGGAGAGTGGAATTCCAC
GTGTAGCGGTGAAATGCGTAGAGATGTGGAGGAACACCAGTGGCGAAGG
CGACTCTCTGGTCTGTAACTGACGCTGAGGAGCGAAAGCGTGGGGAGCG
AACAGGATTAGATACCCTGGTAGTCCACGCCGTAAACGATGAGTGCTAA
GTGTTAGGGGGTTTCCGCCCCTTAGTGCTGCAGCTAACGCATTAAGCAC
TCCGCCTGGGGAGTACGGTCGCAAGACTGAAACTCAAAGGAATTGACGG
GGGCCCGCACAAGCGGTGGAGCATGTGGTTTAATTCGAAGCAACGCGAA
GAACCTTACCAGGTCTTGACATCCTCTGACAATCCTAGAGATAGGACGT
CCCCTTCGGGGGCAGAGTGACAGGTGGTGCATGGTTGTCGTCAGCTCGT
GTCGTGAGATGTTGGGTTAAGTCCCGCAACGAGCGCAACCCTTGATCTT
AGTTGCCAGCATTCAGTTGGGCACTCTAAGGTGACTGCCGGTGACAAAC
CGGAGGAAGGTGGGGATGACGTCAAATCATCATGCCCCTTATGACCTGG
GCTACACACGTGCTACAATGGACAGAACAAAGGGCAGCGAAACCGCGAG
GTTAAGCCAATCCCACAAATCTGTTCTCAGTTCGGATCGCAGTCTGCAA
CTCGACTGCGTGAAGCTGGAATCGCTAGTAATCGCGGATCAGCATGCCG
CGGTGAATACGTTCCCGGGCCTTGTACACACCGCCCGTCACACCACGAG
AGTTTGTAACACCCGAAGTCGGTGAGGTAACCTTTATGGAGCCAGCCGC
CGAAGGTGGGACAGATGATTGGGGTGAAGTCGTAACAAGGTAGCCGTAT
CGGAAGGTGCGGCTGGATCACCTCCTTT
```

-continued

```
>Bacillus amyloliquefaciens ELA191036(BAMY_00854)
                                          (SEQ ID NO: 18)
tcggagagtttgatcctggctcaggacgaacgctggcggcgtgcctaat
acatgcaagtcgagcggacagatgggagcttgctccctgatgttagcgg
cggacgggtgagtaacacgtgggtaacctgcctgtaagactgggataac
tccgggaaaccggggctaataccggatggttgtctgaaccgcatggttc
agacataaaaggtggcttcggctaccacttacagatggacccgcggcgc
attagctagttggtgaggtaacggctcaccaaggcgacgatgcgtagcc
gacctgagagggtgatcggccacactgggactgagacacggcccagact
cctacgggaggcagcagtagggaatcttccgcaatggacgaaagtctga
cggagcaacgccgcgtgagtgatgaaggttttcggatcgtaaagctctg
ttgttagggaagaacaagtgccgttcaaatagggcggcaccttgacggt
acctaaccagaaagccacggctaactacgtgccagcagccgcggtaata
cgtaggtggcaagcgttgtccggaattattgggcgtaaagggctcgcag
gcggtttcttaagtctgatgtgaaagcccccggctcaaccggggagggt
cattggaaactggggaacttgagtgcagaagaggagagtggaattccac
gtgtagcggtgaaatgcgtagagatgtggaggaacaccagtggcgaagg
cgactctctggtctgtaactgacgctgaggagcgaaagcgtggggagcg
aacaggattagataccctggtagtccacgccgtaaacgatgagtgctaa
gtgttagggggtttccgccccttagtgctgcagctaacgcattaagcac
tccgcctggggagtacggtcgcaagactgaaactcaaaggaattgacgg
gggcccgcacaagcggtggagcatgtggtttaattcgaagcaacgcgaa
gaaccttaccaggtcttgacatcctctgacaatcctagagataggacgt
ccccttcgggggcagagtgacaggtggtgcatggttgtcgtcagctcgt
gtcgtgagatgttgggttaagtcccgcaacgagcgcaacccttgatctt
agttgccagcattcagttgggcactctaaggtgactgccggtgacaaac
cggaggaaggtggggatgacgtcaaatcatcatgccccttatgacctgg
gctacacacgtgctacaatggacagaacaaagggcagcgaaaccgcgag
gttaagccaatcccacaaatctgttctcagttcggatcgcagtctgcaa
ctcgactgcgtgaagctggaatcgctagtaatcgcggatcagcatgccg
cggtgaatacgttcccgggccttgtacacaccgcccgtcacaccacgag
agtttgtaacacccgaagtcggtgaggtaacctttatggagccagccgc
cgaaggtgggacagatgattggggtgaagtcgtaacaaggtagccgtat
cggaaggtgcggctggatcacctccttt

>Bacillus subtilis ELA191105 (BSUB_00009)
                                          (SEQ ID NO: 19)
tcggagagtttgatcctggctcaggacgaacgctggcggcgtgcctaat
acatgcaagtcgagcggacagatgggagcttgctccctgatgttagcgg
cggacgggtgagtaacacgtgggtaacctgcctgtaagactgggataac
tccgggaaaccggggctaataccggatggttgtttgaaccgcatggttc
aaacataaaaggtggcttcggctaccacttacagatggacccgcggcgc
attagctagttggtgaggtaacggctcaccaaggcaacgatgcgtagcc
```

-continued

```
gacctgagagggtgatcggccacactgggactgaggcacggcccagact
cctacgggaggcagcagtagggaatcttccgcaatggacgaaagtctga
cggagcaacgccgcgtgagtgatgaaggttttcggatcgtaaagctctg
ttgttagggaagaacaagtaccgttcgaatagggcggtaccttgacggt
acctaaccagaaagccacggctaactacgtgccagcagccgcggtaata
cgtaggtggcaagcgttgtccggaattattgggcgtaaagggctcgcag
gcggtttcttaagtctgatgtgaaagcccccggctcaaccggggagggt
cattggaaactggggaacttgagtgcagaagaggagagtggaattccac
gtgtagcggtgaaatgcgtagagatgtggaggaacaccagtggcgaagg
cgactctctggtctgtaactgacgctgaggagcgaaagcgtggggagcg
aacaggattagataccctggtagtccacgccgtaaacgatgagtgctaa
gtgttaggggtttccgccccttagtgctgcagctaacgcattaagcac
tccgcctggggagtacggtcgcaagactgaaactcaaaggaattgacgg
gggcccgcacaagcggtggagcatgtggtttaattcgaagcaacgcgaa
gaaccttaccaggtcttgacatcctctgacaatcctagagataggacgt
ccccttcgggggcagagtgacaggtggtgcatggttgtcgtcagctcgt
```

-continued

```
gtcgtgagatgttgggttaagtcccgcaacgagcgcaacccttgatctt
agttgccagcattcagttgggcactctaaggtgactgccggtgacaaac
cggaggaaggtggggatgacgtcaaatcatcatgccccttatgacctgg
gctacacacgtgctacaatggacagaacaaagggcagcgaaaccgcgag
gttaagccaatcccacaaatctgttctcagttcggatcgcagtctgcaa
ctcgactgcgtgaagctggaatcgctagtaatcgcggatcagcatgccg
cggtgaatacgttcccgggccttgtacacaccgcccgtcacaccacgag
agtttgtaacacccgaagtcggtgaggtaacctttttaggagccagccgc
cgaaggtgggacagatgattggggtgaagtcgtaacaaggtagccgtat
cggaaggtgcggctggatcacctccttt
```

Example 12. Metabolite Analysis

Tables 14 and 15; show the raw data summarized in Tables 7-13. The amount of metabolite is compared against the media control. A value greater than one indicates the metabolite is secreted. A value less than one indicates the metabolite is consumed. A value equal to one indicates that the metabolite is not consumed or secreted.

TABLE 14

| | Minimal media | | | | |
|---|---|---|---|---|---|
| metabolite | 24 | 36 | 105 | 24-36 | 24-36-105 |
| betaine | 42.85 | 17.85 | 99.69 | 5.77 | 19.38 |
| N-carbamoylserine | 1.00 | 1.00 | 1.00 | 1.00 | 2.61 |
| 2-methylserine | 11.03 | 18.19 | 11.95 | 8.55 | 17.26 |
| N-acetylaspartate (NAA) | 1.20 | 9.09 | 2.95 | 8.78 | 2.38 |
| N-acetylasparagine | 4.09 | 10.16 | 6.73 | 7.26 | 10.89 |
| glutamine | 2.55 | 1.00 | 1.59 | 1.22 | 1.00 |
| N-acetylglutamate | 1.00 | 3.56 | 1.35 | 2.19 | 2.99 |
| N-acetylglutamine | 1.80 | 13.40 | 3.15 | 8.39 | 10.33 |
| beta-citrylglutamate | 1.00 | 1.70 | 1.61 | 1.64 | 2.61 |
| carboxyethyl-GABA | 1.00 | 1.02 | 2.27 | 1.09 | 2.39 |
| 2-pyrrolidinone | 1.29 | 8.95 | 2.99 | 1.53 | 8.81 |
| S-1-pyrroline-5-carboxylate | 2.30 | 12.67 | 6.39 | 1.42 | 15.03 |
| histidine | 0.99 | 1.14 | 1.34 | 1.72 | 1.63 |
| 3-methylhistidine | 1.00 | 1.54 | 3.74 | 1.05 | 4.79 |
| N-acetylhistidine | 11.78 | 23.04 | 17.91 | 58.18 | 27.34 |
| trans-urocanate | 12.34 | 728.77 | 35.53 | 301.42 | 461.12 |
| cis-urocanate | 2.46 | 66.07 | 3.76 | 27.58 | 35.48 |
| formiminoglutamate | 0.86 | 60.31 | 2.32 | 20.43 | 31.96 |
| 4-imidazoleacetate | 1.91 | 5.20 | 3.17 | 3.43 | 4.71 |
| N6-acetyllysine | 19.48 | 31.23 | 18.68 | 23.89 | 28.79 |
| N6-methyllysine | 1.00 | 1.32 | 1.00 | 1.19 | 2.20 |
| N6,N6-dimethyllysine | 1.00 | 1.00 | 1.00 | 1.00 | 2.03 |
| N6,N6,N6-trimethyllysine | 1.00 | 2.42 | 1.94 | 1.34 | 3.66 |
| saccharopine | 1.00 | 1.82 | 3.03 | 1.00 | 4.85 |
| pipecolate | 6.27 | 8.50 | 13.13 | 9.16 | 17.89 |
| cadaverine | 1.00 | 1.00 | 1.00 | 1.00 | 1.50 |
| N,N-dimethyl-5-aminovalerate | 1.53 | 1.00 | 5.77 | 1.34 | 3.66 |
| N-acetylphenylalanine | 8.40 | 42.61 | 15.96 | 56.59 | 39.63 |
| N-succinyl-phenylalanine | 1.14 | 2.95 | 2.54 | 1.00 | 5.37 |
| N-butyryl-phenylalanine | 1.03 | 1.02 | 2.13 | 1.00 | 2.53 |
| phenylpyruvate | 2.88 | 10.20 | 3.69 | 4.64 | 8.40 |
| phenyllactate (PLA) | 25.19 | 24.96 | 35.43 | 88.77 | 49.75 |
| phenethylamine | 1.00 | 2.03 | 1.35 | 1.72 | 2.15 |
| 2-hydroxyphenylacetate | 1.23 | 1.00 | 1.43 | 1.00 | 2.24 |
| N-acetyltyrosine | 3.58 | 19.24 | 6.83 | 22.72 | 21.10 |
| 1-carboxyethyltyrosine | 4.06 | 2.68 | 4.05 | 6.47 | 3.34 |
| tyramine | 1.00 | 1.68 | 1.00 | 1.00 | 1.38 |
| 4-hydroxyphenylpyruvate | 1.89 | 14.25 | 4.45 | 2.74 | 19.60 |
| 3-(4-hydroxyphenyl)lactate (HPLA) | 7.77 | 11.47 | 12.35 | 34.89 | 20.96 |

TABLE 14-continued

| | Minimal media | | | | |
|---|---|---|---|---|---|
| metabolite | 24 | 36 | 105 | 24-36 | 24-36-105 |
| 3-methoxytyramine | 1.63 | 5.66 | 2.33 | 1.08 | 4.51 |
| 5-hydroxymethyl-2-furoic acid | 1.00 | 2.46 | 1.00 | 2.59 | 1.77 |
| tryptophan | 13.07 | 4.41 | 33.67 | 36.52 | 44.33 |
| N-acetyltryptophan | 1.11 | 1.45 | 1.00 | 3.02 | 2.18 |
| anthranilate | 2.59 | 1.00 | 1.00 | 12.73 | 1.00 |
| indolelactate | 1.00 | 1.44 | 1.55 | 2.82 | 3.72 |
| N-acetylleucine | 9.75 | 28.19 | 16.75 | 25.72 | 53.85 |
| N-butyryl-leucine | 1.00 | 1.24 | 2.21 | 1.26 | 2.75 |
| 4-methyl-2-oxopentanoate | 0.78 | 1.43 | 1.36 | 1.21 | 2.49 |
| isovalerate (C5) | 1.00 | 10.27 | 2.28 | 3.97 | 8.31 |
| isovalerylglycine | 2.04 | 1.71 | 2.52 | 4.00 | 3.18 |
| N-acetylisoleucine | 2.28 | 28.43 | 5.53 | 49.36 | 21.51 |
| 3-methyl-2-oxovalerate | 1.09 | 2.92 | 1.61 | 2.05 | 3.17 |
| 2-hydroxy-3-methylvalerate | 1.41 | 6.18 | 3.69 | 1.37 | 4.76 |
| methylsuccinate | 1.42 | 3.09 | 1.50 | 1.75 | 2.21 |
| N-acetylvaline | 11.76 | 149.64 | 29.69 | 82.24 | 120.94 |
| 3-methyl-2-oxobutyrate | 2.43 | 18.07 | 6.91 | 7.08 | 18.81 |
| N-acetylmethionine | 4.16 | 10.93 | 6.14 | 17.10 | 13.13 |
| methionine sulfone | 5.03 | 3.32 | 2.41 | 1.00 | 3.34 |
| N-acetylmethionine sulfoxide | 74.64 | 277.47 | 129.93 | 195.98 | 310.98 |
| S-adenosylmethionine (SAM) | 1.00 | 4.40 | 1.05 | 2.13 | 3.91 |
| 2-hydroxy-4-(methylthio)butanoic acid | 1.23 | 1.62 | 3.84 | 2.39 | 2.05 |
| homocystine | 25.59 | 212.46 | 47.12 | 5.63 | 153.33 |
| S-methylcysteine | 1.00 | 1.00 | 2.59 | 1.00 | 1.00 |
| urea | 1.05 | 1.90 | 1.84 | 3.40 | 2.82 |
| ornithine | 19.18 | 17.31 | 36.60 | 46.68 | 43.64 |
| homocitrulline | 1.00 | 1.00 | 1.00 | 1.00 | 2.58 |
| dimethylarginine (ADMA + SDMA) | 1.00 | 1.76 | 2.01 | 1.45 | 4.02 |
| N-acetylarginine | 64.36 | 190.44 | 99.50 | 112.58 | 179.73 |
| N-acetylcitrulline | 5.73 | 45.01 | 8.72 | 7.47 | 32.73 |
| N-acetylproline | 2.92 | 14.14 | 5.25 | 5.58 | 13.41 |
| N-alpha-acetylornithine | 3.05 | 8.14 | 4.07 | 6.65 | 5.69 |
| hydroxyproline | 1.49 | 3.51 | 1.98 | 2.32 | 4.70 |
| N-methylproline | 1.00 | 1.00 | 2.68 | 1.00 | 1.00 |
| N,N,N-trimethyl-alanylproline betaine (TMAP) | 1.00 | 1.47 | 3.60 | 1.14 | 4.39 |
| N-monomethylarginine | 1.00 | 1.00 | 2.40 | 1.27 | 4.60 |
| guanidinoacetate | 1.77 | 1.00 | 3.04 | 1.70 | 5.80 |
| acetylagmatine | 1.00 | 2.48 | 1.00 | 1.83 | 2.79 |
| putrescine | 1.34 | 1.00 | 2.42 | 1.00 | 2.57 |
| spermidine | 59.18 | 327.34 | 140.39 | 655.03 | 198.97 |
| (N(1) + N(8))-acetylspermidine | 1.00 | 3.89 | 1.77 | 1.74 | 3.70 |
| spermine | 1.00 | 4.06 | 1.00 | 12.80 | 1.97 |
| N(1)-acetylspermine | 1.00 | 1.00 | 1.00 | 1.00 | 2.60 |
| 5-methylthioadenosine (MTA) | 6.82 | 32.89 | 9.65 | 19.21 | 26.07 |
| 4-acetamidobutanoate | 1.00 | 196.74 | 38.06 | 1.70 | 180.74 |
| cysteinylglycine | 1.45 | 1.31 | 10.49 | 4.22 | 11.64 |
| 2-hydroxybutyrate/2-hydroxyisobutyrate | 34.22 | 7.31 | 22.58 | 40.52 | 10.09 |
| gamma-glutamylphenylalanine | 3.21 | 0.25 | 0.89 | 0.25 | 0.25 |
| gamma-glutamyltyrosine | 4.57 | 1.00 | 1.11 | 1.00 | 1.00 |
| cyclo(gly-phe) | 1.00 | 1.37 | 2.35 | 1.25 | 3.38 |
| tryptophylglycine | 1.33 | 1.00 | 2.46 | 1.34 | 1.00 |
| glucose 6-phosphate | 1.00 | 1.00 | 1.00 | 1.00 | 3.66 |
| Isobar: hexose diphosphates | 1.87 | 3.69 | 3.90 | 5.18 | 7.73 |
| 3-phosphoglycerate | 2.14 | 7.08 | 3.25 | 3.14 | 8.82 |
| phosphoenolpyruvate (PEP) | 1.00 | 7.68 | 1.00 | 1.00 | 3.34 |
| pyruvate | 1.16 | 0.93 | 4.47 | 4.26 | 6.08 |
| sedoheptulose-7-phosphate | 1.00 | 1.65 | 1.00 | 1.00 | 2.26 |
| ribitol | 1.00 | 1.38 | 1.45 | 1.44 | 2.58 |
| arabonate/xylonate | 2.52 | 3.31 | 4.06 | 2.77 | 7.08 |
| sedoheptulose | 1.72 | 3.15 | 1.59 | 1.31 | 2.50 |
| ribulonate/xylulonate/lyxonate | 1.00 | 1.29 | 1.79 | 1.07 | 2.82 |
| sucrose | 1.00 | 2.00 | 1.00 | 8.05 | 1.00 |
| fructose | 0.80 | 0.80 | 0.80 | 0.80 | 1.71 |
| mannose | 1.00 | 1.22 | 2.09 | 1.24 | 2.95 |

TABLE 14-continued

| | Minimal media | | | | |
|---|---|---|---|---|---|
| metabolite | 24 | 36 | 105 | 24-36 | 24-36-105 |
| galactonate | 1.00 | 1.77 | 1.60 | 1.00 | 4.00 |
| glucuronate | 1.14 | 2.69 | 1.00 | 2.76 | 3.66 |
| N-acetyl-glucosamine 1-phosphate | 1.06 | 3.83 | 1.00 | 1.00 | 4.24 |
| N-acetylmuramate | 3.85 | 67.72 | 143.77 | 34.24 | 22.11 |
| N-acetylglucosamine/N-acetylgalactosamine | 1.39 | 47.92 | 17.62 | 3.78 | 24.02 |
| isocitric lactone | 1.01 | 1.22 | 1.79 | 1.00 | 3.18 |
| fumarate | 1.49 | 0.22 | 1.84 | 2.56 | 8.59 |
| malate | 1.61 | 1.00 | 1.69 | 1.69 | 6.42 |
| citraconate/glutaconate | 2.82 | 15.55 | 3.00 | 3.04 | 5.65 |
| butyrate/isobutyrate (4:0) | 1.00 | 3.82 | 1.13 | 1.00 | 2.20 |
| 2-hydroxyglutarate | 21.36 | 48.58 | 29.25 | 36.99 | 56.55 |
| azelate (C9-DC) | 2.05 | 1.28 | 1.00 | 1.00 | 1.00 |
| eicosenamide (20:1) | 2.51 | 1.53 | 87.84 | 1.44 | 1.56 |
| 5-dodecenoylcarnitine (C12:1) | 5.42 | 194.14 | 70.49 | 1.00 | 84.24 |
| deoxycarnitine | 1.00 | 1.00 | 2.96 | 2.89 | 1.00 |
| 3-hydroxyhexanoate | 1.00 | 1.00 | 1.00 | 1.00 | 1.73 |
| 3-hydroxyoctanoate | 1.00 | 1.93 | 1.00 | 1.00 | 1.07 |
| 5-hydroxyhexanoate | 2.83 | 6.36 | 4.09 | 1.00 | 9.87 |
| 2S,3R-dihydroxybutyrate | 9.13 | 9.66 | 15.56 | 9.84 | 22.59 |
| 2R,3R-dihydroxybutyrate | 1.45 | 1.17 | 1.26 | 3.80 | 1.64 |
| myo-inositol | 1.00 | 1.00 | 1.45 | 1.00 | 3.83 |
| chiro-inositol | 1.49 | 1.00 | 4.65 | 3.52 | 14.57 |
| choline | 4.68 | 0.11 | 7.40 | 4.65 | 7.11 |
| glycerophosphorylcholine (GPC) | 20.00 | 1.00 | 54.14 | 70.57 | 14.57 |
| glycerophosphoethanolamine | 1.00 | 1.11 | 1.64 | 1.13 | 3.01 |
| glycerophosphoinositol | 1.86 | 1.31 | 1.25 | 1.97 | 3.50 |
| 1-palmitoyl-GPE (16:0) | 1.00 | 41.29 | 107.15 | 1.00 | 20.38 |
| 1-stearoyl-GPE (18:0) | 1.00 | 4.34 | 2.77 | 1.00 | 1.23 |
| glycerol 3-phosphate | 1.48 | 3.74 | 2.43 | 2.37 | 3.77 |
| 1-linoleoylglycerol (18:2) | 1.39 | 1.00 | 2.33 | 1.56 | 1.82 |
| 3-hydroxy-3-methylglutarate | 1.00 | 1.17 | 1.87 | 1.02 | 3.08 |
| mevalonate | 1.13 | 1.30 | 1.64 | 1.00 | 3.37 |
| 5-aminoimidazole-4-carboxamide | 1.91 | 1.00 | 1.00 | 10.87 | 5.07 |
| xanthine | 9.17 | 29.71 | 16.71 | 69.44 | 21.91 |
| xanthosine | 1.25 | 2.82 | 1.54 | 1.13 | 3.33 |
| AMP | 1.82 | 0.82 | 0.82 | 40.14 | 1.23 |
| 2'-AMP | 1.00 | 1.38 | 1.91 | 1.16 | 3.42 |
| adenosine-2',3'-cyclic monophosphate | 2.00 | 1.00 | 1.00 | 1.58 | 1.00 |
| adenosine | 8.91 | 3.51 | 3.99 | 4.25 | 1.00 |
| adenine | 646.35 | 162.23 | 253.40 | 178.48 | 74.38 |
| 1-methyladenine | 1.00 | 3.62 | 1.77 | 1.55 | 3.72 |
| N6-methyladenosine | 1.00 | 5.32 | 3.19 | 2.32 | 2.83 |
| 2'-O-methyladenosine | 1.98 | 4.28 | 5.64 | 1.38 | 10.39 |
| 2'-deoxyadenosine | 1.00 | 1.00 | 1.00 | 2.58 | 1.00 |
| N6-succinyladenosine | 1.00 | 3.20 | 2.32 | 1.00 | 5.94 |
| guanosine | 7.58 | 18.15 | 11.10 | 23.85 | 6.79 |
| 7-methylguanine | 1.00 | 5.42 | 2.45 | 2.12 | 5.24 |
| guanosine 2'-monophosphate (2'-GMP) | 1.00 | 1.71 | 1.88 | 1.49 | 2.84 |
| N-carbamoylaspartate | 1.13 | 1.72 | 1.00 | 1.91 | 1.79 |
| dihydroorotate | 30.78 | 38.31 | 55.53 | 71.39 | 66.37 |
| orotidine | 1.00 | 2.25 | 1.17 | 2.08 | 2.29 |
| UMP | 1.00 | 1.00 | 1.00 | 26.27 | 1.00 |
| uridine-2',3'-cyclic monophosphate | 7.79 | 3.00 | 5.03 | 3.50 | 1.00 |
| uridine | 2.30 | 2.81 | 1.83 | 4.67 | 1.29 |
| pseudouridine | 1.00 | 3.13 | 1.87 | 1.27 | 3.80 |
| 5,6-dihydrouridine | 2.12 | 7.38 | 4.08 | 2.50 | 8.00 |
| 2'-O-methyluridine | 1.00 | 3.80 | 2.73 | 1.13 | 6.46 |
| 3-ureidopropionate | 1.02 | 1.06 | 1.63 | 1.02 | 1.00 |
| uridine 2'-monophosphate (2'-UMP) | 1.00 | 2.21 | 1.94 | 1.40 | 4.65 |
| CMP | 1.33 | 1.12 | 1.00 | 79.57 | 1.00 |
| cytidine 2',3'-cyclic monophosphate | 5.49 | 1.00 | 2.52 | 1.76 | 1.00 |
| cytidine | 3.73 | 2.80 | 3.09 | 8.19 | 1.44 |
| 5-methylcytidine | 2.77 | 4.27 | 1.79 | 3.15 | 2.22 |
| 5-methylcytosine | 1.00 | 1.00 | 1.00 | 1.00 | 2.31 |
| thymine | 11.55 | 28.51 | 16.76 | 34.79 | 25.79 |

TABLE 14-continued

| Minimal media | | | | | |
|---|---|---|---|---|---|
| metabolite | 24 | 36 | 105 | 24-36 | 24-36-105 |
| (3'-5')-adenylyluridine | 1.00 | 1.00 | 1.00 | 8.30 | 1.00 |
| (3'-5')-cytidylyladenosine | 1.00 | 1.00 | 1.00 | 3.93 | 1.00 |
| (3'-5')-cytidylylcytidine | 1.00 | 1.00 | 1.00 | 2.78 | 1.00 |
| (3'-5')-cytidylyluridine | 1.00 | 1.00 | 1.00 | 4.91 | 1.00 |
| (3'-5')-guanylylcytidine | 1.00 | 1.00 | 1.00 | 1.52 | 1.00 |
| (3'-5')-guanylyluridine | 1.00 | 1.00 | 1.00 | 5.66 | 1.00 |
| (3'-5')-uridylylcytidine | 1.00 | 1.00 | 1.00 | 5.44 | 1.00 |
| (3'-5')-uridylyluridine | 1.03 | 1.00 | 2.00 | 4.37 | 2.07 |
| (3'-5')-uridylyladenosine | 2.24 | 1.00 | 1.00 | 7.72 | 1.00 |
| nicotinate | 8.05 | 159.99 | 68.03 | 1.00 | 101.07 |
| nicotinate ribonucleoside | 3.93 | 70.86 | 19.60 | 6.70 | 45.53 |
| nicotinamide ribonucleotide (NMN) | 13.26 | 1.05 | 3.60 | 12.81 | 1.00 |
| nicotinamide riboside | 189.84 | 146.20 | 287.57 | 90.87 | 159.37 |
| NAD+ | 1.00 | 1.00 | 1.00 | 10.42 | 1.00 |
| trigonelline (N'-methylnicotinate) | 95.10 | 107.30 | 198.70 | 111.80 | 240.20 |
| pantoate | 61.42 | 166.28 | 130.04 | 89.83 | 273.82 |
| pantothenate (Vitamin B5) | 3.20 | 12.55 | 8.12 | 8.78 | 20.68 |
| glucarate (saccharate) | 1.00 | 1.00 | 1.00 | 1.00 | 2.15 |
| oxalate (ethanedioate) | 1.00 | 1.00 | 2.70 | 2.70 | 1.00 |
| pterin | 2.22 | 10.34 | 3.81 | 8.22 | 8.51 |
| pyridoxine (Vitamin B6) | 1.00 | 1.11 | 2.14 | 1.34 | 3.11 |
| hippurate | 1.33 | 1.84 | 1.81 | 2.22 | 2.79 |
| benzoate | 1.00 | 1.58 | 1.00 | 1.81 | 1.00 |
| maltol | 1.00 | 3.40 | 5.70 | 5.31 | 3.90 |
| 3-dehydroshikimate | 3.20 | 9.64 | 4.19 | 1.00 | 6.54 |
| 1-kestose | 9.66 | 1.14 | 4.30 | 11.61 | 1.00 |
| 2-isopropylmalate | 1.51 | 94.90 | 3.03 | 4.16 | 4.45 |
| 4-hydroxybenzyl alcohol | 1.00 | 1.79 | 1.00 | 1.00 | 1.39 |
| histidine betaine (hercynine) | 1.62 | 1.00 | 2.83 | 2.06 | 4.13 |
| histidinol | 1.00 | 1.00 | 1.33 | 1.00 | 2.28 |
| homocitrate | 1.00 | 1.00 | 1.31 | 1.00 | 3.00 |
| pyrraline | 1.00 | 1.75 | 1.28 | 1.00 | 4.17 |
| 2-keto-3-deoxy-gluconate | 4.05 | 4.38 | 5.56 | 5.07 | 8.80 |
| 2,6-dihydroxybenzoic acid | 1.00 | 1.14 | 2.13 | 1.12 | 2.90 |
| 2,4-di-tert-butylphenol | 1.05 | 2.17 | 1.12 | 1.22 | 1.24 |
| pentose acid | 1.00 | 1.42 | 2.23 | 1.24 | 3.85 |

TABLE 15

| Rich media | | | | | |
|---|---|---|---|---|---|
| metabolite | 24 | 36 | 105 | 24-36 | 24-36-105 |
| N-acetylserine | 2.95 | 3.02 | 6.56 | 2.96 | 2.70 |
| N-acetylthreonine | 15.64 | 17.47 | 30.63 | 17.65 | 11.54 |
| N,N-dimethylalanine | 1.20 | 0.91 | 1.18 | 0.82 | 2.01 |
| N-acetylglutamine | 1.93 | 1.68 | 5.52 | 1.89 | 2.01 |
| 1-methylhistidine | 1.00 | 1.00 | 3.36 | 3.76 | 2.78 |
| N-acetylhistidine | 1.54 | 1.58 | 3.93 | 1.60 | 1.41 |
| trans-urocanate | 1.45 | 0.53 | 3.19 | 0.44 | 0.58 |
| N6-acetyllysine | 1.09 | 1.05 | 1.64 | 1.07 | 1.01 |
| N6,N6-dimethyllysine | 3.31 | 1.00 | 3.89 | 6.34 | 4.88 |
| N-acetyl-cadaverine | 1.00 | 1.00 | 3.77 | 1.00 | 1.00 |
| N-acetylphenylalanine | 1.18 | 1.15 | 2.40 | 1.18 | 1.11 |
| phenyllactate (PLA) | 8.01 | 5.51 | 19.43 | 6.37 | 5.26 |
| 3-(4-hydroxyphenyl)lactate (HPLA) | 5.38 | 4.72 | 19.61 | 5.24 | 4.18 |
| isovalerate (C5) | 0.73 | 0.69 | 2.36 | 0.69 | 0.58 |
| N-acetylisoleucine | 1.51 | 1.31 | 9.86 | 1.50 | 1.25 |
| N-acetylvaline | 1.23 | 1.23 | 3.22 | 1.29 | 1.16 |
| N-acetylmethionine | 1.16 | 1.06 | 2.32 | 1.15 | 1.11 |
| S-adenosylmethionine (SAM) | 4.09 | 4.50 | 7.19 | 4.45 | 2.82 |
| 2-hydroxy-4-(methylthio)butanoic acid | 2.35 | 1.76 | 4.03 | 1.80 | 1.93 |
| homocystine | 2.94 | 1.00 | 1.00 | 1.00 | 2.02 |
| S-methylcysteine | 1.98 | 2.12 | 6.05 | 3.51 | 4.55 |
| N-acetylarginine | 1.54 | 1.50 | 2.65 | 1.53 | 1.42 |
| N-acetylcitrulline | 10.98 | 1.00 | 1.00 | 1.00 | 4.95 |

TABLE 15-continued

| | Rich media | | | | |
|---|---|---|---|---|---|
| metabolite | 24 | 36 | 105 | 24-36 | 24-36-105 |
| acetylagmatine | 1.79 | 1.78 | 3.93 | 1.81 | 1.94 |
| glutathione, oxidized (GSSG) | 1.81 | 1.00 | 3.84 | 1.87 | 3.21 |
| 2-hydroxybutyrate/2-hydroxyisobutyrate | 4.22 | 4.16 | 9.14 | 4.14 | 4.88 |
| gamma-glutamylhistidine | 1.00 | 1.13 | 2.90 | 1.00 | 2.54 |
| Isobar: hexose diphosphates | 2.60 | 2.54 | 2.51 | 3.71 | 4.57 |
| glucuronate | 1.00 | 1.46 | 5.32 | 1.00 | 1.00 |
| aconitate [cis or trans] | 2.42 | 2.38 | 4.28 | 2.84 | 3.69 |
| alpha-ketoglutarate | 10.33 | 6.88 | 1.40 | 8.74 | 7.16 |
| succinate | 19.41 | 4.90 | 3.80 | 19.53 | 8.74 |
| 2-methylcitrate | 1.88 | 1.73 | 3.75 | 2.89 | 6.47 |
| 5-hydroxyhexanoate | 7.15 | 4.76 | 1.00 | 4.75 | 6.08 |
| 2R,3R-dihydroxybutyrate | 0.85 | 0.80 | 3.97 | 1.10 | 0.75 |
| inositol 1-phosphate (11P) | 1.74 | 1.00 | 1.00 | 1.76 | 1.00 |
| 1-linoleoylglycerol (18:2) | 1.00 | 2.21 | 1.00 | 1.00 | 1.00 |
| 5-aminoimidazole-4-carboxamide | 1.00 | 1.00 | 5.01 | 1.00 | 1.00 |
| N6-methyladenosine | 1.69 | 0.93 | 0.52 | 1.52 | 1.74 |
| 2'-O-methyladenosine | 2.66 | 1.47 | 1.02 | 1.66 | 1.87 |
| guanosine 3'- monophosphate (3'-GMP) | 1.05 | 1.77 | 0.32 | 1.53 | 1.91 |
| guanosine-2',3'-cyclic monophosphate | 1.06 | 2.71 | 0.53 | 2.18 | 2.28 |
| guanine | 9.41 | 4.41 | 0.13 | 6.07 | 6.55 |
| N-carbamoylaspartate | 10.91 | 11.48 | 27.29 | 11.88 | 8.79 |
| dihydroorotate | 21.71 | 20.59 | 36.40 | 17.46 | 19.45 |
| orotidine | 1.00 | 1.00 | 5.67 | 1.00 | 1.00 |
| 5,6-dihydrouridine | 2.42 | 1.00 | 1.57 | 2.01 | 1.63 |
| cytidine 2',3'-cyclic monophosphate | 1.16 | 1.84 | 1.09 | 1.86 | 2.37 |
| thymine | 2.50 | 2.07 | 12.25 | 2.21 | 1.89 |
| (3'-5')-adenylylguanosine | 1.00 | 1.00 | 5.89 | 1.00 | 10.37 |
| nicotinamide ribonucleotide (NMN) | 39.60 | 23.23 | 20.52 | 31.35 | 24.69 |
| nicotinamide riboside | 186.21 | 139.51 | 284.47 | 173.14 | 154.91 |
| NAD+ | 5.21 | 15.34 | 36.28 | 10.51 | 8.53 |
| pyridoxamine | 1.17 | 1.21 | 1.97 | 1.11 | 1.21 |
| pyridoxamine phosphate | 1.01 | 1.11 | 2.68 | 1.39 | 1.26 |
| 3-dehydroshikimate | 13.75 | 6.66 | 1.16 | 6.53 | 6.82 |
| 4-hydroxybenzyl alcohol | 1.79 | 0.56 | 1.13 | 1.05 | 0.56 |
| quinate | 3.37 | 2.00 | 0.99 | 2.10 | 2.19 |
| homocitrate | 2.10 | 2.20 | 3.32 | 2.34 | 4.00 |

Figure 5:
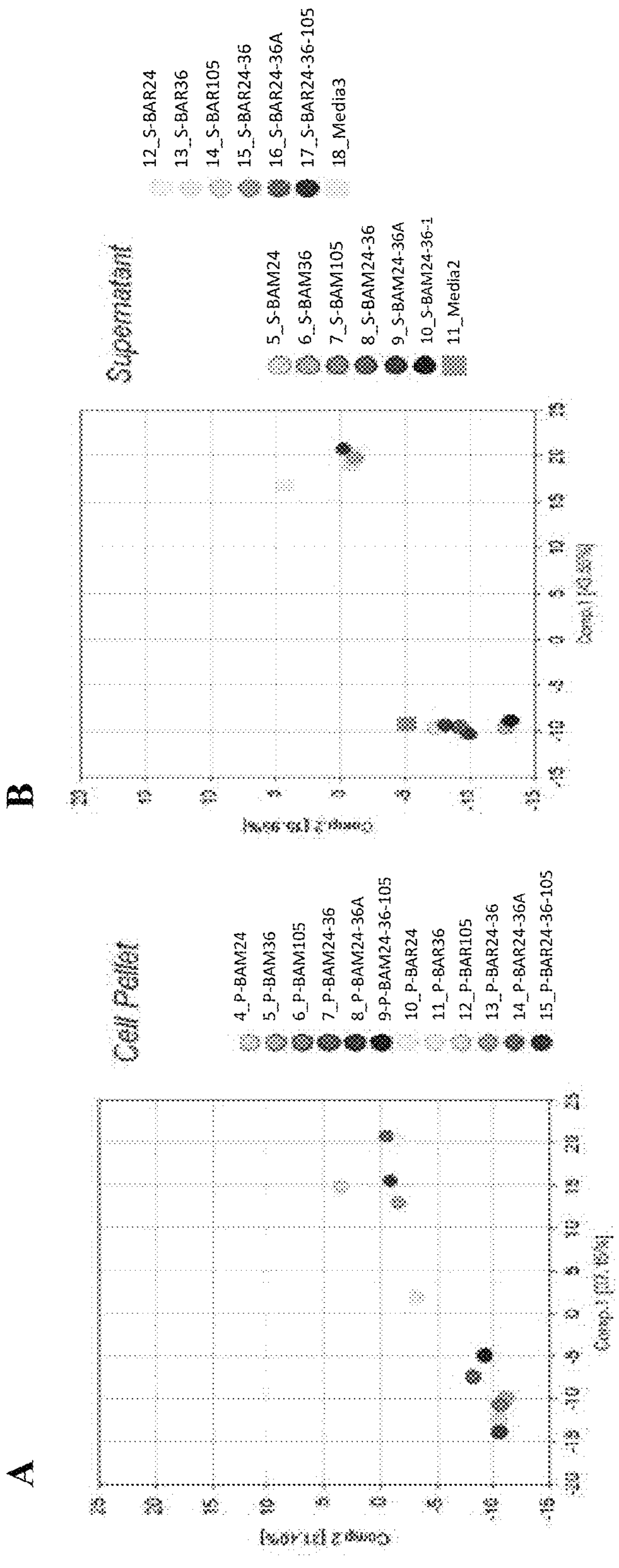
FIGS. 5A-5B depict metabolic data obtained by principal component analysis (PCA) of three strains of *Bacillus* that were cultured individually and together. A represents the cell pellet of the culture and B represents the supernatant of the culture. A key to the strains and cultures depicted in FIG. 5 is provided below in Table 1.

FIG. 5 depicts the metabolic data obtained by principal component analysis (PCA) the ELA 191024 (denoted 24), the ELA191036 (denoted 36) and the ELA191105 (denoted 105) cultured individually or together, including of the cell pellet of the culture and the supernatant of the culture. Additional metabolic analysis of the three strains is provided in FIG. 6, which indicates the number of unique metabolites in the different *Bacillus* samples in chart form.

Example 13. Assessment of *Bacillus* Probiotic Blends for Prevention of Necrotic Enteritis and Improved Growth Performance in Broiler Chickens Study Objectives—To evaluate probiotic candidates for their ability to prevent necrotic enteritis and to enhance growth performance with and without a necrotic enteritis challenge.

Methods

Treatments and Doses

The treatment groups and dosing for the different groups of animals in the study are depicted below in Table 16. Note that treatment groups T03 and T04 were given BMD (Bacitracin Methylene Disalicylate), a Type A medicated article (antibiotic mixture) used for the prevention of necrotic enteritis, to maintain increased weight gain and to improve feed efficiency in poultry.

TABLE 16

| GROUP | CHAL-LENGE | DIET | DOSE (/kg) | NO. OF PENS | ANI-MALS PER PEN | TOTAL ANI-MALS |
|---|---|---|---|---|---|---|
| T00 | none | Basal | | 1* | 2,720 | 2,720 |
| T01 | none | Basal | | 10 | 21 | 210 |
| T02 | NE | Basal | | 10 | 21 | 210 |
| T03 | none | BMD | 55 mg | 10 | 21 | 210 |
| T04 | NE | BMD | 55 mg | 10 | 21 | 210 |
| T05 | none | Combo1 | 1.5 × 108 CFU | 10 | 21 | 210 |
| T06 | NE | Combo1 | 1.5 × 108 CFU | 10 | 21 | 210 |
| T07 | none | Combo2 | 1.5 × 108 CFU | 10 | 21 | 210 |
| T08 | NE | Combo2 | 1.5 × 108 CFU | 10 | 21 | 210 |
| T09 | none | Combo3 | 1.5 × 108 CFU | 10 | 21 | 210 |
| T010 | NE | Combo3 | 1.5 × 108 CFU | 10 | 21 | 210 |
| T011 | none | Combo4 | 1.5 × 108 CFU | 10 | 21 | 210 |
| T012 | NE | Combo4 | 1.5 × 108 CFU | 10 | 21 | 210 |
| Total | | | | 121 | | 5,240 |

*At each weighing time, ten (10) groups of twenty-one (21) randomly selected birds will be weighed to obtain growth performance information for T00.

Strain Combinations

Strains *B. subtilis* BSUB19105 (ELA191105), *B. subtilis* BSUB20082, *B. amyloliquefaciens* BAMY20071, *B. amyloliquefaciens* BAMY20082, *B. amyloliquefaciens* BAMY19006 (ELA191006), *B. amyloliquefaciens* BAMY19024 (ELA191024), *B. amyloliquefaciens* BAMY19036 (ELA191036) were utilized and administered in various combinations. The particular combinations of *Bacillus* strains administered in each of Combo1-Combo4 are noted below in Table 17.

TABLE 17

| COMBINATION | STRAINS |
|---|---|
| Combo1 | BSUB19105 + BAMY20071 + BSUB20082 |
| Combo2 | BSUB19105 + BAMY20071 + BAMY19006 |
| Combo3 | BSUB19105 + BAMY20071 + BAMY19024 |
| Combo4 | BSUB19105 + BAMY19024 + BAMY19036 |

Experimental Design

Randomized block design with 12 treatments groups in a 2 (challenges)×6 (diets) factorial arrangement plus an additional control group (T00).

Experimental Unit—The experimental unit is the pen.

Study Phases—A description of the study phases are as follows as provided in Table 18:

TABLE 18

| Study Phase | Study Days | Diet | Form | Treatments | Animal Weights | Feed Weighback |
|---|---|---|---|---|---|---|
| 1 | 0-14 | Starter | Mash | All | Pen | Pen |
| 2 | 14-28 | Grower | Mash | All | Pen | Pen |
| 3 | 28-42 | Finisher | Mash | All | Pen | Pen |

Randomization Procedure—Assignment of treatments to pens is conducted using a computer program for random number generation or equivalent procedure.

Animals

Source—Commercial Hatchery.

Species—Domestic meat-type broiler chickens, *Gallus gallus domesticus.*

Physiological State—Healthy at trial initiation.

Vaccination

Birds in treatments T01, T03, T05, T07, T09, T11 are given 1× dose of Coccivac B-52 within one day of arrival. Birds in the NE challenged groups (T02, T04, T06, T08, T10, T12) remain unvaccinated.

Age—Day of hatch

Gender—Males

Breed—Ross 708

Weight—approximately 35 to 45 g at enrollment.

Identification—Each pen defines an Experimental Unit and is identified by a unique pen number for each pen within that room or facility. No individual animal identification needed.

Animal-Selection—Animal is clinically assessed to be in good health by the Study Investigator or designated personnel.

Exclusion Criteria

Examples include pre-existing and existing conditions or disease (e.g. enteric disease, lameness, neurological disease, septicemia), unthrifty appearance, abnormal conformation, or history of numerous repeated antimicrobial treatments for disease or injury.

Animal Disposal—Animals are disposed according to site procedures, and observing applicable institutional, local, state, and country guidance and/or regulations. All animals that die or are euthanized during the study are composted at the study facility. All animals completing the study are composted at the study facility and will not enter the food chain.

Daily Observations—Animals are observed at least once each day during the length of the study. When animals are expected to experience distress from necrotic enteritis (days 17-21), animals should be observed twice daily. All abnormalities and mortalities are recorded. Body weight of mortalities and culls are recorded. If all animals within the pen are observed as normal, no specific documentation for that pen is recorded. No animal is culled solely due to apparent slow growth. Animals that show signs of necrotic enteritis and cannot eat or drink or are considered to be uncomfortable are removed from the study and euthanized.

A poultry system/clinical sign key is provided below in Table 19.

TABLE 19

| Poultry System |
|---|
| GEN = General |
| EYE = Eyes |
| GI = Gastrointestinal |
| RNU = Renal and Urinary |
| INTG = Integument (Skin and Feathers) |
| MS = Musculoskeletal and Feet |
| NAR = Nares |
| NEU = Neurological |
| RESP = Respiratory |
| CDV = Cardiovascular |
| OTHER = Other |
| **Clinical Sign Key** |
| GEN |
| CAN = Cannibalism |
| DEAD = Dead |
| HEAT = Heat Stress |
| MISS = Mis-sexed |
| OMP = Omphalitis |
| STVN = Starvation |
| RYS = Retained Yolk Sac |
| MOR = Morbid or Moribund State |
| PND = Pain and Distress |
| EYE |
| ABS = Abscess |
| BLI = Blindness |
| CAT = Corneal Opacity (Cataract) |
| CONJ = Conjunctivitis |
| IFL = Inflammation |
| DCH = Discharge |
| RED = Redness |
| GI |
| ABS = Abscess |
| ANO = Anorexia |
| DCH = Discharge |
| DIA = Diarrhea |
| PSTV = Pasty Vent |
| HER = Hernia |
| PCRP = Pendulus Crop |
| PRO = Prolapse |
| RED = Redness |
| SWE = Swelling |
| CDV |
| BLE = Bleeding |
| EDE = Edema |
| OTHER = Other can be used for any unlisted systems or clinical signs |

TABLE 19-continued

| MS |
|---|
| FLEG = Fractured Leg Bone |
| FWNG = Fractured Wing Bone |
| FWT = Fractured Wing Tip |
| CLT = Curled Toes |
| DIS = Dislocation |
| IFL = Inflammation |
| LAC = Laceration |
| LAM = Lameness |
| NOA = Non-Ambulatory |
| PAS = Paresis |
| SPLY = Splay Legs/Spraddle Legs |
| SPLT = Slipped Tendon |
| **NAR** |
| DCH = Discharge |
| SS = Swollen Sinus |
| **NEU** |
| DEP = Depression |
| TOR = Torticollis (twisted neck) |
| TRE = Tremors |
| SPA = Spasms |
| CONV = Convulsions |
| HES = Hyperesthesia |
| PAR = Paralysis |
| **RESP** |
| SNI = Snicking/ Sneezing |
| LB = Labored Breathing |
| PAN = Panting |
| **INTG** |
| ABS = Abscess |
| FEA = Feather Loss |
| DER = Dermatitis |
| DPIG = Depigmentation |
| HPIG = Hyperpigmentation |
| LAC = Laceration |
| LES = Lesion |
| SWE = Swelling |

A poultry necroscopy key is provided in Table 20,

TABLE 20

| Poultry Necropsy Key |
|---|
| **System** |
| GEN = General |
| CDV = Cardiovascular |
| EYE = Eyes |
| GI = Gastrointestinal |
| RNU = Renal and Urinary |
| INTG = Integument (Skin and Feathers) |
| MS = Musculoskeletal and Feet |
| RESP = Respiratory |
| SYS = Systemic |
| OTHER = Other |
| **Diagnosis[1]** |
| **GEN** |
| ASPH = Asphyxiation |
| CAN = Cannibalism |
| DEHY = Dehydration |
| HEAT = Heat Stress |
| NOGL = No Gross Lesions |
| OMP = Omphalitis |
| RYS = Retained Yolk Sac |
| STVN = Starvation |
| **CDV** |
| ARUP = Aortic Rupture |
| ATHR = Atherosclerosis |

TABLE 20-continued

| |
|---|
| DCMP = Dilated (Spontaneous) Cardiomyopathy |
| ENDO = Endocarditis |
| PERI = Pericarditis |
| SDPH = Perirenal Hemorrhage Sudden Death |
| **EYE** |
| BLPH = Blepharoconjunctivitis |
| BUPH = Buphthalmos |
| CHOR = Chorioretinitis |
| KCNJ = Keratoconjunctivitis |
| **GI** |
| ASC = Ascites |
| CHLM = Chlamydiosis |
| HELM = Helminthiasis |
| HENT = Hemorrhagic Enteritis |
| HLIP = Hepatic Lipidosis |
| IMPN = Impaction |
| NENT = Necrotic Enteritis |
| PCRP = Pendulous Crop |
| PRO = Prolapse |
| PSTV = Pasty Vent |
| PROT = Protozoal Infection |
| THRU = Thrush |
| TENT = Transmissable Enteritis |
| **RNU** |
| NEPH = Nephritis |
| PRO = Prolapse |
| ULTH = Urolithiasis |
| VSGT = Visceral Gout |
| **INTG** |
| ABS = Abscess |
| BRBL = Breast Blister |
| DER = Dermatitis |
| ECTO = Ectoparasite Infestation |
| LAC = Laceration |
| **MS** |
| ARGT = Articular Gout |
| DISJ = Dislocated Joint |
| DPMY = Deep Pectoral Myopathy |
| DSCH = Dyschondroplasia |
| FLEG = Fractured Leg Bone |
| FWNG = Fractured Wing Bone |
| OCDS = Osteochondritis |
| OSTM = Osteomyelitis |
| SEPT = Septic Arthritis |
| SLPT = Slipped Tendon |
| SPDL = Spondylolisthesis |
| SPLY = Splay Legs/Spraddle Legs |
| TNSN = Tendonitis/Tenosynovitis |
| VLVR = Valgus/Varus Deformation |
| **RESP** |
| AIRS = Airsacculitis |
| ASPG = Aspergillosis |
| BRCH = Bronchitis |
| CHLM = Chlamydiosis |
| INFL = Influenza |
| PNM = Pneumonia |
| RHNO = Rhinotracheitis |
| SNTS = Sinusitis |
| **SYS** |
| CHLM = Chlamydiosis |
| COLI = Colibacillosis |
| ERYS = Erysipelas |
| FCHL = Fowl Cholera |
| PTNT = Peritonitis |
| SPTM = Septicemia |
| **OTHER** |
| OTHER = used for any unlisted system or diagnosis |

[1]Findings not confirmed by culture and/or isolation, but gross lesions consistent with a particular disease or condition.

The schedule of events for the study, including study activity for each of the various study days is provided below in Table 21.

TABLE 21

| Study Day | Study Activity |
|---|---|
| All Study | Conduct and record daily observations on all animals |
| Days 0-42 | Feed issue as needed |
| 0 | Randomization of animals to pens |
| | Bird Pen Weight |
| | Feed Issue - Starter diets |
| 1 | T01, T03, T05, T07, T09, T11 - Give 1x dose of Coccivac B-52 |
| 2-12 | |
| 13 | T02, T04, T06, T08, T10, T12 - Gavage with *E. maxima* (10,000 oocysts/birds) |
| 14 | Feed Weighbacks (Starter diets) |
| | Bird Pen Weight |
| | Feed Issue - Grower diets |
| 15-16 | |
| 17 | T02, T04, T06, T08, T10, T12 - Gavage with *C. perfringens* JP1011 |
| | (106 CFU/bird) |
| 18 | |
| 19 | T01, T02, T04, T06, T08, T10, T12 - Necropsy 3 birds per pen for lesion scoring. |
| | T03, T05, T07, T09, T11 - Remove and weigh 3 birds per pen. |
| | 11 Nov. 2020 |
| 20-27 | |
| 28 | Feed Weighbacks |
| | Bird Pen Weights |
| | Feed Issue - Finisher Treatment Diets |
| 29-42 | |
| 42 | Bird Pen Weights |
| | Feed Weighbacks (Finisher diets) |
| | End of Study |

Necrotic Enteritis Challenge

On day 13 treatment groups T02, T04, T06, T08, T10, T12 are inoculated via oral gavage with 10,000 oocysts/mL/bird of *Eimeria maxima*.

On day 17 treatment groups T02, T04, T06, T08, T10, T12 are inoculated via oral gavage with 1×106 CFU/mL/bird of *C. perfringens* (NAH 1314-JP1011).

The study site should provide adequate staffing to prevent employee fatigue that could negatively impact the welfare of the birds when gavaging a large number of animals.

Measurements

Performance

Pen body weights at days 0, 14, 28, 42.

Feed addition to each pen.

Pen unconsumed feed at the end of each feeding phase

Lesion Scoring

On day 19, three birds from each pen in treatment groups T01, T02, T04, T06, T08, T10, T12 are randomly selected (by first bird caught), sacrificed, weighed, and examined for the degree of presence of necrotic enteritis lesions. The scoring is based on a 0 to 4 score as follows as provided in Table 22:

TABLE 22

Lesion scoring for necrotic enteritis (NE)-typical lesions (according to Prescott and others 1978)

| Lesions score (NE) | Observed macroscopic finding |
|---|---|
| 0 | No gross lesions |
| 1 | Thin-walled or friable small intestine |
| 2 | Focal necrosis or ulceration |
| 3 | Larger patches of necrosis |
| 4 | Severe, extensive necrosis typical of field cases |

Source: A. A. Alnassan et al, *Necrotic enteritis in chickens: development of a straightforward disease model system;* 2014. Veterinary Record.

In order to maintain similar stocking density, three birds from the remaining treatment groups (T03, T05, T07, T09, T11) are removed and weighed. Gut tissues or contents may be collected from some or all treatments for non-study related activities. Study sponsor will provide sampling materials for tissue collection.

Mortality—Reason for mortality is documented. Mortality is separated as NE induced and others. Dead bird weight is documented Animal Management and Housing Facility Layout—A facility diagram is provided in FIG. 7.

Litter—Used litter is used for this study

Management and Environmental Conditions

- Comply with 2010 Guide for the Care and Use of Agricultural Animals ($3^{rd}$ edition, FASS, 2010) or similar guideline.
- Comply with any applicable institutional, local, state, and country regulations.
- According to the procedures of the facility.

Animal Feeds—Nutritional requirements were estimated by regressing nutrient recommendations of Aviagen (Huntsville, AL) for Ross 708 over time in order to match the feeding phases in this protocol.

Diet Formulation

For each feeding phase, diets were least-cost formulated using the Diet Formulation and Evaluation Software (version metric 4-16-13, JMJ 01232012). The feed is commercial type rations and formulated to meet Ross 708 Commercial Nutrient Guidelines (Ross 708, 2014) nutrient recommendations for broilers. Basal diets are transferred to Blue River Research facility for test article inclusion.

The diet formulation/feed ingredients for each of the Starter, Grower and Finisher phases is provided below in Table 23.

TABLE 23

| | Starter (d 0-14) | Grower (d 14-28) | Finisher (d 28-42) |
|---|---|---|---|
| Ingredients (%) | | | |
| Corn, yellow dent | 53.485 | 53.885 | 56.155 |
| Soybean meal, 47.0% CP | 36.48 | 33.00 | 28.46 |
| Soybean oil | 2.27 | 3.94 | 4.54 |
| Corn DDGS | 4.00 | 6.00 | 8.00 |
| L-lysine HCl | 0.20 | 0.12 | 0.12 |
| DL-methionine | 0.29 | 0.23 | 0.20 |
| L-threonine | 0.16 | 0.10 | 0.07 |
| Dicalcium phosphate 18.5% | 1.19 | 0.90 | 0.66 |
| Limestone | 1.27 | 1.18 | 1.15 |
| Salt | 0.33 | 0.32 | 0.32 |
| Promote phytase 2500 | 0.025 | 0.025 | 0.025 |
| Provimi 5 PMX | 0.30 | 0.30 | 0.30 |
| Calculated Analyses (%) | | | |
| ME (kcal/kg) | 3018 | 3134 | 3204 |
| CP | 22.1 | 20.9 | 19.4 |
| Dig Lys | 1.26 | 1.12 | 1.01 |
| Dig Met | 0.63 | 0.57 | 0.52 |
| Dig Thr | 0.86 | 0.76 | 0.68 |
| Ca | 0.95 | 0.85 | 0.78 |
| Av P | 0.48 | 0.43 | 0.39 |

Feed Manufacturing

All treatments using test article are administered in the feed. Study sponsor prepares test by spraying a spore concentrate onto a ground rice hull carrier followed by drying. This results in a free-flowing dry product that can be easily blended into the feed. The pre-blend consists of the phase basal diet and test article. The amount of test article for each mixture is calculated based on the treatment batch size. The pre-blend mixture is allowed to continue mixing for at least 5 minutes. As the pre-blend is mixing, it is ensured that no test article adheres to the sides or mixing arm of the floor mixer. After pre-blend mixture is manufactured, it is blended with the batch of basal diet to form the desired treatment diet. Final treatment diets are mixed for approximately 10 min. Diets are fed to birds in mash form.

Feed Labelling—The feed is stored in 22.67-kg capacity new feed sacks labeled with study number (ELAVV200198), feed ID (starter, grower, finisher), treatment ID, and treatment color code. Feed for treatment groups with the same diet (e.g. T03 & T04) can be made in the same batch.

Feed Samples

One sample of about 500 g from each diet and phase is collected, labeled, and stored frozen at BRRS. One additional sample from the T01 diets is sent to Minnesota Valley Testing Laboratory (MVTL) for proximate analysis of crude protein, fat, moisture, ash, Na, Ca, and P.

Statistical Analysis

Key Variables

Growth performance (average daily gain, average daily feed intake, gain efficiency, etc.) is calculated and evaluated for each study phase and overall. Removals and mortality are documented by treatment. General health records (e.g. diarrhea, respiratory problems, etc.) are documented by treatment and cause of illness.

The list of variables and calculations for each pen are provided below in Table 24.

TABLE 24

| List of Variables | Calculation for each pen |
|---|---|
| Average body weight in kilograms (Feeding Phase) | Pen weight of the Feeding Phase ÷ animal inventory at the end of the Feeding Phase |
| Average Daily Gain, ADG in grams (Feeding Phase) | (Average body weight at the end of the Feeding Phase − average body weight at the start of the Feeding Phase) ÷ number of days in the Feeding Phase) × 1,000 |
| Average Daily Feed Intake, ADFI in grams (Feeding Phase) | Total Feed Intake in the Feeding Phase ÷ Final animal inventory ÷ number of days in the Feeding Phase × 1,000 |
| Unadjusted Feed conversion ratio, FCR (Feeding Phase) | ADFI of the Feeding Phase ÷ ADG of the Feeding Phase |
| Unadjusted Gain Efficiency, GF (Feeding Phase) | ADG of the Feeding Phase ÷ ADFI of the Feeding Phase |
| European Broiler Index, EBI (Feeding Phase) | [(Average body weight at the end of the Feeding Phase ÷ age of animals in days at the end of the Feeding Phase) × percent survival of the Feeding Phase] ÷ (FCR of the feeding phase × 10) |
| Mortality Adjusted Average Daily Gain, in grams MA_ADG (Feeding Phase) | [(Pen weight at the end of the Feeding Phase − pen weight at the start of the Feeding Phase + Σ(Pen mortality weight)] ÷ [(animal inventory at the end of the Feeding Phase + Σ(Animal days of mortality of the Feeding Phase)] × 1,000 |
| Mortality Adjusted Average Daily Feed Intake, MA_ADFI in grams (Feeding Phase) | Total Feed Intake in the Feeding Phase ÷ [(Final animal inventory × number of days in the Feeding Phase) + Σ(Animal days of mortality of the Feeding Phase)] × 1,000 |
| Mortality Adjusted Feed conversion ratio, MA_FCR (Feeding Phase) | MA_ADFI of the Feeding Phase ÷ MA_ADG of the Feeding Phase |
| Mortality Adjusted Gain Efficiency, MA_GF (Feeding Phase) | MA_ADG of the Feeding Phase ÷ MA_ADFI of the Feeding Phase |

Data Analysis—All variables are analyzed using a two-way analysis of variance using JMP version 14.0 or higher (SAS Institute, Inc., Cary NC) with challenge status and diet as fixed effects and block as a random effect. All pair-wise comparisons are evaluated using a two-tail t-test. Pen serves as the experimental unit for growth performance measurements.

Results

In accordance with the treatments and doses and the study protocol outlined above, various (eight) *Bacillus* combinations were tested in Ross 708 breed of broiler chickens *Gallus gallus domesticus* with and without necrotic enteritis challenge over the 42 day study period. The animals were given a corn and soybean mash diet as described above.

Three phases were conducted: Phase 1 (Days 0-14), Phase 2 (Days 14-28) and Phase 3 (Days 28-42). For the necrotic enteritis (NE) challenge animals were administered by gavage (through a tube leading down the throat to the stomach) 10,000 oocytes of *Eimeria maxima* (*E. maxima*) on Day 13 and $10^6$ CFU *Clostridium perfringens* (*C. perfringes*) bacteria strain JP1011 on day 17. The animals were housed in pens in a facility as depicted in FIG. 7.

Figure 8:
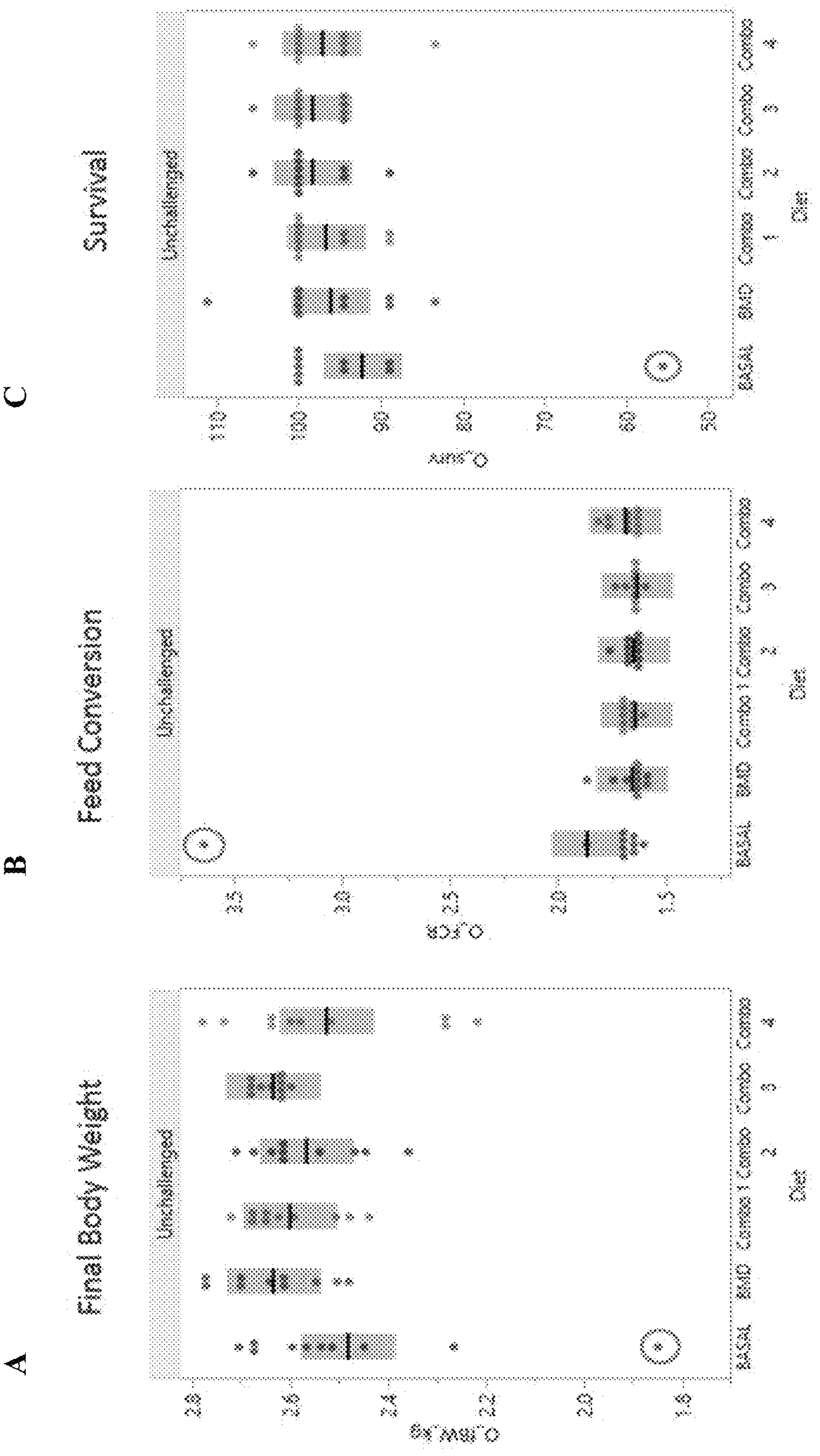

The final body weight, feed conversion and survival of unchallenged animals is depicted in FIG. 8, where it is noted that one outlier pen (circled) was removed from the T01 unchallenged control due to inordinate outlier results across all three measures.

Figure 9:
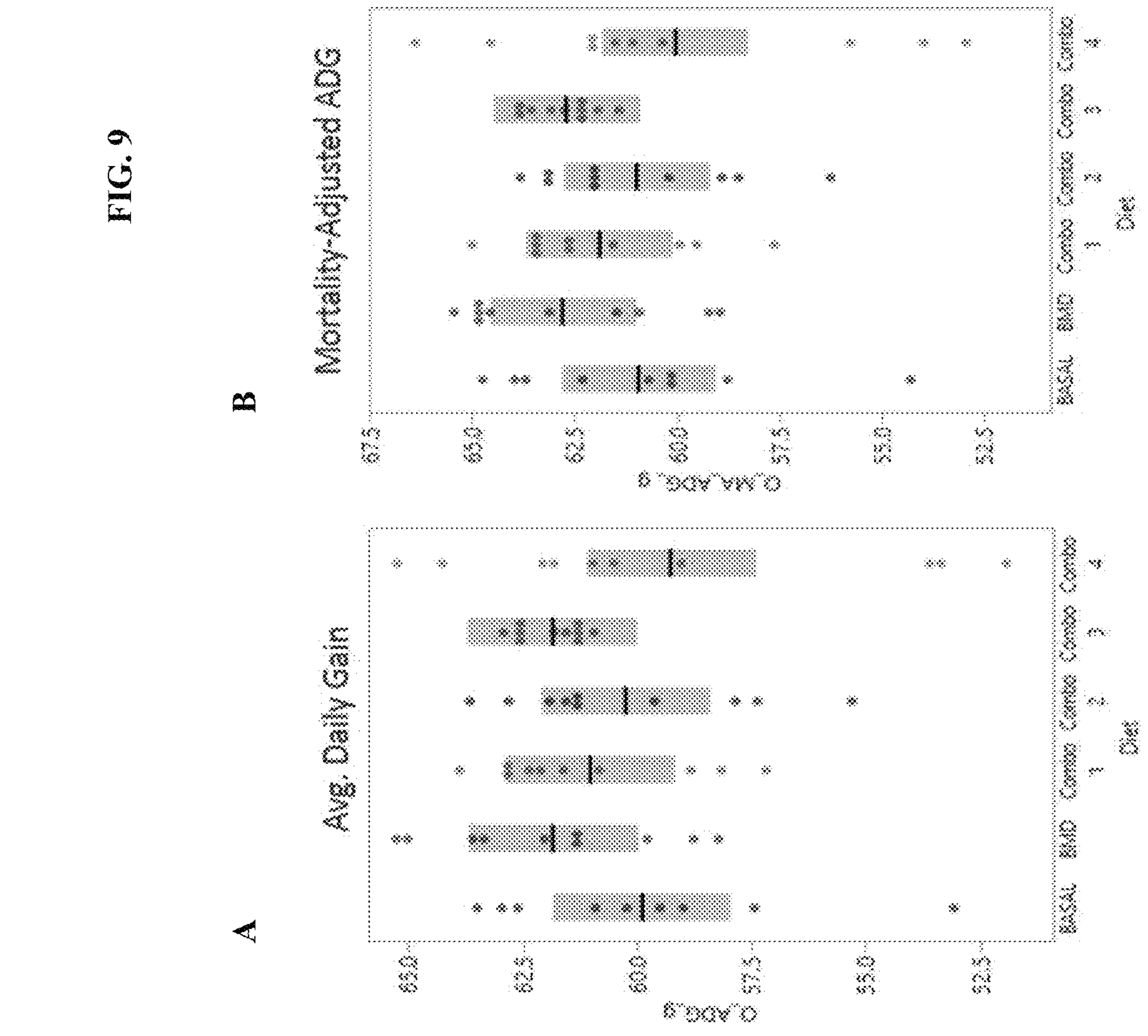

The weight gain in unchallenged chickens is depicted in FIG. 9, particularly average daily gain (FIG. 9A) and mortality-adjusted average daily gain (ADG) (FIG. 9B). The results are charted on a color coded scale in FIG. 9C. Unchallenged animals with BMD (antibiotic) and Combo 3 (BSUB19105+BAMY20071+BAMY 19024) demonstrated an average daily gain (ADG) and mortality adjusted ADG that was improved/better vs the basal diet situation. Unchallenged animals with BMD and Combo 3 demonstrated similar to near equivalent results. Combo 1 (BSUB19105+BAMY20071+BSUB20082) also demonstrated some improvement versus basal.

Figure 1:
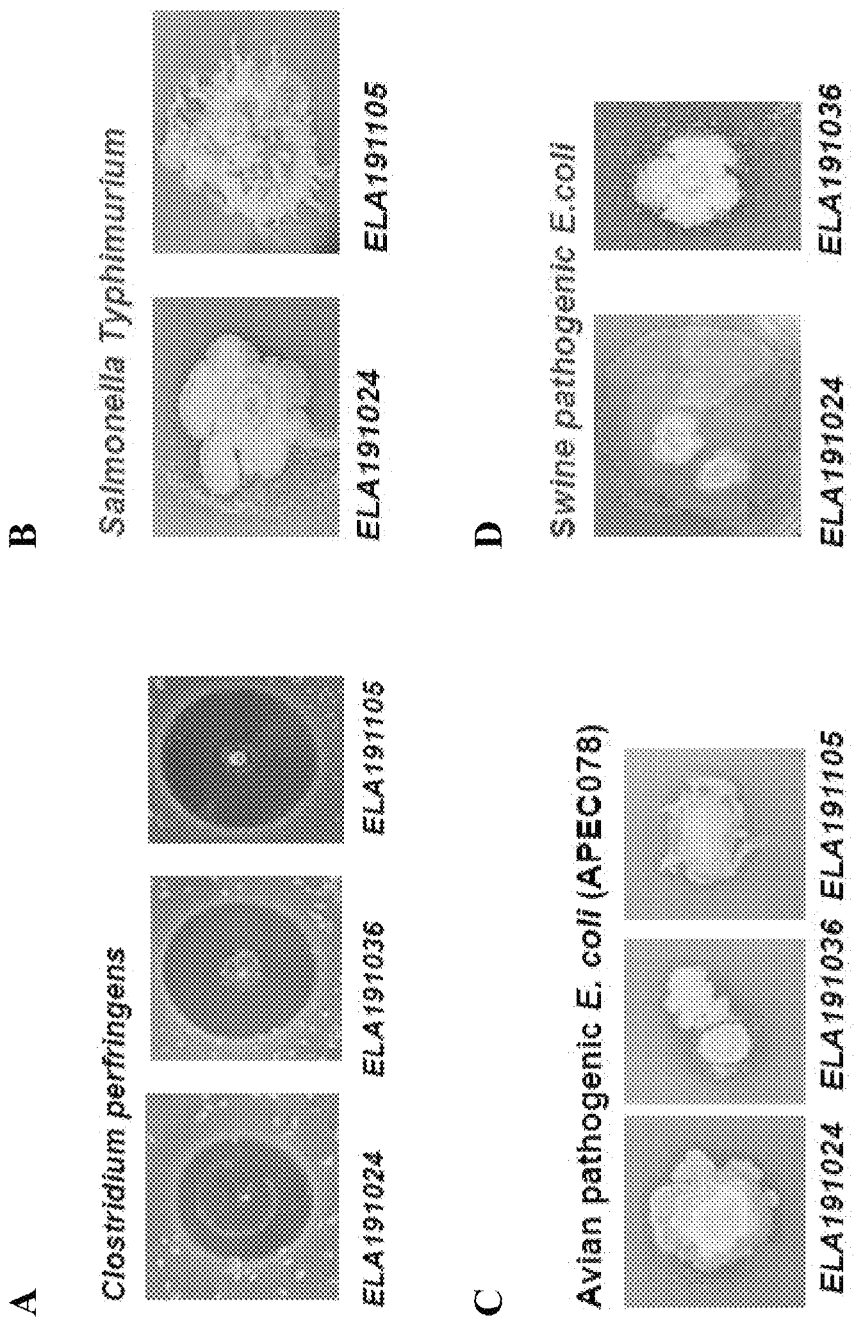
FIG. 1 depicts antimicrobial effect of *Bacillus amyloliquefaciens* ELA 191024, *Bacillus amyloliquefaciens* ELA 91036, and *Bacillus subtilis* ELA191105, as evidenced by a clear "halo" surrounding the strains. These strains are active against Gram positive and negative bacteria. Pathogenic bacteria shown include gram-positive pathogen *Clostridium* perfringes; gram negative pathogens are *Escherichia coli* and *Salmonella Typhimurium*. In particular, ELA191024, ELA191036, and ELA191105 demonstrate antimicrobial activity against *Clostridium perfringens*; ELA191024 and ELA191105 demonstrate activity against *Salmonella Typhimurium*; ELA191024, ELA191036, and ELA191105 demonstrate activity against Avian pathogenic *E. coli* (APEC078); and ELA191024 and ELA191036 demonstrate activity against Swine pathogenic *E. coli.*

The feed intake in unchallenged chickens is depicted in FIG. 1.0, particularly average daily feed intake (FIG. 10A) and mortality-adjusted average daily average daily feed intake (ADFI) (FIG. 10B). The results are charted on a color coded scale in FIG. 10C. Unchallenged animals with BMD (antibiotic) and Combo 3 (BSUB19105+BAMY20071+BAMY19024) demonstrated a mortality adjusted ADFI that was improved/better vs the basal diet. Unchallenged animals with BMD and Combo 3 demonstrated similar to near equivalent mortality adjusted ADFI results.

Figure 11:
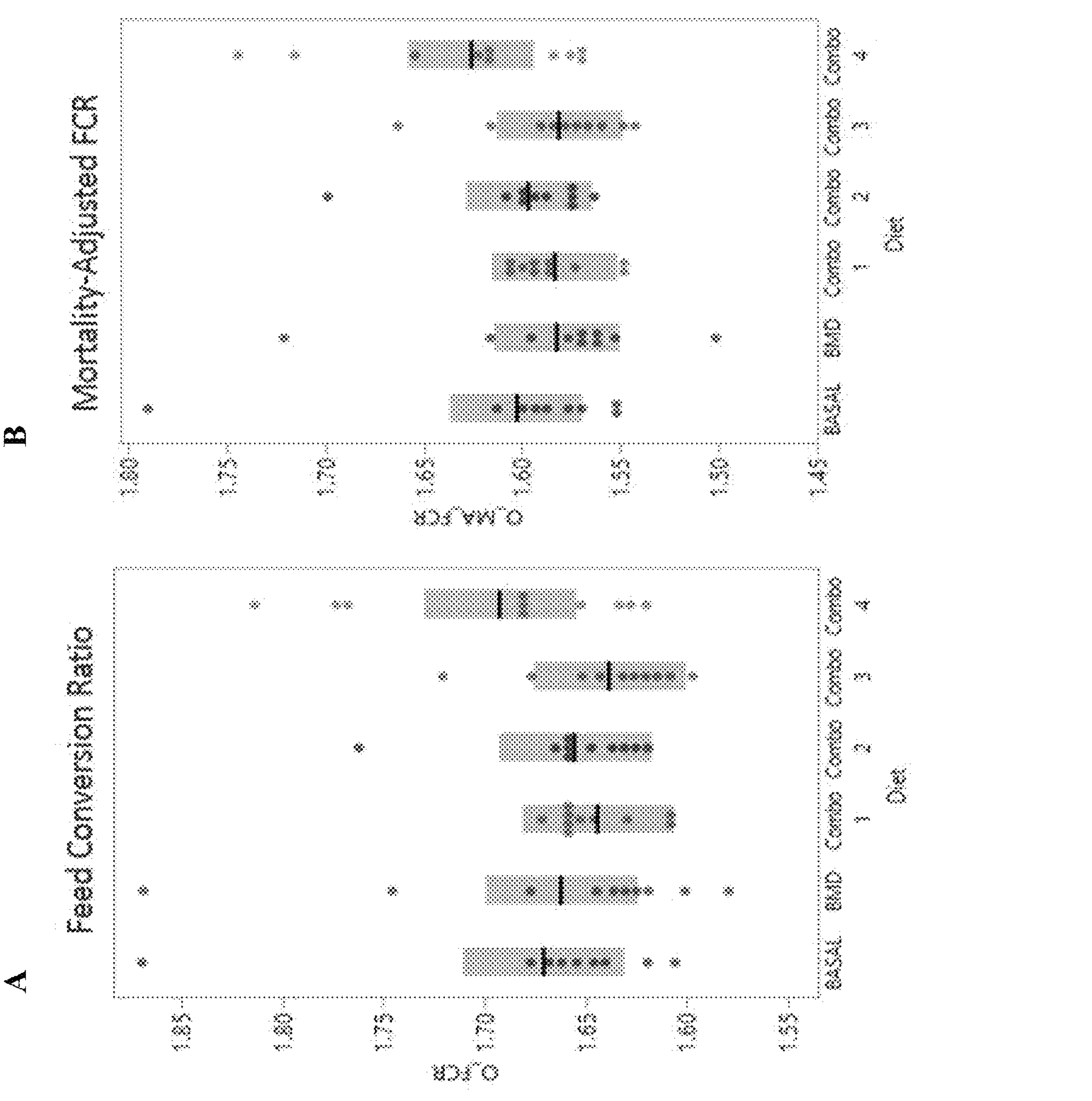

The feed efficiency in unchallenged chickens is provided in FIG. 11. FIG. 11A depicts feed conversion ratio and 11B depicts mortality-adjusted feed conversion ratio (FCR). The results are charted on a color coded scale in FIG. 11C, Combo 1 (BSUB19105+BAMY20071+BSUB20082) and Combo 3 (BSUB19105+BAMY20071+BAMY19024) demonstrated a feed conversion ratio and mortality-adjusted feed conversion ratio (FCR) that was improved vs the basal diet in both instances and was improved versus unchallenged animals with BMD (antibiotic) or the same as unchallenged animals with BMD, respectively.

Figure 12:
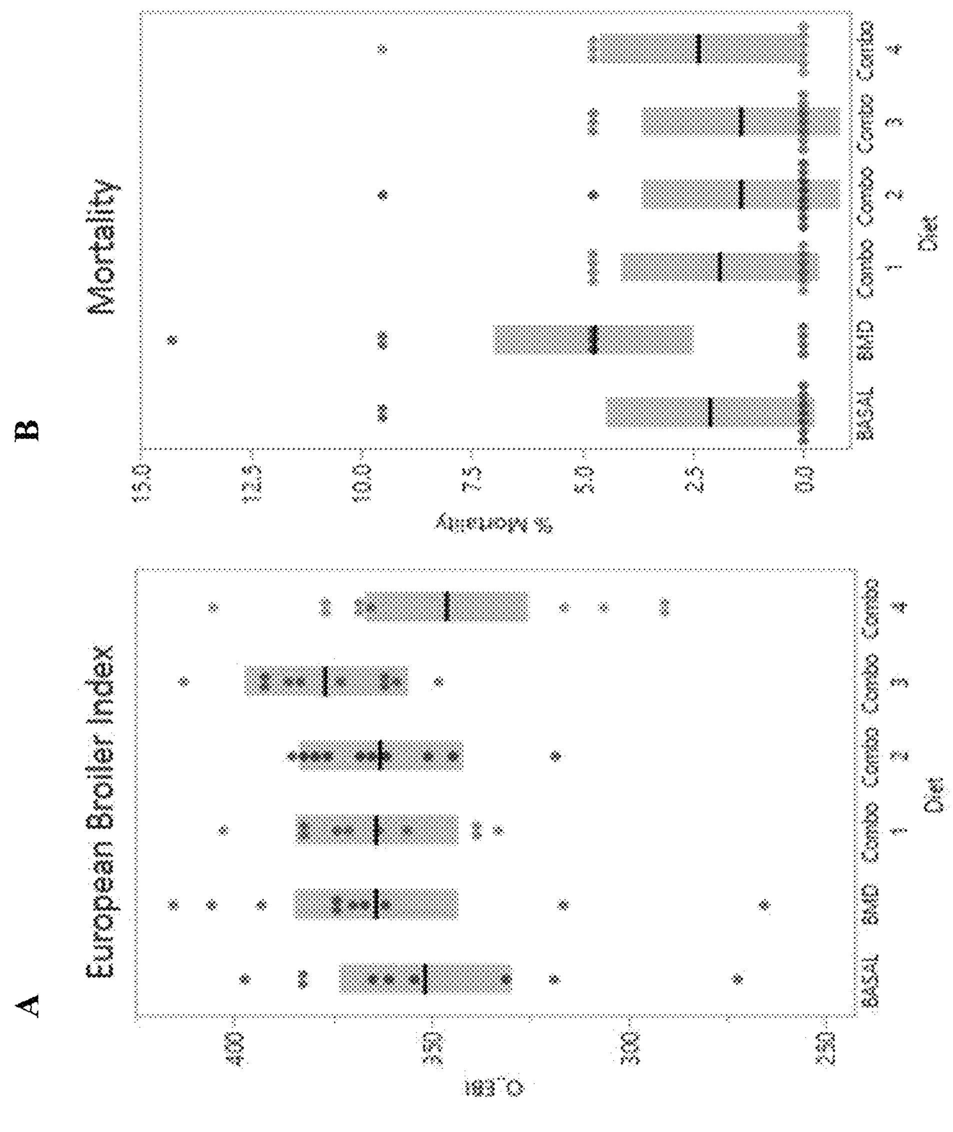

Production efficiency and mortality in unchallenged chickens is provided in FIG. 12, with the European Broiler Index provided in 12A and mortality results indicated in 12B. The results are charted on a color coded scale in FIG. 12C. Combo 3 (BSUB19105+BAMY20071+BAMY19024) demonstrated a significant EBI index improvement versus all other Diets and Combos. Unchallenged animals with BMD (antibiotic), Combo 1 (BSUB19105+BAMY20071+BSUB20082) and Combo 2 (BSUB19105+BAMY20071+BAMY19006) all showed EBI index improvement over basal. In terms of mortalities, the BMD animals had a significantly higher (worse) mortality percentage versus all other diet situations. Both Combo 2 and Combo 3 *Bacillus* strain combinations had improved mortalities.

Figure 13:
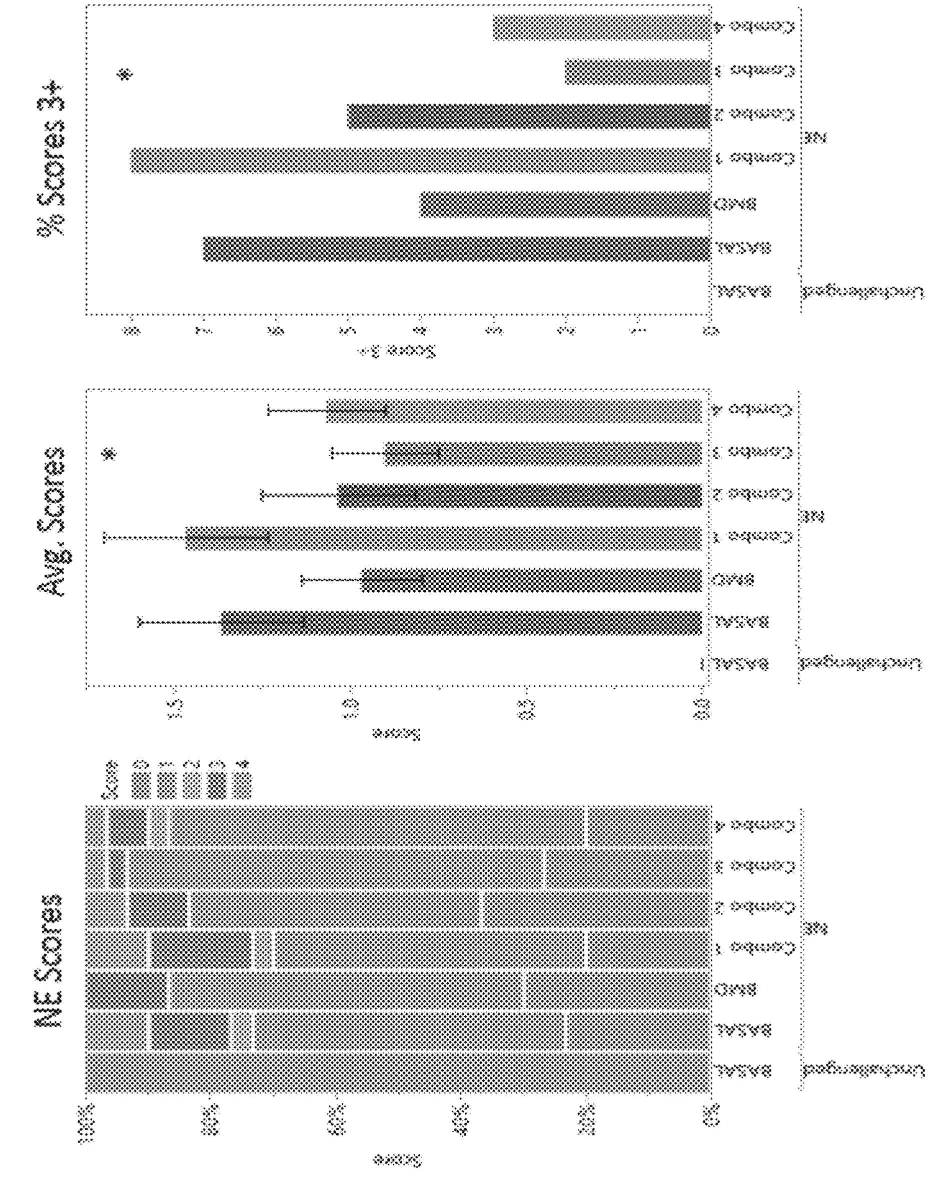

Necrotic enteritis (NE) lesion scores were assessed on Day 19 of the study, two days post challenge with *C. perfringes* on Day 17. The results are provided in FIG. 13. Lesions in the animals were scored 0, 1, 2, 3 and 4 in accordance with the observed macroscopic finding as provided in Table 21, with 3 indicating larger patches of necrosis and 4 indicating severe, extensive necrosis typical of field cases. The percentage of each of the scores 0-4 for each of the diets/combos and the average scores are shown in FIGS. 13 A and B. The percentage (%) of animals with scores 3 or greater (3+) for each of the diet/combos tested are shown in 13C. The results are charted in FIG. 13D with better % vs basal indicated by a color coding (blue being better). BMD, Combo 2, Combo 3 and Combo 4 all showed improvement in average lesion scores, with Combo 3 being the most significant. Similar results were seen in the lesion scores 3+ which were reduced in each of BMD, Combo 2, Combo 3 and Combo 4, with Combo 3 being the most significant.

Weight gain with NE challenge, particularly average daily gain and mortality-adjusted average daily gain (ADG), was then assessed, with results provided in FIGS. 14A and B. Results are charted in FIG. 14C and indicate that BMD and Combo 3 provided the most significant improvement in ADG. Combo 1 also improved ADG. Combo 2 and Combo 4 showed improvement in ADG over basal as well. Mortality-adjusted ADG was very significantly improved in either BMD diet or with *Bacillus* Combo 3. Combo 1 also demonstrated good improvement. Combo 2 and Combo 4 also gave improvement over basal.

Feed intake with NE challenge, particularly average daily feed intake and mortality-adjusted average daily feed intake (ADFI) was evaluated and data is provided in FIGS. 15A and B. FIG. 15C provides a chart of the results, with better % vs basal indicated by a color coding (blue being better). The results show that Combo 3 showed most significant difference versus basal diet, providing improvement in average daily feed intake (ADFI) and Mortality adjusted ADFI Combo 1 provided the next most significant improvement over basal in ADFI. Combo 2 also showed improvement in ADFI BMD and Combo 1 showed improvement in average daily feed intake versus basal. In terms of mortality adjusted ADFI, BMD demonstrated the next most significant improvement after Combo 3. Some improvement with Combo 1 was also seen, as well some but less improvement with Combo 2 and Combo 4.

Feed efficiency with NE challenge was evaluated, with results provided in FIGS. 16A and B and % improvement versus basal diet charted in FIG. 16C. Only BMD diet provided much improvement in feed conversion ratio (FCR). The improvement vs basal was minimally worsened with Combos 1-4. Mortality adjusted FCR was improved with BMD and also with Combo 3 in particular and about equally. Combo 1 showed some improvement also. Minimal but some improvement was demonstrated with Combo 2 and Combo 4.

Figure 17:
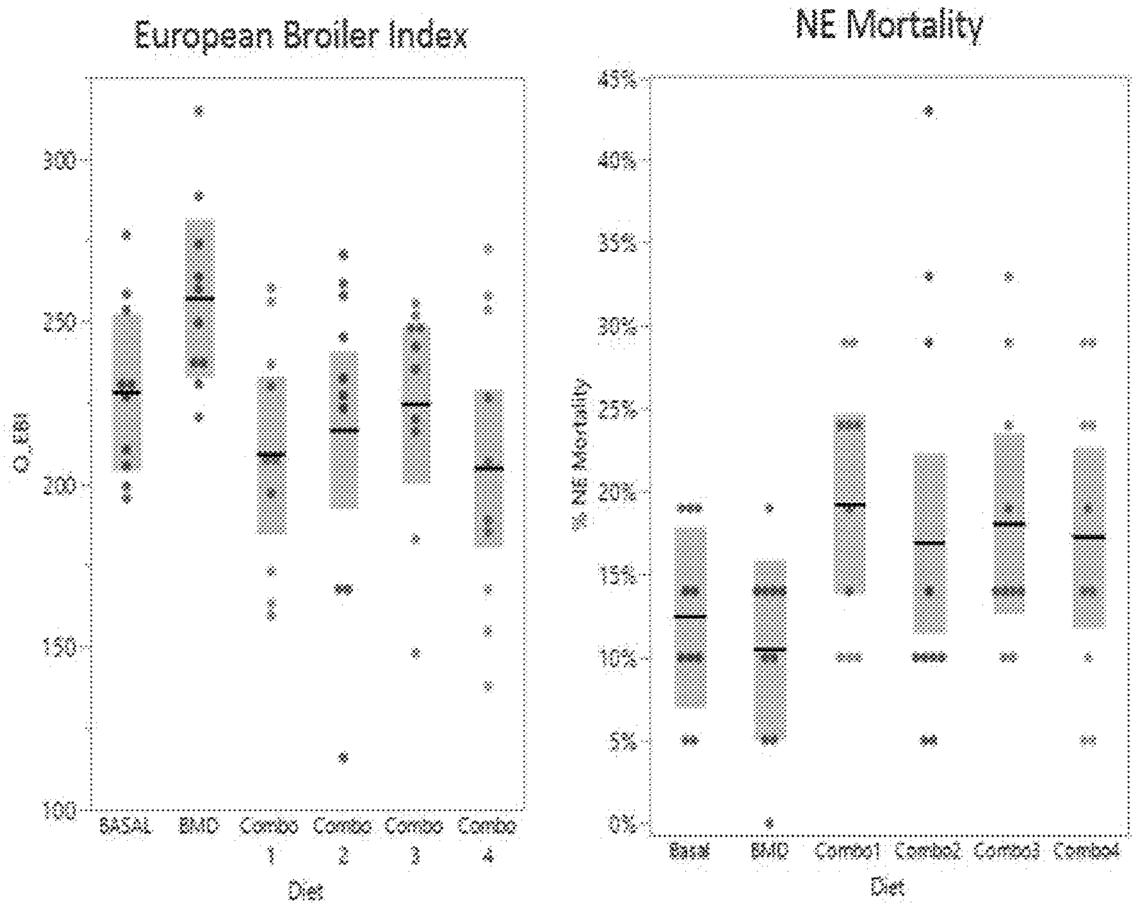

Production efficiency and mortality with NE challenge, particularly European Broiler Index (EBI) and necrotic enteritis (NE) mortality were evaluated and results are depicted in FIGS. 17 A and B. The % change versus Basal diet is charted in FIG. 17C. European Broiler Index (EBI) with NE challenge was improved with BMD, however each of Combos 1-4 showed worse EBI numbers. NE mortality was also improved with BMD. Each of Combos 1-4 showed worse mortality figures.

Pen weight uniformity with NE challenge and unchallenged is charted in FIG. 18.

A comparison of overall results for each measure with Combo 3 (strains BSUB19105+BAMY20071+BAMY19024) versus BMD and the % difference versus control (Ctrl) Basal diet is provided in FIG. 19. Combo 3 demonstrated improved growth performance in unchallenged and necrotic enteritis (NE) challenged conditions. The Combo 3 combination of a *B. subtilis* strain, particularly BSUB19105) and two *B. amyloliquefaciens* strains (BAMY20071 and BAMY19024) significantly reduced NE lesion scores in the animals. These strains are diverse *bacillus* strains with one being a *B. subtilis* bacteria strain and the other two being distinct *B. amyloliquefaciens* strains.

Additional results with *bacillus* strains tested here, including *B. subtilis* strain BSUB19105, the *B. amyloliquefaciens* strain BAMY20071 and the *B. amyloliquefaciens* strain BAMY19006, in post-weaning piglets is provided in Example 14. Good pilot efficacy in broiler chickens with *B. amyloliquefaciens* strain BAMY19024 alone has also been observed and determined (data not shown). Metabolomics data with strains *B. subtilis* strain BSUB19105 and *B. amyloliquefaciens* strain BAMY19024 is provided above herein, including in Example 12.

While the *bacillus* strain combinations tested in the study described in this Example did not improve NE survival or mortality in this study, various combinations, including Combo 3, as well as in certain aspects other tested *bacillus* strain combinations, showed improvement in various assessed parameters. Reduction in NE lesion scores, improved weight gain, improved feed intake for example have been shown with strain combinations. These improvements can significantly effect and impact for reduced necrotic enteritis, including reduced lesions and improvements with regard to animal housing, animal management and costs, even if survival is not improved overall and mortality is not reduced.

Example 14. Assessment of *Bacillus* Probiotic Combinations for Reducing the Impact of Post-Weaning Diarrhea in Piglets This study was undertaken to provide an assessment of *bacillus* probiotic combinations for reducing the impact of post-weaning diarrhea in piglets.

Post-weaning diarrhea is a common and problematic issue and outbreaks can result in high morbidity and mortality and detrimentally affect production and costs. Diarrhea can result from various bacteria or viruses infecting or colonizing a pen, herd or group of animals.

Study Objectives—Assess probiotic combinations for their ability to reduce the impact of post weaning diarrhea as measured by fecal scores. *Escherichia coli* quantification, and growth performance.

Methods

Treatment and Doses—The treatment groups and dosing for the different groups of animals in the study are depicted below in Table 25. The Control treatment is without antibiotic or pharmacological levels of Zn and Cu. The Conventional treatment contains 110 ppm of Tylan (antibiotic also denoted as tylosin, used for colitis and chronic diarrhea), 2,500 ppm of Zn from ZnO and 125 ppm of Cu from CuSO4 or tribasic copper chloride.

TABLE 25

| Code | Treatment | Dose (CFU/g of feed) | Treatment Duration, days | Pigs/pen | No. of Pens | Total Animals |
|---|---|---|---|---|---|---|
| T01 | Control* | 0 | 42 | 5 | 7 | 35 |
| T02 | Conventional** | 0 | 42 | 5 | 7 | 35 |
| T03 | *B. subtilis* 1E | $10^5$ | 42 | 5 | 7 | 35 |
| T04 | *B. subtilis* 1G | $10^5$ | 42 | 5 | 7 | 35 |
| T05 | *B. subtilis* 1E + *B. subtilis* 1G | $10^5$ | 42 | 5 | 7 | 35 |
| T06 | *B. subtilis* 1E + *B. subtilis* 1D | $10^5$ | 42 | 5 | 7 | 35 |
| T07 | *B. subtilis* 1E + *B. subtilis* 1D + *B. subtilis* 1G | $10^5$ | 42 | 5 | 7 | 35 |
| T08 | BSUB20025 + BSUB19105 + BAMY19006 | $10^5$ | 42 | 5 | 7 | 35 |
| T09 | BSUB19105 + BAMY19006 + BAMY20071 | $10^5$ | 42 | 5 | 7 | 35 |
| T10 | BSUB20025 + BAMY20071 | $10^5$ | 42 | 5 | 7 | 35 |
| T11 | BSUB20025 + BSUB19105 | $10^5$ | 42 | 5 | 7 | 35 |
| T12 | BSUB19105 + BAMY19006 | $10^5$ | 42 | 5 | 7 | 35 |
| Total | | | | | 84 | 420 |

*Without antibiotic or pharmacological levels of Zn and Cu

**Containing 110 ppm of Tylan, 2,500 ppm of Zn from ZnO and and 125 ppm of Cu from CuSO4 or tribasic copper chloride.

Experimental Design—The experimental design will be a randomized block design with 12 treatments in 7 blocks of 12 pens each.

Experimental Unit—The experimental unit will be both the pen and the pig.

Study Phases—A description of the study phases are as follows shown below in Table 26:

TABLE 26

| Dietary Study Phases | Expected Body Weight Range, kg | Study Days | Treatments | Feed Form |
|---|---|---|---|---|
| 1 | 7.0 to 9.6 | 0 to 7 | 1 to 12 | Meal |
| 2 | 9.6 to 14.6 | 7 to 21 | 1 to 12 | Meal |
| 3 | 14.6 to 28.0 | 21 to 42 | 1 to 12 | Meal |
| Overall | 7.0 to 28.0 | 0 to 42 | 1 to 12 | Meal |

A schedule of events for each study day(s) and study activity if provided below in Table 27,

TABLE 27

| Study Day | Study Activity |
|---|---|
| 0 thru 42 | Conduct and record daily observations on all animals<br>Fecal scoring<br>Feed Issue as needed |
| 0 | Randomization of animals to pens<br>Individual Animal Weights<br>Feed Issue - Phase 1 Diets |
| 1 thru 6 | |
| 7 | Individual Animal Weights<br>Feed Weighbacks<br>Feed Issue - Phase 2 Diets |

TABLE 27-continued

| Study Day | Study Activity |
|---|---|
| 8 thru 13 | |
| 14 | Collect fecal samples from 2 pigs per pen |
| 15 thru 20 | |
| 21 | Individual Animal Weights<br>Feed Weighbacks<br>Feed Issue - Phase 3 Diets |
| 22 thru 41 | |
| 42 | Individual Animal Weights<br>Feed Weighbacks<br>End of study |

Randomization Procedures—Assignment of treatments to pens will be conducted using a computer program for random number generation. The computer-generated assignment will be included in the study data file and final study report.

Animals

Source—Pigs from a single herd and lot of weaned pigs.

Species—Domestic pig, *Sus scrofa.*

Physiological State—Healthy at trial initiation with the customary vaccination program at the source farm, which may include: *Mycoplasma hyopneumoniae*, Porcine Circovirus Type 2 (PCV2), and Porcine Reproductive and Respiratory Syndrome (PRRS) virus, etc. Information regarding animal source and vaccination history will be recorded and documented in the study data file.

Age—Animals will be on average 21+3 days of age and immediately after weaning.

Gender—Balance genders among treatments. Final distribution will depend on pig availability.

Breed—PIC Canborough sows×PIC 359 boar or equivalent.

Weight—Approximately 7.0 kg at enrollment.

Identification—Individual numbered ear tag.

Animal Selection—Each animal must meet the following inclusion criteria:

- At day 0, pigs will be clinically assessed to be in good health by the Study Investigator or designated personnel.
- Animal source and vaccination history will be documented in the study records.
- Each animal will be identified by a unique ID ear tag.

Exclusion Criteria—Animals not meeting the inclusion criteria outlined above in animal selection. Examples include pre-existing and existing conditions or disease (e.g. lameness, neurological disease, septicemia), unthrifty appearance, abnormal conformation, or history of numerous repeated antimicrobial treatments for disease or injury.

Animal Disposal—Animals will be disposed of according to site procedures, and observing institutional, local, state, and national guidelines and/or regulations. All animals that die or are euthanized during the study will be composted at the study facility. All animals completing the study may be marketed and enter the food chain.

Observations, Examinations, and Tests

Daily Observations

Pigs will be observed at least once each day during the length of the study. All abnormalities and mortalities will be recorded. Body weight of mortalities and culls will be recorded. If all animals within the pen are observed as normal, no specific documentation for that pen will be recorded. No animal will be culled solely due to apparent slow growth.

A swine system/clinical sign key is provided in Table 28 below:

TABLE 28

| System |
|---|
| CDV = Cardiovascular |
| EAR = Ear and Labyrinth |
| EYE = Eyes |
| GEN = General |
| GI = Gastrointestinal |
| INTG = Skin and Integument |
| MS = Musculoskeletal |
| NEU = Neurological |
| REP = Reproductive |
| RESP = Respiratory Tract |
| RNU = Renal and Urinary |
| OTHER = Other |
| **Clinical Sign** |
| CDV |
| BRAD = Bradycardia |
| EDE = Edema |
| HEMR = Hemorrhage |
| TACH = Tachycardia |
| EAR |
| ABS = Abscess/Cystic |
| DCH = Discharge |
| IFL = Inflammation |
| LES = Lesion |
| SWE = Swelling (e.g., bubble ear) |
| EYE |
| ABS = Abscess/Cystic |
| BLI = Blindness |
| DCH = Discharge |
| IFL = Inflammation |
| LES = Lesion |
| RED = Redness |
| GEN |
| DEAD = Dead |
| LET = Lethargic |
| MORB = Moribund |
| GI |
| ANO = Anorexia |
| DIA = Diarrhea |
| HER = Hernia |
| HEMR = Hemorrhage |
| IPAR = Internal Parasite Infestation |
| PRO = Prolapse |
| INTG |
| ABS = Abscess/Cystic |
| ALO = Alopecia |
| DER = Dermatitis |
| ECTO = Ectoparasite Infestation |
| LAC = Laceration |
| LES = Lesion |
| SWE = Swelling |
| MS |
| CONT = Contusion |
| FBON = Fractured |
| LMNS = Laminitis |
| IFL = Inflammation |
| LAC = Laceration |
| LAM = Lameness |
| NOA = Non-Ambulatory |
| NEU |
| ATX = Ataxia |
| CIR = Circling |
| NYS = Nystagmus |

TABLE 28-continued

| |
|---|
| PAR = Paralysis |
| PAS = Paresis |
| TLT = Head Tilt |
| REP |
| ABS = Abscess/Cystic |
| DCH = Discharge |
| EST = Estrus |
| HER = Hernia |
| IC = Incomplete |
| PRO = Prolapse |
| RED = Redness |
| SWE = Swelling |
| RESP |
| COU = Coughing |
| DCH = Discharge |
| LB = Labored Breathing |
| PNM = Pneumonia |
| RNU |
| DCH = Discharge |
| SWE = Swelling |
| RED = Redness |
| OTHER |
| Other = used for any unlisted systems or clinical signs |

Fecal Collection

Collection tubes should be labeled with the pen number and animal ID. Fecal samples are collected aseptically. A clean disposable glove is used for each pig. Do not use any lubricants if manual stimulation is needed. Approximately 1 to 3 grams of feces is collected into a clean 50 mL tube containing 15 mL of LB broth with 10% glycerol and stored at −20° C., preferably −80° C., until ready to be shipped on dry ice to Elanco Animal Health.

Sample Collection—The Schedule of Events Table 26 above indicates the schedule and applicable study day(s) for fecal collection.

Animal Management and Housing

Facility Layout—A facility diagram is included in FIG. 20.

Management and Environmental Conditions

Comply with 2010 Guide for the Care and Use of Agricultural Animals (3rd edition, FASS, 2010) or similar guideline.

Comply with any applicable institutional, local, state, and national regulations.

According to the procedures of the facility.

Conditions and parameters for various aspects are provided below in Table 29.

TABLE 29

| | |
|---|---|
| Space Allocation: | Approximately 4.8 $ft^2$/animal of usable floor space in a pen in an indoor facility. Flooring will be concrete slats. |
| Lighting: | Animals will receive approximately 18 hrs of light for every 24 hour interval. |
| Heating Program: | Temperature and fan settings will be adjusted to meet recommended thermal conditions for each stage of growth per facility procedure. Supplemental heat may be used via individual pen heaters as needed. |
| Ventilation Program: | Mechanical |
| Feeding Program: | Animals will be meal fed via a three-section stainless steel nursery type feeder. |
| Watering Program: | Ad libitum access to water via cup waterers. |
| Euthanasia Procedure: | Animals will be euthanized by designated personnel according to site specific procedures (M-012), and in accordance with accepted AVMA or other referenced guidelines and procedures. |

Measurements—the following measurements are taken and noted:

Individual body weights

Feed addition to each pen

Unconsumed feed at the end of each feeding phase

Fecal score per pen fecal Score—For fecal score, pigs ware observed daily for clinical signs of diarrhea which will be scored using a 5-point fecal scoring system that will be used to indicate the presence and severity of diarrhea:

1 None (normal feces)

2 Minimal (slightly soft feces)

3 Mild (soft, partially formed feces)

4 Moderate (loose, semi-liquid feces)

5 Severe (watery, mucous-like feces)

Scores for individual pens are recorded daily in the morning by a trained technician. Pigs with severe diarrhea may be individually treated according to prescription of the attending veterinarian.

Animal Feeds

Nutrient Requirements

Nutritional requirements were estimated using the computer model (v.06-19-12a) of the Nutrient Requirements of Swine: Eleventh Revised Edition downloaded on Oct. 20, 2016 from The National Academies Press website (nap.edu/download/13298). Requirements for all feeding phases were estimated with a diet metabolic energy (ME) content of 3,300 kcal/kg. Requirements for Phase 1 and Phase 2 were calculated using the "Starting Pigs" module of the aforementioned software using mean BW of 8.3 and 12.1 kg, respectively. Requirements for Phase 3 were estimated using both the "Starting Pigs" and "Growing-Finishing Pigs" modules of the software as follows:

A mean BW of 17.3 kg was used in the "Starting Pigs",

Input parameters for the "Growing-Finishing Pigs" module were 20 and 28 kg BW for initial and final BW, respectively, under "Whole body protein deposition (Pd) pattern" the option "Specify PdMax and StartPdMax decline" was selected with values of 135.0 for "PdMax, g/day" and 90.0 for "Body weight at start of PdMax decline, kg"; and A weighted average was calculated for the 3-week period of feeding Phase 3 diet as: "Starting Pigs" as ⅓ and "Growing-Finishing Pigs" as ⅔.

Diet Formulation

For each feeding phase, European-type diets were least-cost formulated using the Diet Formulation and Evaluation Software (version metric 4-16-13, JMJ 01232012) of the 2010 National Swine Nutrition Guide (www.uspork.org) using the nutrient recommendations obtained (see Table 30 and Table 31 below for ingredients and calculated/calculation of nutrients and also Table 31 for certain calculations.

TABLE 30

| Ingredient | Phase 1 | Phase 2 | Phase 3 |
|---|---|---|---|
| Corn, ground, 8% CP | 47.67 | 59.03 | 68.43 |
| Soybean meal, 47% CP | 15.45 | 24.00 | 28.00 |
| Whey, dried, 12% CP | 27.78 | 11.11 | — |
| Fishmeal, menhaden, 62% CP | 3.00 | 2.00 | — |
| Spray-dried plasma, 78% CP | 3.50 | 1.00 | — |
| L-lysine HCI | 0.44 | 0.48 | 0.55 |
| DL-methionine | 0.22 | 0.20 | 0.21 |
| L-threonine | 0.15 | 0.18 | 0.21 |
| L-isoleucine | 0.09 | 0.04 | 0.03 |
| L-tryptophan | 0.04 | 0.03 | 0.04 |
| L-valine | 0.01 | — | — |
| Monocalcium phosphate, 21% P | 0.38 | 0.40 | 0.66 |
| Calcium carbonate | 0.85 | 0.86 | 1.00 |
| Salt | 0.25 | 0.35 | 0.50 |
| Sodium bicarbonate | 0.07 | 0.20 | 0.25 |
| Promote phytase | — | 0.02 | 0.02 |
| Belstra vitamin-mineral premix* | 0.10 | 0.10 | 0.10 |

Vitamin and trace mineral premix must be free of phytase, any other enzyme, or feed additive.

TABLE 31

| Calc. Nutrient | Phase 1 | Phase 2 | Phase 3 |
|---|---|---|---|
| ME, kcal/kg | 3,327 | 3,340 | 3,340 |
| NE, kcal/kg | 2,590 | 2,570 | 2,473 |
| CP, % | 19.1 | 19.3 | 18.5 |
| ADF, % | 2.7 | 3.6 | 4.1 |
| NDF, % | 5.8 | 7.5 | 8.8 |
| Crude fiber, % | 1.5 | 2.1 | 2.4 |
| Crude fat, % | 2.2 | 2.3 | 2.3 |
| Lactose % | 20.0 | 8.0 | 0 |
| Phytase, U/kg | 0 | 500 | 500 |
| SID Lys, % | 1.41 | 1.35 | 1.29 |
| SID Thr, % | 0.85 | 0.81 | 0.77 |
| SID Met, % | 0.50 | 0.50 | 0.49 |
| SID TSAA, % | 0.82 | 0.78 | 0.75 |
| SID Trp, % | 0.25 | 0.23 | 0.23 |
| SID Ile, % | 0.79 | 0.76 | 0.72 |
| SID Val, % | 0.92 | 0.93 | 0.89 |
| SID Arg, % | 0.94 | 1.10 | 1.13 |
| SID His, % | 0.45 | 0.46 | 0.44 |

TABLE 31-continued

| Calc. Nutrient | Phase 1 | Phase 2 | Phase 3 |
|---|---|---|---|
| SID Leu, % | 1.52 | 1.51 | 1.46 |
| SID Phe % | 0.79 | 0.82 | 0.82 |
| SID Phe + Tyr, % | 1.36 | 1.39 | 1.36 |
| Ca, % | 0.82 | 0.78 | 0.70 |
| STTD of P,% | 0.43 | 0.40 | 0.33 |
| Na, % | 0.50 | 0.35 | 0.29 |
| Cl, % | 0.63 | 0.43 | 0.34 |
| Ca:STTD P | 1.91 | 1.94 | 2.12 |
| SID Lys:ME | 4.23 | 4.04 | 3.86 |
| SID Lys:ME | 5.43 | 5.36 | 5.22 |

Feed Manufacturing—Diets are manufactured under the supervision of BRRS personnel. Feed manufacturing records for the manufacture of all test feeds, as well as each diet formulation, is included in the study data file. Diets are analyzed for proximate analysis of crude protein, ash, moisture, sodium, calcium, zinc, copper, and phosphorous. For each feeding phase, a master batch is mixed and all ten treatment diets are derived.

Feed Manufacturing Records—All feed manufacturing batch records are included in the final data file.

Feed Labelling—The feed is stored in 25-kg capacity new feed sacks labeled with study number (ELAVV200241), feed ID (Phase 1, Phase 2, or Phase 3), treatment ID (T01, T02, etc.) and treatment color code.

Feed Samples—One feed sample of about 500 g from each diet and phase is collected, labeled, and stored at BRRS. For T01 and T02, a second feed sample is sent to Minnesota Valley Testing Laboratory (MVTL) for proximate analysis.

Proximate Analysis—Feed samples from T01 and T02 are sent for analysis of crude protein, moisture, ash, Na, Ca, P, Zn, Cu at Minnesota Valley Testing Laboratory (MVTL)

Statistical Analysis

Variable Classification—Variable calculations are made relative to phases, where the phases are defined according to the study phases as indicated above in Table 26.

Key Variables

Growth performance efficiency (average daily gain, average daily feed intake, gain efficiency) is calculated and evaluated for each study phase and overall. Individual feed intake is calculated according the procedure of Lee et al., 2016. Removals and mortality by system and clinical sign is documented by treatment. General health records (e.g. diarrhea, respiratory problems, etc.) is documented by treatment and cause of illness.

A listing of continuous variables and their calculation is provided below in Table 32.

TABLE 32

| List of Continuous Variables | Calculation |
|---|---|
| Individual Feed Intake maintenance (IFIm), kg | $(197 \times BW^{0.60} \times d) \div MEf$ |
| Pen Feed Intake maintenance (PFIm), kg | $\sum_{j=1}^{n} IFIm_j$ |
| Pen Feed Intake gain, (PFIg), kg | Total PFI-PFIm |
| Individual BW Gain (IBWG), kg | Final BW-Initial BW |
| Pen BW Gain (PBWG), kg | $\sum_{j=1}^{n} IBWG_j$ |
| Individual Feed Intake gain (IFIg), kg | $PFIg \times (IBWG \div PBWG)$ |
| Individual Feed Intake (IFI), kg | IFIm + IFIg |

TABLE 32-continued

| List of Continuous Variables | Calculation |
|---|---|
| Average Final Body Weight | $\frac{\Sigma \text{ Individual Live Body Weight on } d\ 42}{\text{Number of animals alive on } d\ 42}$ |
| Individual Average Daily Gain (Phase 1) (d 0 to 7) | $\frac{\Sigma\ IBGW\ (d\ 0 \text{ to } 7)}{\text{Number of animals alive } (d\ 0 \text{ to } 7)}$ |
| Individual Average Daily Gain (Phase 2) (d 7 to 21) | $\frac{\Sigma\ IBGW\ (d\ 7 \text{ to } 21)}{\text{Number of animals alive } (d\ 7 \text{ to } 21)}$ |
| Individual Average Daily Gain (Phase 3) (d 21 to 42) | $\frac{\Sigma\ IBGW\ (d\ 21 \text{ to } 42)}{\text{Number of animals alive } (d\ 21 \text{ to } 42)}$ |
| Individual Average Daily Gain (Overall) (d 0 to 42) | $\frac{\Sigma(\text{Individual } BW \text{ on } d\ 0 - \text{Individual } BW \text{ on } d\ 42)}{\text{Number of animals alive on } d\ 42}$ |
| Individual Average Daily Feed Intake (Phase 1) (d 0 to 7) | $\frac{\Sigma\ IFI\ (d\ 0 \text{ to } 7)}{\text{Number of animals alive } (d\ 0 \text{ to } 7)}$ |
| Individual Average Daily Feed Intake (Phase 2) (d 7 to 21) | $\frac{\Sigma\ IFI\ (d\ 7 \text{ to } 21)}{\text{Number of animals alive } (d\ 7 \text{ to } 21)}$ |
| Individual Average Daily Feed Intake (Phase 3) (d 21 to 42) | $\frac{\Sigma\ IFI\ (d\ 21 \text{ to } 42)}{\text{Number of animals alive } (d\ 21 \text{ to } 42)}$ |
| Individual Average Daily Feed Intake (Overall) (d 0 to 42) | $\frac{\Sigma\ IFI\ (d\ 0 \text{ to } 42)}{\text{Number of animals alive } (d\ 0 \text{ to } 42)}$ |
| Individual Gain Efficiency (Phase 1) (d 0 to 7) | $\frac{\Sigma\ IBWG\ (d\ 0 \text{ to } 7)}{\Sigma\ IFI(d\ 0 \text{ to } 7)}$ |
| Individual Gain Efficiency (Phase 2) (d 7 to 21) | $\frac{\Sigma\ IBWG\ (d\ 7 \text{ to } 21)}{\Sigma\ IFI(d\ 7 \text{ to } 21)}$ |
| Individual Gain Efficiency (Phase 3) (d 21 to 42) | $\frac{\Sigma\ IBWG\ (d\ 21 \text{ to } 42)}{\Sigma\ IFI(d\ 21 \text{ to } 42)}$ |
| Individual Gain Efficiency (Overall) (d 0 to 42) | $\frac{\Sigma\ IBWG\ (d\ 0 \text{ to } 42)}{\Sigma\ IFI(d\ 0 \text{ to } 42)}$ |
| Individual Feed Conversion Ratio (FCR, Phase 1, d 0 to 7) | $\frac{\Sigma\ IFI\ (d\ 0 \text{ to } 7)}{\Sigma\ IBWG(d\ 0 \text{ to } 7)}$ |
| Individual Feed Conversion Ratio (FCR, Phase 2, d 7 to 21) | $\frac{\Sigma\ IFI\ (d\ 7 \text{ to } 21)}{\Sigma\ IBWG(d\ 7 \text{ to } 21)}$ |
| Individual Feed Conversion Ratio (FCR, Phase 3, d 21 to 42) | $\frac{\Sigma\ IFI\ (d\ 21 \text{ to } 42)}{\Sigma\ IBWG(d\ 21 \text{ to } 42)}$ |
| Individual Feed Conversion Ratio (FCR, Overall, d 0 to 42) | $\frac{\Sigma\ IFI\ (d\ 0 \text{ to } 42)}{\Sigma\ IBWG(d\ 0 \text{ to } 42)}$ |
| Pen Average Daily Fecal Score (Phase 1) (d 0 to 7) | $\frac{\Sigma \text{ daily pen fecal score } (d\ 0 \text{ to } 7)}{7\ (d\ 0 \text{ to } 7)}$ |
| Pen Average Daily Fecal Score (Phase 2) (d 7 to 21) | $\frac{\Sigma \text{ daily pen fecal score } (d\ 7 \text{ to } 21)}{14\ (d\ 7 \text{ to } 21)}$ |
| Pen Average Daily Fecal Score (Phase 3) (d 21 to 42) | $\frac{\Sigma \text{ daily pen fecal score } (d\ 21 \text{ to } 42)}{21\ (d\ 21 \text{ to } 42)}$ |
| Pen Average Daily Fecal Score (Overall) (d 0 to 42) | $\frac{\Sigma \text{ daily pen fecal score } (d\ 0 \text{ to } 42)}{42\ (d\ 0 \text{ to } 42)}$ |

Where:
d is number of days in each diet phase
BW is the body weight of a pig in kg
MEf is the feed metabolizable energy in kcal/kg
Total PFI is the amount of feed added to a pen during each feeding phase
n is the number of pigs in a pen Data Analysis—Variables are analyzed using a two-way analysis of variance using JMP version 12.0 or higher (SAS Institute, Inc., Cary NC) with treatment as a fixed effect. Block may be included in the model as a random effect. All pair-wise comparisons are evaluated using a two-tail I-test. Pen and pig serve as the experimental unit for growth performance, and pen is the experimental unit for fecal scores.

A swine necropsy key and findings/presumptive diagnosis for the study is provided in Table 33.

TABLE 33

| System |
|---|
| CDV = Cardiovascular |
| EAR = Ear and Labyrinth |
| EYE = Eyes |
| GEN = General |
| GI = Gastrointestinal |
| INTG = Skin and Integument |
| MS = Musculoskeletal |
| NEU = Neurological |
| RESP = Respiratory |
| Tract RNU = Renal and |
| Urinary SYS = Systemic |
| OTHER = Other |
| **Findings/Presumptive Diagnosis[1]** |
| CDV |
| ENDO = Endocarditis |
| MABS = Myocardial Abscess |
| PERI = Pericarditis |
| EAR |
| OTSM = Otitis Media |
| EYE |
| CHOR = Chorioretinitis |
| KCNJ = Keratoconjunctivitis |
| GEN |
| ASPH = Asphyxiation |
| DEHY = Dehydration |
| HEAT = Heat Stress |
| NOGL = No Gross Lesions |
| STVN = Starvation |
| GI |
| ENTS = Enteritis |
| ETOX = Enterotoxemia |
| GULC = Gastric Ulcer |
| HINF = Hepatic Infarction |
| IMPN = Impaction |
| IPAR = Internal Parasite Infestation |
| NENT = Necrotic Enteritis |
| RPRO = Rectal Prolapse |
| INTG |
| ABS = Abscess |
| DER = Dermatitis |
| ECTO = Ectoparasite Infestation |
| LAC = Laceration |
| RING = Ringworm |
| PAPL = Papillomatosis (warts) |
| MS |
| DISJ = Dislocated Joint |
| DSCH = Dyschondroplasia |
| FBON = Fractured Bone |
| LMNS = Laminitis |
| MNEC = Muscle Necrosis |
| MYS = Myositis |
| OSTM = Osteomyelitis |
| SEPT = Septic Arthritis |
| SPDL = Spondylolisthesis |
| SPLY = Splay Leg |

TABLE 33-continued

| |
|---|
| TNSN = Tendonitis/Tenosynovitis |
| TRMA = Trauma |
| NEU |
| BABS = Brain/Spinal Cord Abscess |
| CINF = Cerebral Infarction |
| GMNC = Gray Matter Necrosis |
| RESP |
| BPNM = Bronchopneumonia |
| BRCH = Bronchitis |
| DPTH = Diptheria |
| PABS = Pulmonary Abscessation |
| PLRS = Pleuritis |
| RHNO = Rhinotracheitis |
| SNTS = Sinusitis |
| RNU |
| NEPH = Nephritis |
| PYEL = Pyelonephritis |
| RINF = Renal Infarction |
| ULTH = Urolithiasis |
| SYS |
| PTNT = Peritonitis |
| SPTM = Septicemia |
| OTHER |
| OTHER = used for any unlisted systems or findings/diagnosis |

[1]Findings were not confirmed by culture and/or isolation, but gross lesions were consistent with a particular disease or condition

Results

In accordance with the treatments and doses and the study protocol outlined above, various *Bacillus* strain combinations were tested in the domestic pig *Sus scrofa* for their effects on and ability to reduce the impact of post weaning diarrhea in pigs, as measured by fecal scores and various aspects of feed intake, penn weight and weight gain. The data and analysis is depicted in various figures.

Fecal scores, using a 1 (none) to 5 (severe) scoring system as provided above, were assessed for various treatments and doses, particularly of combinations of *bacillus* bacteria strains. Results are graphed in FIG. 21A and tabulated in FIG. 21B. Comparisons of each of the following were assessed: T01 (control—no antibiotic), T02 (conventional—Tylan antibiotic), T08 (BSUB20025+BSUB19105+BAMY19006), TO9 (BSUBI19105+BAMY19006+BAMY20071), T10 (BSUB20025+BAMY20071), T11 (BSU1B20025+BSUB19105) and T12 (BSUB19105+BAMY19006). The T09 combination of strains BSUB19105+BAMY19006+BAMY20071 (105+6+71) showed improvement and reduced fecal scores versus the control.

Figure 22:
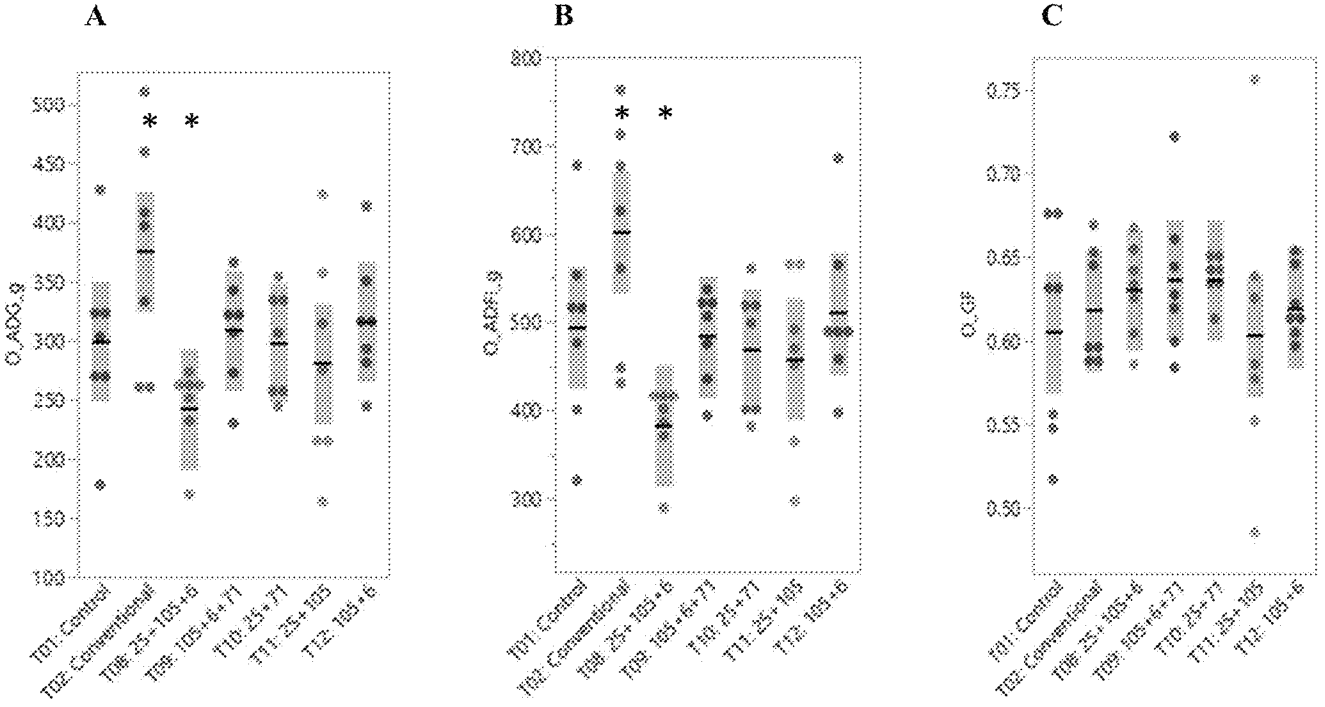

Pen performance was evaluated for several parameters. Average daily gain (ADG) in grams (g) body weight of pen animals is graphed for various treatments in FIG. 22A. Average daily feed intake (ADFI) in grams (g) is graphed for various treatments in FIG. 22B. The gain:feed results are graphed in FIG. 22C. FIG. 22D provides an overall comparison of final body weight (BW), ADG, ADFI and Gain: Feed ratio versus control, with better % vs control indicated by a color coding (blue better, red worse vs control). T01 conventional (antibiotic) provided the highest final body weight, ADFG and ADFI versus control. T12 (105+6) and T09 (105+6+71) both showed improvement in final BW and in ADG versus control. T12 (105+6) was also somewhat improved versus control in ADFL Gain:Feed was improved with T09 (105+6+71), T10 (25+71) and T08 (25+105+6), even over conventional feed. T12 showed about the same improvement in Gain:Feed as conventional versus control.

Figure 23:
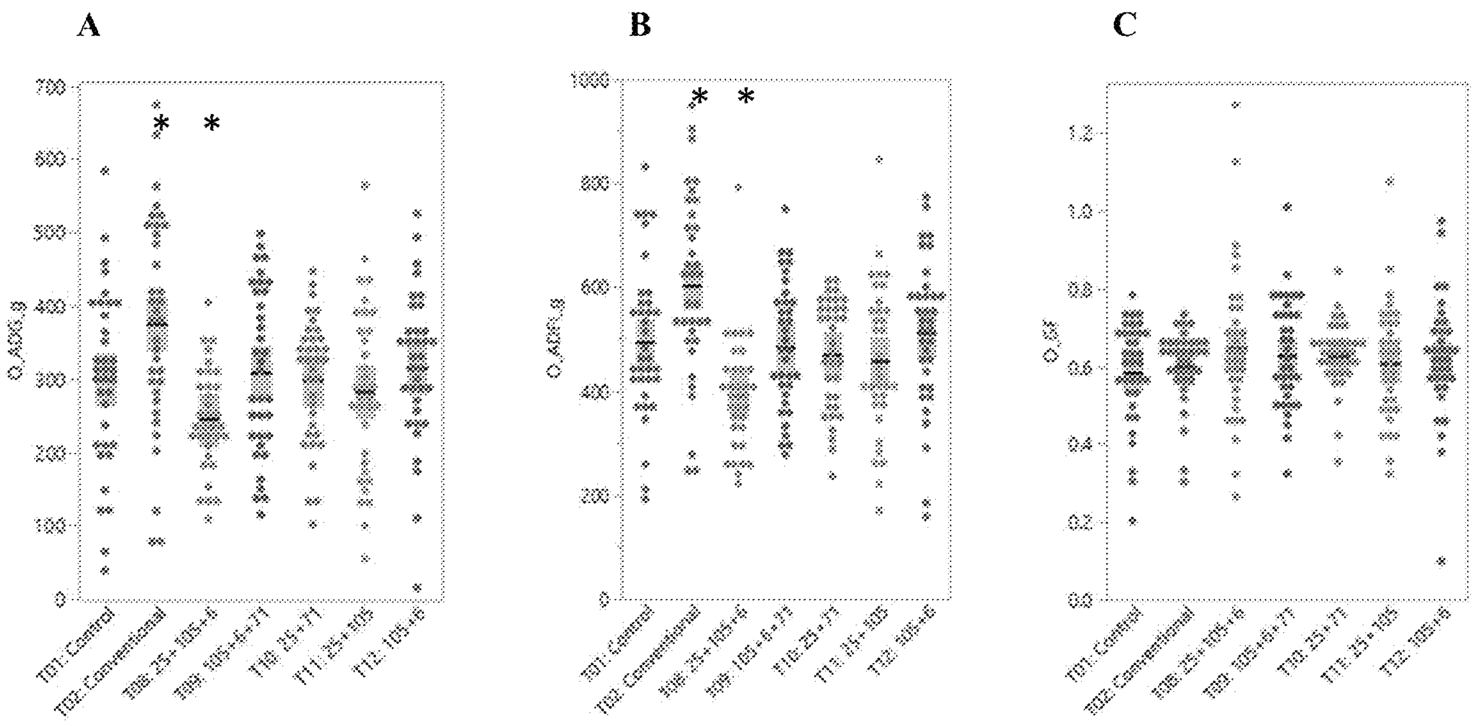

Individual performance was evaluated for several parameters. Average daily gain (ADG) in grams (g) body weight of individual animals is graphed for various treatments in FIG. 23A. Average daily feed intake (ADFI) in grams (g) is is graphed for various treatments in FIG. 23B. The gain:feed results are graphed in FIG. 23C. FIG. 23D provides an overall comparison of final body weight (BW), ADG, ADFI and Gain:Feed ratio versus control, with better % vs control indicated by a color coding. T01 conventional (antibiotic) provided the highest final body weight, ADFG and ADFI versus control. T12 (105+6) and T09 (105+6+$^{71}$) both showed some improvement in final BW and in ADG versus control. T12 (105+6) was also somewhat improved versus control in ADFI. Gain:Feed was most improved with T09 (105+6+71) and T10 (25+71) even over conventional feed. T08 (25+105+6) showed about the same improvement in Gain:Feed as conventional versus control.

The study results show that bacilli were more effective in smaller piglets. The above performance parameters were evaluate for smaller piglets vs larger piglets. FIG. 24A graphs ADG under the treatment conditions for phase 1 in animals 4-5.67 kg body weight and in larger animals 5.67-7.91 kg. In the smaller piglets, T09 (strains 105+6+71), T11 (strains 25+105) and T12 (strains 105+6) each performed as well as piglets with conventional antibiotic T02. Overall results in smaller piglets (3.9-5.7 kg) and in larger piglets (5.7-7.9 kg) are depicted and color coded vs control (blue being better, red being worse) in FIG. 24B. Again, in smaller piglets, T09 (strains 105+6+71), T11 (strains 25+105) and T12 (strains 105+6) each performed well and comparable or nearly comparable to small piglets with conventional antibiotic T02.

Additional results showing more effectiveness of bacilli in smaller piglets are provided in FIGS. 25A and 25B. Again, a combination of strains 105+6 (T12) or of strains 105+6+71 (T09) provided average daily gain (ADG) on par with conventional (Tylan antibiotic) in small piglets (4-5.32 kg body weight).

A similar weight-dependent effect was observed in a further study additionally conducted as depicted in FIG. 26. In this study individual *bacillus* strains were evaluated and administered alone. All individual *bacillus* strains tested demonstrated an increase over control (+18% to +29% vs control) in small piglets (4.33-6.26 kg body weight). *B. amyloliquefaciens* strains 24 and 64 were evaluated alone and showed increased ADO vs control. *B. subtilis* strains 105, 25 and 66 were evaluated alone and showed increased ADG.

These studies demonstrate reduced post-weaning diarrhea in an improvement in fecal scores in piglets treated with *bacillus* strains and an overall improvement in individual and in pen performance, including in aspects of average daily gain (ADG), final body weight (BW), average daily food intake (ADFI) and gain:feed ratios in animals treated with or administered *bacillus* strains. These improvements were most significant in small piglets with a lower body weight—in the range of 4 kg or a bit less to 6 kg or less. A combination of *bacillus* strains *B. subtilis* 105 (BSUB19105) and *B. amyloliquefaciens* 6 (BAMY19006) and a combination of *bacillus* strains *B. subtilis* 105 (BSUB19105), *B. amyloliquefaciens* 6 (BAMY 19006) and *B. amyloliquefaciens* 71 (BAMY20071) demonstrated effectiveness on the order of conventional (antibiotic), particularly in small piglets.

Example 1.5

Evaluation and Dose Titration in Piglets

A combination of *bacillus* strains *B. subtilis* 105 (BSUB19105), *B. amyloliquefaciens* 6 (BAMY19006) and *B. amyloliquefaciens* 71 (BAMY20071)—denoted 105+6+71 was further evaluated in in vivo piglet studies. The studies were conducted in line with and in accordance with the protocols described and detailed in Example 14. A dose titration of the *B. subtilis* plus *B. amyloliquefaciens* strain combination 105+6+71 was conducted. The 105+6+71 (noted as Blend B) was compared to a distinct combination of alternative bacteria (noted as Blend A) in a phased study in line with the study conducted in Example 14. Phase 1 represented days 0 to 7, Phase 2 represents days 7 to 21 and Phase 3 represents days 21 to 42, as depicted above in TABLE 26, Control animals T01 were without antibiotic or pharmacological levels of Zn and T02 animals were administered Zn from ZnO. In testing T03 through T08, total doses (CFU/g) of Blend A or of Blend B (strains 105+6+71) of either 75K (75,000), 150K (150,000) or 300K (300,000) were administered. A description of the study is tabulated in FIG. 27.

Pen performance days 0-21 was again evaluated for several parameters. Average daily feed intake (ADFI) in grams (g) is graphed for the various treatments in FIG. 28A. Average daily gain (ADG) in grams (g) body weight of pen animals is graphed for the various treatments in FIG. 28B. The gain:feed results are graphed in FIG. 28C. Blend B (strains 105+6+71) performed at least as well and in most instances better than an alternate Blend A. The optimal dose of Blend B was lower at at 75K. In gain:feed the lower 75K dose of 105+6+71 strains provided the best results of any blend or dose and was near that of the ZnO administration.

Figure 29D:
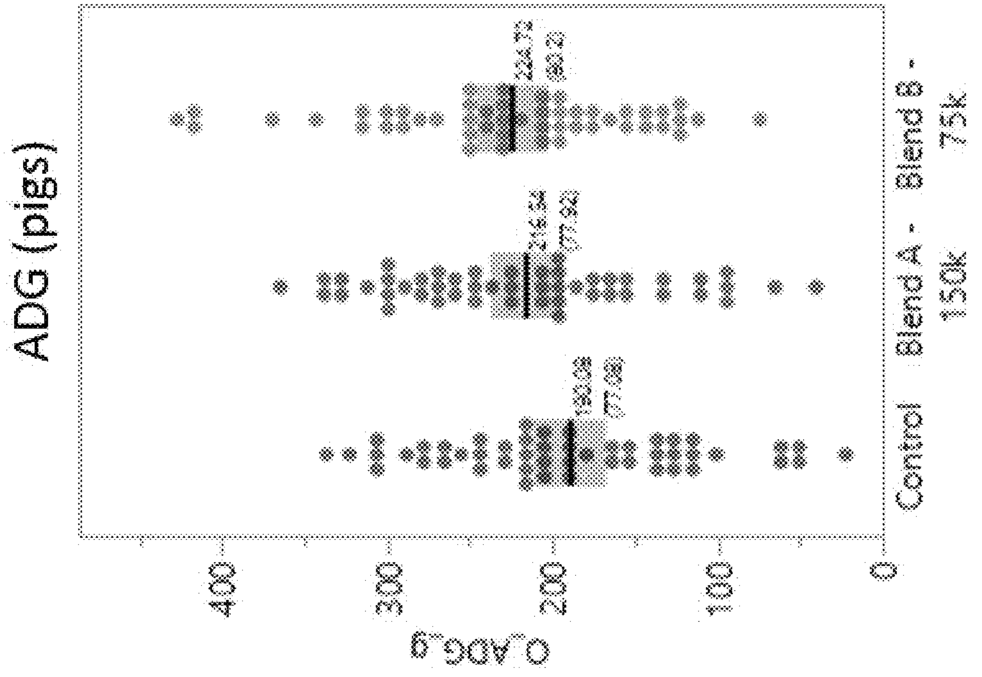

The optimal Blend B dose of 75K was compared directly with the higher optimal dose of 150K of Blend A. The results are depicted in FIG. 29. Average daily feed intake (ADFI) for the pen in grams (g) is graphed for the control versus the Blend A and Blend B optimum doses in FIG. 29A. Average daily gain (ADG) for the pen in grams (g) body weight of pen animals is graphed for the various treatments in FIG. 29B. The gain:feed for the pen results are graphed in FIG. 29C. FIG. 29D provides a comparison of the ADG for the pigs. The results are compared quantitatively in FIG. 29E. Both Blend A and Blend B performed better than the control, and notably the lower dose of Blend B (105+6+71) performed the best overall.

Bodyweight uniformity at Day 21 was assessed with Blend B and Blend A at each of the 75K, 150K and 300K doses and is depicted in FIG. 30. The percentage (%) of pigs with bodyweight within 15% of pen average is provided. Again, the Blend B lower dose 75K performed the best.

In summary, Dose Titration Results (first 21 days)

Blend A (150 k CFU/g) improved ADG by 14% and G:F by 3.9%. Blend B (75 k CFU/g) improved ADG by 18% and G:F by 6.8%. Blend B improved BW uniformity, while Blend A did not.

Previous POC Results (42 Days)

Blend A (100 CFU/g) improved ADG by 1.7% and G:F by 6.7%. Blend B (100 CFU/g) improved ADG by 3.2% and G:F by 5.2%

Conclusions

Blend B is showing slightly better efficacy than Blend A at a lower optimal dose A similar dose response was determined by comparison of 75K, 150K and 300K doses of strain combination 105+6+71 in poultry when compared to swine (piglets). These results are depicted in FIG. 31.

To confirm the compatibility of the strains *B. subtilis* 105 (BSUB19105), *B. amyloliquefaciens* 6 (BAMYI19006), *B. amyloliquefaciens* 24 (strain ELA 191024) and *B. amyloliquefaciens* 71 (BAMY20071) a bacteria compatability test was conducted. Combinations of two of each of the strains were assessed. The results are shown in FIG. 32. One strain is streaked perpendicular to the other strain. A clearance zone in the intersection of the strains suggests strain incompatibility. Compatibility of the two strains tested is demonstrated if there is no clearance zone. Each of strains *B. subtilis* 105 (BSUB19105), *B. amyloliquefaciens* 6 (BAMY19006), *B. amyloliquefaciens* 24 (strain ELA191024) and *B. amyloliquefaciens* 71 (BAMY20071) are compatible with one another.

Example 16

Evaluation and Dose Titration in Chickens

A combination of *bacillus* strains *B. subtilis* 105 (BSUB19105), *B. amyloliquefaciens* 6 (BAMY19006) and *B. amyloliquefaciens* 71 (BAMY20071)—denoted 105+6+71 was further evaluated in in vivo broiler chicken studies. The studies were conducted in line with and in accordance with the protocols described and detailed in Example 13.

A dose titration study was conducted. The treatment groups and dosing for the different groups of animals in the study are depicted in TABLE 34. Treatment groups T01 and T02 were given a basal diet. T02 was challenged with necrotic enteritis challenge as were treatment groups T03-T08. For the necrotic enteritis (NE) challenge, animals were administered by gavage (through a tube leading down the throat to the stomach) 10,000 oocytes of *Eimeria maxima* (*E. maxima*). Note that treatment group T03 was given BMD (Bacitracin Methylene Disalicylate), a Type A medicated article (antibiotic mixture) used for the prevention of necrotic enteritis, to maintain increased weight gain and to improve feed efficiency in poultry. 50K, 100K, 200K, 400K and 600K doses (CFU/g) of strain combination 105+6+71 (*B. subtilis* 105 (BSUB19105), *B. amyloliquefaciens* 6 (BAMY19006) and *B. amyloliquefaciens* 71 (BAMY20071)) were administered in groups T04, T05, T06, T07 and T08 respectively.

TABLE 34

| TG | Challenge | Diet | Total Dose (CFU/g) | Dose/Strain (CFU/g) | Pens | Birds | Total |
|---|---|---|---|---|---|---|---|
| T01 | None | Basal | 0 | 0 | 15 | 18 | 270 |
| T02 | NE | Basal | 0 | 0 | 15 | 18 | 270 |
| T03 | NE | BMD | 0 | 0 | 15 | 18 | 270 |
| T04 | NE | DFM | 50k | 17k | 15 | 18 | 270 |
| T05 | NE | DFM | 100k | 33k | 15 | 18 | 270 |
| T06 | NE | DFM | 200k | 67k | 15 | 18 | 270 |
| T07 | NE | DFM | 400k | 133k | 15 | 18 | 270 |
| T08 | NE | DFM | 600k | 200k | 15 | 18 | 270 |
| | | | | | 120 | | 2,160 |

TABLE 35 depicts the Effect sizes detectable for pairwise combinations (P<0.05, 80% Power, One-tailed test).

TABLE 35

| | ADG | FCR | EBI | Lesion Scores |
|---|---|---|---|---|
| 6 Doses (n = 15) | 5.6% | 3.3% | 11.7% | 60.0% |
| DLL Target | | 3.6% | | |
| Previously Observed | 2-8% | 0-8% | 0-16% | 14-34% |

TABLE 36 depicts the Simulated Power for Linear Regression of ADG (Average Daily Gain) (+1% ADG per 100 CFU, p<0.05).

TABLE 36

| Design | Group N | Total N | Power | Avg. R |
|---|---|---|---|---|
| 6 Doses | 15 | 90 | 98.8% | 0.437 |

On Day 23, fecal oocyst counts of K maxima were evaluated. The results are depicted in FIGS. 33 A and B. Doses of 100K and 600K showed significance at *<0.001, the 50K dose showed one effectiveness at p<0.01 (FIG. 33A). 50K, 100K and 600K doses of 105+6+71 demonstrated greater reduction in the number of oocytes per gram feces vs the BMD antibiotic mix (FIG. 33B).

Evaluations of mortalities due to necrotic enteritis at days 22-27 are shown in FIG. 34 A-C. Again the 50K and 100K doses provided the greatest reduction in % mortality compared to control. Oocyte counts were correlated with NE mortality. Results are provided in FIG. 35 A-B.

Of the doses evaluated, the optimal dose was determined to be 100K CFU/g or 105+6+71. Efficacy of the *bacillus* combination at the optimal 100K CFU/g was further evaluated. Unchallenged, and challenged control, BMD or *Bacillus* 100K were assessed, with the results depicted in FIG. 36A-E. Mortality, FCR (feed conversion ratio), mortality-adjusted FCR and EBI (European Broiler Index) were determined. The *Bacillus* combo significantly reduced mortality % and FCR. The EBI was significantly increased with the *bacillus* probiotic combination.

Unadjusted performance and ADFI (average daily feed intake), ADG (average daily gain) and FCR (feed conversion ratio) for unchallenged, control, BMD administered, and the *bacillus* 105+6+71 combination at doses 50K, 100K, 200K, 400K and 600K is provided in FIG. 37. Mortality adjusted performance and MA-ADFI (average daily feed intake), MA-ADG (average daily gain) and MA-FCR (feed conversion ratio) for unchallenged, control. BMD administered, and the *bacillus* 105+6+71 combination at doses 50K, 100K, 200K, 400K and 600K is provided in FIG. 38.

Unchallenged, control, BMD administered, and the *bacillus* 105+6+71 combination at doses 50K, 100K, 200K, 400K and 600K evaluated for total production and Total Live Weight and EBI (European Broiler Index) is depicted in FIG. 39A-B. Again the *bacillus* strain 105+6+71 combination showed the best performance and production at the 100K dose.

Unadjusted performance and % mortality, ADFI, ADG and FCR for unchallenged, control, BMD administered, and the *bacillus* 105+6+71 combination at doses 50K, 100K, 200K, 400K and 600K is provided in FIG. 40. Mortality adjusted performance and % mortality, MA-ADFI, MA-ADG and MA-FCR for unchallenged, control, BMD administered, and the *bacillus* 105+6+71 combination at doses 50K, 100K, 200K, 400K and 600K is provided in FIG. 41.

Feed efficiency dose response was assessed and the results are shown on FIG. 42 A-C for FCR, MA-FCR and EBL Example 17

Metabolite and Genome Analysis of *Bacillus* Strains

Metabolite analysis was conducted on the strains ELA1901105 (also denoted strain 105), ELA2002071 (also denoted strain 71) or ELA2001006 (also denoted strain 6). These strains make up a preferred combination of probiotic *bacillus* strains.

TABLE 37 provides analysis of the presence or absence of certain natural antibiotics/antibacterials or bacteriocins in the 105 (ELA1901105), 71 (ELA2002071) and 6 (ELA2001006) strains.

TABLE 37

| Class | ELA191105 | ELA202071 | ELA191006 |
|---|---|---|---|
| 132.2; LCI | Absent | Present | Present |
| Lanthipeptide_class_II | Absent | Absent | Present |
| 266.1; Amylocyclicin | Absent | Present | Present |
| 318.1; ComX1 | Absent | Absent | Present |
| 216.2; Subtilosin_(SboX) | Present | Absent | Absent |
| 492.1; Competence | Present | Absent | Absent |
| 490.1; Pumilarin | Absent | Absent | Absent |
| 225.2; UviB | Absent | Absent | Absent |
| 294.1; Plantathiazolicin_(Plantazolicin) | Absent | Present | Absent |
| 54.1; LichenicidinVK21A1_(Lichenicidin_A1) | Absent | Absent | Absent |
| 121.1; Sporulation-killingfactor_skfA | Absent | Absent | Absent |
| 321.1; ComX4 | Absent | Present | Absent |
| 145.1; Subtilosin_A | Absent | Absent | Absent |
| 127.1; Sublancin_168 | Absent | Absent | Absent |

Small peptides have powerful biological activities ranging from antibiotic to immune suppression. Some of these peptides are synthesized by Non Ribosomal Peptide Synthetases (NRPS) (Challis GL and Naismith JH (2004) Cur Opin Struct Biol 14(6):748-756). While the vast majority of peptide bond formation is catalyzed by ribosomes, the catalysis of peptide bond formation by NRPS is of importance and relevance. Some of the most well known examples of molecules made by NRPS illustrate the importance of NRPS systems. The antibiotic vancomycin and its analogues have very complex structures made by NRPS and associated enzymes. Indeed, almost all peptide based antibiotics are made by NRPS. Chelation of iron by bacteria is vital for their survival and is often a virulence determinant in pathogens. NRPS synthesize macrocycles such as enterobactin, which have an extraordinary high iron affinity. Cyclosporin, an immune suppressor and the potent anti tumour compound bleomycin are both made by NRPS. The molecules made by NRPS are often cyclic, have a high density of non-proteinogenic amino acids, and often contain amino acids connected by bonds other than peptide or disulfide bonds. NRPS are now known to be very large proteins and, despite the obvious complexity of the products, consist of a series of repeating enzymes fused together.

The non-ribosomal peptide synthetases are modular enzymes that catalyze synthesis of important peptide products from a variety of standard and non-proteinogenic amino acid substrates. Within a single module are multiple catalytic domains that are responsible for incorporation of a single residue. After the amino acid is activated and covalently attached to an integrated carrier protein domain, the substrates and intermediates are delivered to neighboring catalytic domains for peptide bond formation or, in some modules, chemical modification. In the final module, the peptide is delivered to a terminal thioesterase domain that catalyzes release of the peptide product. (Miller BR and Gulick AM (2016) Methods Mol Biol 1401:3-29).

The probiotic *bacillus* strains of the invention include numerous NRPS and also predicted proteins which are expected to be synthesized by NRPS A tabulation of certain of certain proteins is provided in TABLE 38.

TABLE 38

| ELA1901105 | ELA2002071 | ELA2001006 |
|---|---|---|
| NRPS | NRPS | NRPS |
| NRPS | NRPS | NRPS |
| | NRPS | NRPS |
| | NRPS | |
| NRPS, betalactone | | |
| CDPS | | |
| head_to_tail, sactipeptide | | |
| transAT-PKS, PKS-like, T3PKS, transAT-PKS-like, NRPS | | |
| | transAT-PKS, T3PKS, transAT-PKS-like, NRPS | transAT-PKS, T3PKS, transAT-PKS-like, NRPS |
| | | NRPS, transAT-PKS |

TABLE 38-continued

| ELA1901105 | ELA2002071 | ELA2001006 |
|---|---|---|
| | NRPS, bacteriocin | NRPS, bacteriocin |
| | NRPS, transAT-PKS, betalactone | NRPS, transAT-PKS, betalactone |
| | PKS-like | PKS-like |
| | transAT-PKS | transAT-PKS |
| | transAT-PKS-like, transAT-PKS | |
| | | transAT-PKS-like |
| | | transAT-PKS-like |
| | | lanthipeptide |
| | LAP | |
| terpene | terpene | terpene |
| terpene | terpene | terpene |
| T3PKS | T3PKS | T3PKS |
| other | other | other |

The presence of certain predicted proteins and secondary metabolites is indicated with the number of predicted such type proteins provided in parenthesis below in TABLE 39.

TABLE 39

| | ELA191105 (strain 105) | ELA2002071 (strain 71) | ELA191006 (strain 6) |
|---|---|---|---|
| CDPS | Present (1) | — | — |
| LAP | — | Present (1) | — |
| NRPS | Present (2) | Present (2) | Present (1) |
| NRPS,PKS-like, T3PKS, transAT-PKS, transAT-PKS-like | Present (1) | — | — |
| NRPS, T3PKS, transAT-PKS, transAT-PKS-like | — | Present (1) | Present (1) |
| NRPS, bacteriocin | — | Present (1) | Present (1) |
| NRPS, betalactone | Present (1) | — | — |
| NRPS, betalactone, transAT-PKS | — | Present (1) | Present (1) |
| NRPS, transAT-PKS | — | Present (1) | Present (1) |
| PKS-like | — | Present (1) | Present (1) |
| T3PKS | Present (1) | Present (1) | Present (1) |
| head_to_tail, sactipeptide | Present (1) | — | — |
| lanthipeptide | — | — | Present (1) |
| terpene | Present (2) | Present (2) | Present (2) |
| transAT-PKS | — | Present (1) | Present (1) |
| transAT-PKS, transAT-PKS-like | — | Present (1) | Present (1) |
| other | Present (1) | Present (1) | Present (1) |

No plasmids were identified in any of the strains ELA11901105 (also denoted strain 105), ELA2002071 (also denoted strain 71) or ELA2001006 (also denoted strain 6) by analysis of the whole genome sequences.

Analysis of the predicted proteins from the whole genome sequencing of the *Bacillus* strains was conducted. Certain results are provided below in TABLE 40.

TABLE 40

| Database #FILE | ELA191105 | ELA202071 | ELA191006 |
|---|---|---|---|
| NUM_FOUND | 5 | 3 | 5 |
| aadK_1 | 99.77 | — | 75.20 |
| fosB1_1 | 96.16 | — | — |
| mph(K)_1 | 100.00 | — | 86.43 |
| tet(L)_5 | 100.00 | 100.00 | 100.00 |
| tetB(60)_1 | 33.68 | — | — |

TABLE 40-continued

| Database #FILE | ELA191105 | ELA202071 | ELA191006 |
|---|---|---|---|
| cfr(B)_3 | — | 100.00 | 98.67 |
| fosB 5 | — | 97.36 | 97.36 |

Further analysis of predicted proteins from the whole genome sequencing of the *Bacillus* strains was conducted. Certain results are provided below in TABLE 41.

TABLE 41

| | VFDB | | |
|---|---|---|---|
| Database #FILE | ELA1901105 (strain 105) | ELA2002071 (strain 71) | ELA2001006 (strain 6) |
| NUM_FOUND | 19 | 21 | 20 |
| bslA/yuaB | 100.00 | 74.73 | 74.73 |
| cap8D | 32.84 | 25.60 | 25.66 |
| capB | 64.23 | 67.46 | 67.46 |
| capC | 99.78 | 100.00 | 100.00 |
| cdsN | 40.86 | 41.01 | 41.08 |
| clpC | 95.01 | 95.29 | 95.29 |
| clpE | 64.28 | 25.56; 21.61 | 21.61; 25.56 |
| clpP | 93.47 | 92.13 | 92.13 |
| cps41 | 72.68 | — | — |
| cpsA | 32.84 | 32.60 | 32.60 |
| cpsJ | 33.18 | 28.79 | 24.40 |
| essC | 15.72 | — | 16.31 |
| fliP | 25.58 | 25.58 | 25.58 |
| hasC | 42.73 | 27.32 | 27.32 |
| htpB | 96.67 | 97.64 | 97.40 |
| katA | 65.87 | 52.54 | 52.54 |
| IplA1 | 49.60 | 76.71 | 45.98 |
| oatA | 22.69 | — | — |
| ureB | 80.00 | 79.01 | — |
| cap8P | — | 55.58 | 55.50 |
| capA | — | 20.06 | 20.06 |
| flhA | — | 17.93 | 17.93 |
| pvdL | — | 1.73 | 1.75; 1.75 |
| pvdD | — | 4.97; 2.42 | — |

Further analysis of predicted antioxidant proteins from the sequence analysis of the *Bacillus* strains was conducted. Certain results are provided below in TABLE 42.

TABLE 42

Antioxidant prediction. Putative genes encoding antioxidant in the genomes of three *Bacillus* strains

| Description | Accession Number | *B. amyloliquefaciens* BAMY006 | *B. amyloliquefaciens* BAMY071 | *B. subtilis* PTA-86 (strain 105; BSUB105) |
|---|---|---|---|---|
| Alkyl hydroperoxide reductase C | UniRef100_P80239 | PRESENT | PRESENT | NA |
| | UniRef100_O34564 | NA | NA | PRESENT |
| | UniRef100_P80239 | NA | NA | PRESENT |
| Glutathione peroxidase BsaA | UniRef100_P40581 | NA | PRESENT | NA |
| Hydroperoxy fatty acid reductase | UniRef100_P40581 | PRESENT | NA | NA |
| gpx1 | UniRef100_P40581 | NA | NA | PRESENT |
| Organic hydroperoxide resistance | UniRef100_O34777 | PRESENT | NA | NA |
| transcriptional regulator | UniRef100_O34777 | PRESENT | NA | NA |
| | UniRef100_O34777 | NA | NA | PRESENT |
| Peroxide operon regulator | Q2G282 | PRESENT | PRESENT | NA |
| | Q2G282 | NA | NA | PRESENT |
| Sporulation thiol-disulfide | UniRef100_O31687 | PRESENT | PRESENT | NA |
| oxidoreductase A | UniRef100_O31687 | NA | NA | PRESENT |
| Superoxide dismutase [Mn] | UniRef100_P49114 | PRESENT | PRESENT | NA |
| | UniRef100_P49114 | NA | NA | PRESENT |
| Thiol peroxidase | UniRef100_P80864 | PRESENT | PRESENT | NA |
| | UniRef100_P80864 | NA | NA | PRESENT |
| Thiol-disulfide oxidoreductase | UniRef100_P35160 | PRESENT | PRESENT | NA |
| ResA | UniRef100_O31820 | PRESENT | PRESENT | NA |
| | UniRef100_O31820 | NA | NA | PRESENT |
| | UniRef100_P35160 | NA | NA | PRESENT |
| Thiol-disulfide oxidoreductase | UniRef100_O31699 | PRESENT | PRESENT | NA |
| Yku V | UniRef100_O31699 | NA | NA | PRESENT |
| Vegetative catalase | UniRef100_Q64405 | PRESENT | PRESENT | NA |
| | UniRef100_Q64405 | NA | NA | PRESENT |

Toxin or Antitoxin prediction is provided below in TABLE 43.

TABLE 43

| Uniprot_id | description | ELA191105 | ELA202071 | ELA191006 |
|---|---|---|---|---|
| P96621 | Antitoxin EndoAI | BSUB105_00523 (also denoted JS609_00513) | BVEN2071_02649 (also denoted BVEN71_03490) | BVEN6_02737 (also denoted BAMY06_03619) |
| P96622 | Endoribonuclease EndoA | BSUB105_00524 (also denoted JS609_00514) | BVEN2071_02650 (also denoted BVEN71-03489) | BVEN6_02738 (also denoted BAMY06_03618) |

Digestive enzymes include enzymes that cleave cell wall or cell membrane components, particularly of bacteria. Among these are for instance lysins which are cell wall hydrolases and often are found on and encoded by bacteriophages. The activities of lysins can be classified into two groups based on bond specificity within the peptidoglycan: glycosidases that hydrolyze linkages within the aminosugar moieties and amidases that hydrolyze amide bonds of cross-linking stem peptides. (Fischetti V A et al (2006) Nat Biotechnol 24(12):1508-11). Predicted digestive enzymes in the *bacillus* strains based on sequence analysis are provided in TABLE 44 below.

Strains were compared for various other components and particularly antimicrobial resistance genes as shown below in TABLE 45.

TABLE 44

Predicted Digestive Enzymes identified in the genomes of *B. amyloliquefaciens* BAMY006 and BAMY071, and *B. subtilis* PTA-85 (percent identity >50 and alignment length percent >90)

| Gene Description | Accession Number | *B. amyloliquefaciens* BAMY006 | *B. amyloliquefaciens* BAMY071 | *B. subtilis* PTA-86 |
|---|---|---|---|---|
| 1,4-alpha-glucan branching enzyme GlgB | AGA22754.1 | NA | NA | JS609_03093 |
| 3-hydroxyacyl-[acyl-carrier-protein] dehydratase FabZ | QAT16354.1 | BAMY06_00446 | BAMY71_00468 | NA |
| 50S ribosomal protein L1 | QFI56506.1 | BAMY06_03980 | BAMY71_03857 | NA |
| | QFI56506.1 | NA | NA | JS609_00131 |
| 6-phospho-beta-galactosidase | AWG39028.1 | NA | BAMY71_02679 | NA |
| | QDK89482.1 | BAMY06_02843 | NA | NA |
| 6-phospho-beta-glucosidase GmuD | CDG27774.1 | NA | BAMY71_00235 | NA |
| | QAS06813.1 | NA | NA | JS609_00629 |
| | QDK91913.1 | BAMY06_00219 | NA | NA |

TABLE 44-continued

Predicted Digestive Enzymes identified in the genomes of *B. amyloliquefaciens* BAMY006 and BAMY071, and *B. subtilis* PTA-85 (percent identity >50 and alignment length percent >90)

| Gene Description | Accession Number | *B. amyloliquefaciens* BAMY006 | *B. amyloliquefaciens* BAMY071 | *B. subtilis* PTA-86 |
|---|---|---|---|---|
| Alpha-amylase | AIW36239.1 | NA | BAMY71_03662 | NA |
| | QAV82864.1 | NA | NA | JS609_00345 |
| | BAT21551.1 | BAMY06_03784 | NA | NA |
| Alpha-galactosidase | QEK97784.1 | NA | BAMY71_01110 | NA |
| | AIC99339.1 | NA | NA | JS609_03025 |
| | QDK91116.1 | BAMY06_01080 | NA | NA |
| Alpha-galacturonidase | ASB68722.1 | NA | NA | JS609_00767 |
| Arabinoxylan arabinofuranohydrolase | AAD30363.1 | BAMY06_02211 | BAMY71_02039 | NA |
| | AAD30363.1 | NA | NA | JS609_01919 |
| Aryl-phospho-beta-D-glucosidase BglA | CDG26179.1 | NA | BAMY71_01915 | NA |
| | QAW06324.1 | NA | NA | JS609_04055 |
| | QDK90194.1 | BAMY06_02089 | NA | NA |
| Aryl-phospho-beta-D-glucosidase BglC | CDG24623.1 | NA | BAMY71_03632 | NA |
| | ARV97270.1 | NA | NA | JS609_00386 |
| Aryl-phospho-beta-D-glucosidase BglH | CDG27827.1 | NA | BAMY71_00175 | NA |
| | QAS10023.1 | NA | NA | JS609_03976 |
| ATP synthase subunit alpha | QHB16940.1 | BAMY06_00401 | BAMY71_00424 | NA |
| | QHB16940.1 | NA | NA | JS609_03732 |
| Beta-glucanase | ATV02530.1 | NA | BAMY71_00202 | NA |
| | AID00207.1 | NA | NA | JS609_03959 |
| | AYL88759.1 | BAMY06_00186 | NA | NA |
| Beta-hexosaminidase | ANB82474.1 | NA | BAMY71_03774 | NA |
| | QAR91196.1 | NA | NA | JS609_00211 |
| | QDK88534.1 | BAMY06_03899 | NA | NA |
| Cephalosporin-C deacetylase | AHZ14331.1 | NA | BAMY71_03649 | NA |
| | QAS06568.1 | NA | NA | JS609_00359 |
| | QDK88655.1 | BAMY06_03770 | NA | NA |
| Cortical fragment-lytic enzyme | CCP20089.1 | NA | BAMY71_03967 | NA |
| | QBJ80577.1 | NA | NA | JS609_00022 |
| | ATC51419.1 | BAMY06_04090 | NA | NA |
| Cysteine synthase | AYA39814.1 | BAMY06_04025 | BAMY71_03902 | NA |
| | AYA39814.1 | NA | NA | JS609_00087 |
| Demethyllactenocin mycarosyltransferase | CDG24864.1 | NA | BAMY71_03378 | NA |
| | ARV97526.1 | NA | NA | JS609_00617 |
| | QDK88875.1 | BAMY06_03520 | NA | NA |
| Endo-1,4-beta-xylanase A | AQQ16389.1 | NA | BAMY71_00446 | NA |
| | ANJ02848.1 | NA | NA | JS609_01995 |
| | QDK91715.1 | BAMY06_00424 | NA | NA |
| Endoglucanase | CDG26057.1 | NA | BAMY71_02044 | NA |
| | NP_389695.1 | NA | NA | JS609_01916 |
| | QDK90074.1 | BAMY06_02216 | NA | NA |
| General stress protein A | AKF74877.1 | NA | BAMY71_00258 | NA |
| | AGA22706.1 | NA | NA | JS609_03892 |
| | QDK91887.1 | BAMY06_00245 | NA | NA |
| GlcNAc-binding protein A | QEQ03549.1 | BAMY06_02269 | BAMY71_02101 | NA |
| Glucose-1-phosphate adenylyltransferase | QHA28835.1 | NA | NA | JS609_03092 |
| Glucuronoxylanase XynC | CBL17903.1 | BAMY06_02212 | BAMY71_02040 | NA |
| | CBL17903.1 | NA | NA | JS609_01918 |
| Glycogen phosphorylase | AIX08721.1 | NA | NA | JS609_03089 |
| Glycogen synthase | QAW13524.1 | NA | NA | JS609_03090 |
| Intracellular maltogenic amylase | AMR45682.1 | NA | NA | JS609_03485 |
| L-Ala--D-Glu endopeptidase | QGH57794.1 | NA | BAMY71_00874 | NA |
| | QGI53236.1 | NA | NA | JS609_03258 |
| | QGT57119.1 | BAMY06_00853 | NA | NA |
| Maltose-6'-phosphate glucosidase | QGH55793.1 | NA | BAMY71_03140 | NA |
| | QGU25462.1 | NA | NA | JS609_00864 |
| | QDK89133.1 | BAMY06_03235 | NA | NA |
| Melibiose/raffinose/stachyose import permease protein MelC | QEK97784.1 | BAMY06_01081 | BAMY71_01111 | NA |
| | QEK97784.1 | NA | NA | JS609_03024 |
| Membrane-bound lytic murein transglycosylase F | CCP21108.1 | NA | BAMY71_02800 | NA |
| | ASB92721.1 | NA | NA | JS609_01215 |
| | QDK90428.1 | BAMY06_01817 | NA | NA |
| | QDK89432.1 | BAMY06_02899 | NA | NA |
| N-acetyl-alpha-D-glucosaminyl L-malate deacetylase 1 | ATV01518.1 | NA | BAMY71_01790 | NA |
| | AYE64850.1 | NA | NA | JS609_02193 |
| | QEQ03843.1 | BAMY06_01754 | NA | NA |
| N-acetyl-alpha-D-glucosaminyl L-malate synthase | ASS91714.1 | BAMY06_01755 | BAMY71_01791 | NA |
| | ASS91714.1 | NA | NA | JS609_02192 |
| N-acetylglucosamine-6-phosphate deacetylase | QGH58054.1 | NA | BAMY71_00603 | NA |
| | QAS09601.1 | NA | NA | JS609_03525 |
| | QDK91560.1 | BAMY06_00582 | NA | NA |
| | ATV02313.1 | NA | BAMY71_00532 | NA |

TABLE 44-continued

Predicted Digestive Enzymes identified in the genomes of *B. amyloliquefaciens* BAMY006 and BAMY071, and *B. subtilis* PTA-85 (percent identity >50 and alignment length percent >90)

| Gene Description | Accession Number | *B. amyloliquefaciens* BAMY006 | *B. amyloliquefaciens* BAMY071 | *B. subtilis* PTA-86 |
|---|---|---|---|---|
| N-acetylglucosaminyldiphosphoundecaprenol N- | AYE66149.1 | NA | NA | JS609_03617 |
| acetyl-beta-D-mannosaminyltransferase | QDK91629.1 | BAMY06_00513 | NA | NA |
| Oleandomycin glycosyltransferase | CDG26160.1 | NA | BAMY71_01935 | NA |
| | CDG29153.1 | NA | BAMY71_02666 | NA |
| | AIC97767.1 | NA | NA | JS609_01294 |
| | AKN14112.1 | NA | NA | JS609_02068 |
| | QDK90176.1 | BAMY06_02109 | NA | NA |
| | QDK89494.1 | BAMY06_02830 | NA | NA |
| Oligo-1,6-glucosidase | AJK66530.1 | NA | BAMY71_00985 | NA |
| | ASZ62584.1 | NA | NA | JS609_03151 |
| | AKD24292.1 | BAMY06_00965 | NA | NA |
| Oligo-1,6-glucosidase 1 | QAW18252.1 | NA | NA | JS609_03479 |
| Pectate lyase | AWG39450.1 | NA | BAMY71_03210 | NA |
| | AFP43210.1 | NA | NA | JS609_00804 |
| | QDK89071.1 | BAMY06_03304 | NA | NA |
| Pectate lyase C | AIC99792.1 | NA | NA | JS609_03519 |
| Pectin lyase | AWG40278.1 | NA | BAMY71_00178 | NA |
| | AKE23786.1 | NA | NA | JS609_01975 |
| | QDK91950.1 | BAMY06_00171 | NA | NA |
| Penicillin-binding protein 1A/1B | AWG38114.1 | NA | BAMY71_01806 | NA |
| | QCU15370.1 | NA | NA | JS609_02178 |
| | QDK90466.1 | BAMY06_01770 | NA | NA |
| Penicillin-binding protein 1F | CDG25272.1 | NA | BAMY71_02930 | NA |
| | QCU14315.1 | NA | NA | JS609_01067 |
| | QDK89310.1 | BAMY06_03028 | NA | NA |
| Penicillin-binding protein 2D | CDG27654.1 | NA | BAMY71_00358 | NA |
| | QGU22813.1 | NA | NA | JS609_03799 |
| | QDK91796.1 | BAMY06_00339 | NA | NA |
| Penicillin-binding protein 4 | AWG37355.1 | NA | BAMY71_00960 | NA |
| | ASB94693.1 | NA | NA | JS609_03174 |
| | QDK91217.1 | BAMY06_00940 | NA | NA |
| | CDG30505.1 | NA | BAMY71_01443 | NA |
| | CDG25227.1 | NA | BAMY71_02976 | NA |
| | QAW40980.1 | NA | NA | JS609_01025 |
| | QDK90813.1 | BAMY06_01407 | NA | NA |
| | QDK89265.1 | BAMY06_03074 | NA | NA |
| Peptidoglycan-N-acetylmuramic acid deacetylase | QEQ05952.1 | BAMY06_03250 | BAMY71_03156 | NA |
| PdaA | AFQ56715.1 | NA | NA | JS609_00844 |
| Peptidoglycan-N-acetylmuramic acid deacetylase PdaC | AIX06967.1 | NA | NA | JS609_01282 |
| Processive diacylglycerol beta-glucosyltransferase | AKF76366.1 | NA | BAMY71_01851 | NA |
| | QAV83859.1 | NA | NA | JS609_01417 |
| | AYE64796.1 | NA | NA | JS609_02138 |
| | QDK90264.1 | BAMY06_02009 | NA | NA |
| PTS system maltose-specific EIICB component | VEC47756.1 | BAMY06_03233 | BAMY71_03138 | NA |
| | VEC47756.1 | NA | NA | JS609_00866 |
| Pullulanase | AYA43052.1 | NA | NA | JS609_02990 |
| putative 6-phospho-beta-glucosidase | CCG51779.1 | NA | BAMY71_00249 | NA |
| | NP_391735.1 | NA | NA | JS609_03909 |
| | QDK91899.1 | BAMY06_00233 | NA | NA |
| putative esterase YxiM | AOY05484.1 | NA | NA | JS609_03964 |
| putative glycosyltransferase | QCV96123.1 | BAMY06_02752 | BAMY71_02600 | NA |
| | QCV96123.1 | NA | NA | JS609_01367 |
| putative glycosyltransferase YkoT | ASB41833.1 | NA | NA | JS609_01421 |
| putative oligo-1,6-glucosidase 2 | AJK64068.1 | NA | BAMY71_03680 | NA |
| | QAW02849.1 | NA | NA | JS609_00325 |
| | AMP32821.1 | BAMY06_03802 | NA | NA |
| | AHC40869.1 | BAMY06_03803 | NA | NA |
| putative protein YqbO | QAW41282.1 | NA | NA | JS609_01344 |
| putative rhamnogalacturonan acetylesterase YesY | ASZ60459.1 | NA | NA | JS609_00761 |
| Putative sporulation-specific glycosylase YdhD | AKF76978.1 | NA | BAMY71 02559 | NA |
| | CAB12390.2 | NA | NA | JS609_00616 |
| | NP_391282.1 | NA | NA | JS609_03425 |
| | QDK89600.1 | BAMY06_02712 | NA | NA |
| Rhamnogalacturonan acetylesterase RhgT | QFY87628.1 | NA | NA | JS609_00756 |
| Rhamnogalacturonan endolyase YesW | QAT44941.1 | NA | NA | JS609_00759 |
| Rhamnogalacturonan exolyase YesX | AIX06475.1 | NA | NA | JS609_00760 |
| Trehalose-6-phosphate hydrolase | AIW36656.1 | NA | BAMY71_03178 | NA |
| | NP_388662.1 | NA | NA | JS609_00827 |
| | AVX18210.1 | BAMY06_03273 | NA | NA |
| UDP-N-acetylglucosamine--N-acetylmuramyl- | AMR47346.1 | NA | NA | JS609_01610 |
| (pentapeptide) pyrophosphoryl-undecaprenol N-acetylglucosamine transferase | QDK89788.1 | BAMY06_02513 | BAMY71_02353 | NA |

TABLE 45

Putative antimicrobial resistance genes identified through genome analysis (percent identity >80 and percent coverage >95)

| *Bacillus* strain | Gene product | Gene id | % Coverage | % Identity | Accession number | Antibiotic Resistance |
|---|---|---|---|---|---|---|
| *B. amyloliquefaciens* BAMY006 | streptothricin N-acetyltransferase SatA | satA_Bs | 100 | 85.63 | NG_064662.1 | STREPTOTHRICIN |
| | tetracycline efflux MFS transporter Tet(L) | tet(L) | 100 | 86.64 | NG_048204.1 | TETRACYCLINE |
| | rifamycin-inactivating phosphotransferase RphC | rphC | 99.35 | 80.41 | NG_063825.1 | RIFAMYCIN |
| | 23S rRNA (adenine(2503)-C(8))-methyltransferase ClbA | clbA | 100 | 96.86 | NG_062350.1 | LINCOSAMIDE; MACROLIDE; STREPTOGRAMIN |
| *B. amyloliquefaciens* BAMY071 | streptothricin N-acetyltransferase SatA | satA_Bs | 100 | 84.1 | NG_064662.1 | STREPTOTHRICIN |
| | tetracycline efflux MFS transporter Tet(L) | tet(L) | 100 | 86.78 | NG_048204.1 | TETRACYCLINE |
| | tetracycline efflux MFS transporter Tet(L) | rphC | 99.35 | 80.52 | NG_063825.1 | RIFAMYCIN |
| | 23S rRNA (adenine(2503)-C(8))-methyltransferase ClbA | clbA | 100 | 99.14 | NG_062350.1 | LINCOSAMIDE; MACROLIDE; STREPTOGRAMIN |
| *B. subtilis* PTA-86 | macrolide 2'-phosphotransferase MphK | mphK | 100 | 97.72 | NG_065846.1 | MACROLIDE |
| | ABC-F type ribosomal protection protein VmlR | vmlR | 100 | 98.66 | NG_063831.1 | LINCOSAMIDE; STREPTOGRAMIN; TIAMULIN |
| | rifamycin-inactivating phosphotransferase RphC | rphC | 99.39 | 82.18 | NG_063825.1 | RIFAMYCIN |
| | aminoglycoside 6-adenylyltransferase AadK | aadK | 99.77 | 98.12 | NG_047379.1 | STREPTOMYCIN |
| | streptothricin N-acetyltransferase SatA | satA Bs | 100 | 95.78 | NG_064662.1 | STREPTOTHRICIN |
| | tetracycline efflux MFS transporter Tet(L) | tet(L) | 100 | 100 | NG_048204.1 | TETRACYCLINE |

The 16S rRNA sequences of each of the ELA191006 and ELA2002071 bacteria strains are provided below:

ELA191006 16S rRNA sequence (BVEN6_C18)
(SEQ ID NO: 259)

```
TCGGAGAGTTTGATCCTGGCTCAGGACGAACGCTGGCGGCGTGCCTAAT

ACATGCAAGTCGAGCGGACAGATGGGAGCTTGCTCCCTGATGTTAGCGG

CGGACGGGTGAGTAACACGTGGGTAACCTGCCTGTAAGACTGGGATAAC

TCCGGGAAACCGGGGCTAATACCGGATGGTTGTCTGAACCGCATGGTTC

AGACATAAAAGGTGGCTTCGGCTACCACTTACAGATGGACCCGCGGCGC

ATTAGCTAGTTGGTGAGGTAACGGCTCACCAAGGCGACGATGCGTAGCC

GACCTGAGAGGGTGATCGGCCACACTGGGACTGAGACACGGCCCAGACT

CCTACGGGAGGCAGCAGTAGGGAATCTTCCGCAATGGACGAAAGTCTGA

CGGAGCAACGCCGCGTGAGTGATGAAGGTTTTCGGATCGTAAAGCTCTG

TTGTTAGGGAAGAACAAGTGCCGTTCAAATAGGGCGGCACCTTGACGGT

ACCTAACCAGAAAGCCACGGCTAACTACGTGCCAGCAGCCGCGGTAATA

CGTAGGTGGCAAGCGTTGTCCGGAATTATTGGGCGTAAAGGGCTCGCAG

GCGGTTTCTTAAGTCTGATGTGAAAGCCCCCGGCTCAACCGGGGAGGGT

CATTGGAAACTGGGGAACTTGAGTGCAGAAGAGGAGAGTGGAATTCCAC

GTGTAGCGGTGAAATGCGTAGAGATGTGGAGGAACACCAGTGGCGAAGG

CGACTCTCTGGTCTGTAACTGACGCTGAGGAGCGAAAGCGTGGGGAGCG

AACAGGATTAGATACCCTGGTAGTCCACGCCGTAAACGATGAGTGCTAA

GTGTTAGGGGGTTTCCGCCCCTTAGTGCTGCAGCTAACGCATTAAGCAC

TCCGCCTGGGGAGTACGGTCGCAAGACTGAAACTCAAAGGAATTGACGG
```

-continued

```
GGGCCCGCACAAGCGGTGGAGCATGTGGTTTAATTCGAAGCAACGCGAA

GAACCTTACCAGGTCTTGACATCCTCTGACAATCCTAGAGATAGGACGT

CCCCTTCGGGGGCAGAGTGACAGGTGGTGCATGGTTGTCGTCAGCTCGT

GTCGTGAGATGTTGGGTTAAGTCCCGCAACGAGCGCAACCCTTGATCTT

AGTTGCCAGCATTCAGTTGGGCACTCTAAGGTGACTGCCGGTGACAAAC

CGGAGGAAGGTGGGGATGACGTCAAATCATCATGCCCCTTATGACCTGG

GCTACACACGTGCTACAATGGACAGAACAAAGGGCAGCGAAACCGCGAG

GTTAAGCCAATCCCACAAATCTGTTCTCAGTTCGGATCGCAGTCTGCAA

CTCGACTGCGTGAAGCTGGAATCGCTAGTAATCGCGGATCAGCATGCCG

CGGTGAATACGTTCCCGGGCCTTGTACACACCGCCCGTCACACCACGAG

AGTTTGTAACACCCGAAGTCGGTGAGGTAACCT
```

*B. ayloliquefaciens* ELA2002071 16S-rRNA (BVEN2071_C21)
(SEQ ID NO: 260)

```
GGAGAGTTTGATCCTGGCTCAGGACGAACGCTGGCGGCGTGCCTAATAC

ATGCAAGTCGAGCGGACAGATGGGAGCTTGCTCCCTGATGTTAGCGGCG

GACGGGTGAGTAACACGTGGGTAACCTGCCTGTAAGACTGGGATAACTC

CGGGAAACCGGGGCTAATACCGGATGGTTGTCTGAACCGCATGGTTCAG

ACATAAAAGGTGGCTTCGGCTACCACTTACAGATGGACCCGCGGCGCAT

TAGCTAGTTGGTGAGGTAACGGCTCACCAAGGCGACGATGCGTAGCCGA

CCTGAGAGGGTGATCGGCCACACTGGGACTGAGACACGGCCCAGACTCC
```

-continued

```
TACGGGAGGCAGCAGTAGGGAATCTTCCGCAATGGACGAAAGTCTGACG
GAGCAACGCCGCGTGAGTGATGAAGGTTTTCGGATCGTAAAGCTCTGTT
TTGTTAGGGAAGAACAAGTGCCGTTCAAATAGGGCGGCACCTTGACGGT
ACCTAACCAGAAAGCCACGGCTAACTACGTGCCAGCAGCCGCGGTAATA
CGTAGGTGGCAAGCGTTGTCCGGAATTATTGGGCGTAAAGGGCTCGCAG
GCGGTTTCTTAAGTCTGATGTGAAAGCCCCCGGCTCAACCGGGGAGGGT
CATTGGAAACTGGGGAACTTGAGTGCAGAAGAGGAGAGTGGAATTCCAC
GTGTAGCGGTGAAATGCGTAGAGATGTGGAGGAACACCAGTGGCGAAGG
CGACTCTCTGGTCTGTAACTGACGCTGAGGAGCGAAAGCGTGGGGAGCG
AACAGGATTAGATACCCTGGTAGTCCACGCCGTAAACGATGAGTGCTAA
GTGTTAGGGGGTTTCCGCCCCTTAGTGCTGCAGCTAACGCATTAAGCAC
TCCGCCTGGGGAGTACGGTCGCAAGACTGAAACTCAAAGGAATTGACGG
GGGCCCGCACAAGCGGTGGAGCATGTGGTTTAATTCGAAGCAACGCGAA
GAACCTTACCAGGTCTTGACATCCTCTGACAATCCTAGAGATAGGACGT
CCCCTTCGGGGGCAGAGTGACAGGTGGTGCATGGTTGTCGTCAGCTCGT
GTCGTGAGATGTTGGGTTAAGTCCCGCAACGAGCGCAACCCTTGATCTT
AGTTGCCAGCATTCAGTTGGGCACTCTAAGGTGACTGCCGGTGACAAAC
CGGAGGAAGGTGGGGATGACGTCAAATCATCATGCCCCTTATGACCTGG
GCTACACACGTGCTACAATGGACAGAACAAAGGGCAGCGAAACCGCGAG
GTTAAGCCAATCCCACAAATCTGTTCTCAGTTCGGATCGCAGTCTGCAA
CTCGACTGCGTGAAGCTGGAATCGCTAGTAATCGCGGATCAGCATGCCG
CGGTGAATACGTTCCCGGGCCTTGTACACACCGCCCGTCACACCACGAG
AGTTTGTAACACCCGAAGTCGGTGAGGTAACCTTTTAGGAGCCAGCCGC
CGAAGGTGGGACAGATGATTGGGGTGAAGTCGTAACAAGGTAGCCGTAT
CGGAAGGTGCGGCTGGATCACCTCCTTT
```

Example 18

Safety and Muli-omics Characterization of Host-Derived *Bacillus* spp. Probiotics for Improved Growth Performance in Poultry Microbial feed ingredients or probiotics have been used widely in the poultry industry to improve production efficiency. Spore-forming *Bacillus* spp. offer advantages over traditional probiotic strains as *Bacillus* spores are resilient to high temperature, acidic pH, and desiccation. This results in increased strain viability during manufacturing and feed-pelleting processes, extended product shelf-life, and increased stability within the animal's gastrointestinal tract. Despite numerous reports on the use of *Bacillus* spores as feed additives, detailed characterizations of *Bacillus* probiotic strains are typically not published. Insufficient characterizations can lead to misidentification of probiotic strains in product labels, and the potential application of strains carrying virulence factors, toxins, antibiotic resistance, or toxic metabolites. Hence, it is critical to characterize in detail the genomic and phenotypic properties of these strains to screen out undesirable properties and to tie individual traits to clinical outcomes and possible mechanisms. Here, we report a screening workflow and comprehensive multi-omics characterization of *Bacillus* spp. for use in broiler chickens. Host-derived *Bacillus* strains were isolated and screened for desirable probiotic properties. The phenotypic, genomic and metabolomic analyses of three probiotic candidates, two *B. amyloliquefaciens* (Ba ATCC PTA126784 (ELA191024, strain 24) and ATCC PTA126785 (ELA191036, strain 36)), and a *B. subtilis* (Bs ATCC PTA12686 (ELA191105, strain 105)), showed that all three strains had promising probiotic traits and safety profiles. Inclusion of Ga ATCC PTA12684 (Ba-PTA84 (ELA91024, strain 24)) in the feed of broiler chickens resulted in improved growth performance, as shown by a significantly improved feed conversion ratio (3.3%), increased of European Broiler Index (6.2%), and increased average daily gain (3.5%). Comparison of the cecal microbiomes from Ba PTA84-treated and control animals suggested minimal differences in microbiome structure, indicating that the observed growth promotion presumably was not mediated by modulation of cecal microbiome.

Introduction

An increasing demand for poultry meat and egg has put significant pressure on the poultry industry to improve production efficiency. The Food and Agriculture Organization ofthe United Nations (FAO) projected that global meat and egg consumption will increase by 52 and 39%, respectively, in 2050 compared to 2012 (1). The challenge is further heightened by restrictions from European Union and United States regulatory bodies on the use of antibiotics as growth promoters (AGPs) and prophylactic care; this change is due to public health concerns related to the development and spread of antibiotic resistant bacteria (2, 3). Antibiotics have been used as AGPs for over half a century, aiding growth performance and controlling disease outbreaks (4).

For the above reasons, microbial feed ingredients, also called direct-fed microorganisms (DFMs) or probiotics, have attracted tremendous interest as an alternative to AGPs to support improved production efficiency. Probiotics are defined as "live microorganisms that, when administered in adequate amounts, confer a health benefit on the host" (5). Probiotics are believed to exert their benefits through the following proposed mechanisms: assisting with nutrition and digestion, competitive exclusion of pathogens, modulating the immune system and gut microbiota, improving epithelial integrity, and/or producing small molecule metabolites that are beneficial to the host (6, 7). In addition to the above probiotic effects, microorganisms used as probiotics must survive environmental and processing challenges prior to reaching their target site. This includes low acidity of the upper gastrointestinal tract (GIT), bile acid toxicity, and heat exposure during feed pelleting application, which could pose challenges to the use of traditional probiotic strains such as those belonging to the genera *Lactobacillus* and *Bifidobacterium*, as they are often sensitive to some of these extreme conditions.

Endospore-forming *Bacillus* spp. offer advantages over traditional probiotic strains due to the ability of *Bacillus* spores to withstand hostile environments such as high temperature, desiccation, and acidic pH, resulting in increased viability during the manufacturing and feed-pelleting process, increased stability inside animals' GIT and extended product shelf-life. Thus, *Bacillus* strains have been widely used to support improved production parameters (8-11). *Bacillus* spp., commonly found in soil, enter the animal GIT through feed or ingestion of fecal material. Once inside the GIT, the spores germinate into metabolically active vegetative cells, eliciting their probiotic effect (12-15). Within the *Bacillus* genus, species commonly used as probiotics are *B. subtilis, B. coagulans, B. clausii, B. amyloliquefaciens*, and *B. licheniformis* (16). *Bacillus* strains are known to produce commercial enzymes, antimicrobial peptides, and small metabolites that may confer health benefits to the host by supporting improved feed digestion, suppressing undesirable organisms, and by maintaining a healthy gut microbiota and immune system (reviewed in (17)).

Despite several reports on the benefits of *Bacillus* spores as probiotics and DFMs on human and animal health, respectively, detailed characterizations of *Bacillus* spp. strains to not only help explain their potential probiotic properties but also to evaluate their safety are typically unavailable in the public domain. Insufficient characterization of probiotic strains could result in the following undesirable outcomes: 1) misleading identification at the genus and species levels of probiotic strains in commercial products; and 2) the occurrence of antimicrobial resistance traits and toxins in probiotic strains that could negatively impact the host and raise public health concerns. As an example of the first instance, commercial probiotics labeled as *B. coagulans* were later shown to be *Lactobacillus sporogenes*, and *B. clausii*-containing probiotics were mislabeled as comprised of *B. subtilis* (19-21).

To fill the knowledge gap in the genomic and phenotypic characterization of *Bacillus* spp. DFMs, we take advantage of DNA sequencing and omics technologies for the comprehensive identification, screening, and characterization of *Bacillus* spp. to assess their safety and efficacy as probiotic candidates. Detailed strain characterizations employing multi-omics approaches could uncover correlations between strain properties and the effects of probiotic administration on the host, underpin possible mechanisms of action of probiotic strains, identify biomolecules that could be used in place of live bacteria (i.e. peptides, enzymes, metabolites), and help to rationally design strain consortia to maximize positive effects on the host.

Here, we present a comprehensive screening and multi-omics characterization for *Bacillus* spp. as probiotics for use in poultry. Our analysis provides insights into the genotypic, phenotypic, and metabolomic properties of three *Bacillus* spp. strains that show desirable probiotic traits and safety profiles. Furthermore, results from a clinical study of the administration of one of the strains—*B. amyloliquefaciens* Ba PTA84—showed a significant improvement of broiler growth performance. Such in-depth characterization and the data made available will guide future efforts to develop next generation probiotics, microbial-derived nutritional health products, and inform decisions to design microbial consortia for the potential improvement of poultry production efficiency.

Materials and Methods

Microbial strains and growth conditions—The *Bacillus* spp. strains were routinely grown in Lysogeny Broth (LB) and incubated at 37° C. overnight while shaking at 200 rpm. Avian pathogenic *Escherichia coli* (APEC) serotypes O2, O18, O78 and *Clostridium perfringens* NAH 1314-JP1011 were obtained from the Elanco pathogen library. *Salmonella* enteritica serovar *Typhimurium* ATCC 14028 was purchased from the American Type Culture Collection (ATCC, Manassas, VA). *E. coli* strains and S. *Typhimurium*, were routinely grown in LB, and *C. perfringens* was grown in anaerobic Brain Heart Infusion (BHI) broth supplemented with yeast extract (5.0 g/L) and L-cysteine (0.5 g/L). For growth in liquid culture, a colony from the respective agar plate was inoculated into a 10 mL tube containing liquid media and the tube was incubated in a shaker incubator at 37° C. and 200 rpm for *E. coli* and S. *Typhimurium*, and statically at 39° C. for *C. perfringens* inside a Bactron anaerobic chamber (Sheldon Manufacturing, Inc., Cornellius, OR). The anaerobic chamber contained a mixture of N2:CO2:H2 (870.5:10:2.5, v/v/v).

Vero cells growth condition—Vero cells were obtained from Elanco cell culture collection and were maintained in Opti-MEM® I reduced serum media containing 5% Fetal Bovine Serum (FBS) (Cytiva, Marlborough, MA) and Gentamicin (Opti-5-Gent) (Life Technologies, Carlsbad, CA). The serum-free cell culture medium was similarly prepared with Minimal Essential Medium with Earle's Balanced Salt Solution (MEM/EBSS), 10% fetal bovine serum (FBS), 1% non-essential amino acids and 1% L-glutamine in place of FBS. To generate wells containing 100% confluent cells for the cytotoxicity assay, Vero cells grown for two to three days were divided into a 96-well flat bottom tissue culture plate (Fisher Scientific, Waltham, MA) where each well contained 1×104 cells. The cells were then incubated on the plate for 48-72 hours inside a CO2 incubator (37° C.; % CO2 was maintained at 5±1%).

*Bacillus* Spp. Isolation and Identification

*Bacillus* isolation—*Bacillus* spp. were isolated from cecal contents of healthy 30-42 day old chickens raised at poultry research farms in Arkansas, Georgia, and Indiana, USA employing a combination of a high-throughput isolation platform employing Prospector® (GALT, Inc, San Carlos, CA) following the manufacture's protocol, and a classical isolation method as described previously (22). For both approaches, isolation protocols were preceded by selection of *Bacillus* spores from the starting cecal contents by applying heat at 95° C. for 5 min or treatment with ethanol. For the latter, frozen cecal samples from the Elanco library preserved in BHI containing 20% glycerol were thawed and equal amounts of Tryptic Soy Broth (TSB) medium were added and mixed. An equal amount of absolute ethanol was added to the sample to a final concentration of 50% and the mixture was incubated at 30° C. for an hour. The ethanol-treated samples were then used for isolation. For *Bacillus* spp. isolation employing conventional methods, 10-fold serial-dilution was applied to the treated cecal samples to ensure separate colonies recovered on agar plates. Each colony was purified by three sequential passages onto agar plates.

Strain identification—For an initial strain identification, *Bacillus* cell lysates were sent to the TACGen genomic sequencing facility (Richmond, CA) for strain identification. The strain identities were determined by Sanger sequencing of amplified regions of a partial length of 16S ribosomal RNA (rRNA) gene employing primers 27F (5' AGA GTT TGA TCM TGG CTC AG 3') (SEQ ID NO: 306) and 1492R (5' CGG TTA CCT TGT TAC GAC TT3') (SEQ ID NO: 307). The resulting 16S rRNA sequences were then searched against the NCBI 16S rRNA database using BLAST searches with an e-value cutoff of <10-20 and a percent sequence identity value of >95%. Strain identification of select isolates were further confirmed by ortholog analyses as described in the following section: Genome-based strain identification and comparative genomic analyses.

In vitro microorganism inhibition assay—Eight *Bacillus* spp. strains were screened for their antimicrobial activity against five microorganisms, namely APEC serotypes O2, O18, O78, *Salmonella Typhimurium* ATCC 14028, and

*Clostridium perfringens* NAH 1314-JP1011. The assays were modified from a protocol described in (23) and performed in duplicate. The detailed protocol is presented in Supplementary Materials.

Enzyme activities—The β-mannanase assay was adapted from a protocol as described by Cleary, B., et. al. (24). Assays for amylase and protease activities were done following protocols in (23). These protocols are presented in Supplementary Materials.

Cytotoxicity assay—Cytotoxicity assays of eight *Bacillus* culture supernatants were performed following the protocol described in EFSA guidelines (25). A detailed protocol is described in Supplementary Information. Culture supernatant of *B. cereus* ATCC 14579 and *B. licheniformis* ATCC14580 were used as positive and negative controls, respectively.

Antimicrobial susceptibility assessment—Antibiotic susceptibility assays of *Bacillus* spp. for tetracycline, chloramphenicol, strepLomycin, kanamycin, erythromycin, vancomycin, gentamycin, ampicillin, and clindamycin were performed and assessed according to an EFSA guideline for Antimicrobial resistance of the *Bacillus* spp. as direct fed microbials (25). *Bacillus* spp. strains on LB agar plates were sent to Microbial Research, Inc. (Fort Collins, CO) for analysis following protocols in compliance with Clinical Laboratory Standard Institute (CLSI) document VET01 (26). Briefly, MIC plates were prepared using cation-adjusted Mueller Hinton Broth (MHB) and the antimicrobials were 2-fold serially diluted to obtain a final concentration range of 0.06-32 μg/mL. Growth of *Bacillus* spp. in the presence of each of nine antimicrobials with different dilutions was monitored. Susceptibility was interpreted as the lack of *Bacillus* spp. growth in the presence of antimicrobial at a concentration that was lower that the cut-off values of the respective antimicrobials described in the EFSA guideline (FIG. 2A). For quality control, the following organisms were used as controls, *Escherichia coli* ATCC 25922, *Enterococcus faecalis* ATCC 29212, *Pseudomonas aeruginosa* ATCC 27853 and *Staphylococcus aureus* ATCC 29213.

Whole Genome Sequencing, Assembly and Annotation

Genomic DNA isolation—High molecular weight genomic DNA of *Bacillus* spp. were extracted employing a Phenol:Chloroform:Isoamyl alcohol (PCI) method as described previously (27). Bacterial cells were harvested by centrifugation at 7,000×g for 10 min from an overnight culture of *Bacillus* spp. grown in 25 mL LB supplemented with 0.005% TWEEN Tween 80 in 50 mL sterile Falcon tube (Fisher Scientific, Waltham. MA). The resulting cell pellet was resuspended in 0.75 mL of 1× Tris-EDTA (TE) buffer (Life Technologies, Carlsbad, CA), pH 8, containing Tris-HCl and EDTA at final concentrations of 10 and 1 mM, respectively, in a 2 mL Eppendorf tube (Fisher Scientific, Waltham, MA). To lyse the cells, Lysozyme (Sigma Aldrich, St. Louis, MO) was added at a final concentration of 7 mg/mL and the mixture was incubated at 37° C. for an hour. Then, SDS and Proteinase K (Sigma Aldrich, St. Louis, MO) were added to the mixture at final concentrations of 2% and 400 μg/mL, respectively, and the lysate was incubated at 60° C. for 1 hour. To remove RNA from the cell lysate, 10 pL of RNase (ThermoFisher Scientific, Waltham, MA) were added and the mixture was incubated at 37° C. for 30 min. An equal volume of a mixture of PCI (25:24:1, v/v/v) was added to the supernatant and was mixed by carefully inverting tubes 5-10 times rigorously. The aqueous phase containing DNA was separated from the organic phase by centrifugation at 12,000×g for 15 min, and the top aqueous layer was collected into a fresh 2 mL Eppendorf tube. An equal volume of a mixture of Chloroform:lsoamyl alcohol (24:1, v/v) was added to this aqueous phase containing DNA, and mixed by carefully inverting the tube. The mixture was centrifuged at 12,000×g for 10 min. DNA from the aqueous layer was precipitated by an addition of one tenth volume of sodium acetate (3M, pH 5.2) followed by centrifugation at 16,000×g for 20 min. The DNA pellet was washed three times with ice-cold 70% ethanol, air-dried, and resuspended in 0.5 mL 1×TE buffer.

PacBio long read genome sequencing—The bacterial genomic DNA samples were shipped on dry-ice to DNA Link, Inc. (San Diego, CA) for whole genome sequencing using PacBio RSI platform. Briefly, 20 kb DNA fragments were generated by shearing genomic DNA using the covaris G-tube according to the manufacturer's recommended protocol (Covaris, Woburn, MA). Smaller fragments were purified by the AMpureXP bead purification system (Beckman Coulter, Brea, CA). For library preparation, 5 pug of genomic DNA were used. The SMRTbell library was constructed using SMRTbell™ Template Prep Kit 1.0 (PacBio®, Menlo Park, CA). Small fragments were removed using the BluePippin Size selection system (Sage Science, Beverly, MA). The remaining DNA sample was used for large-insert library preparation. A sequencing primer was annealed to the SMRTbell template and DNA polymerase was bound to the complex using DNA/Polymerase Binding kit P6 (PacBio®, Menlo Park, CA). Following the polymerase binding reaction, the MagBead was bound to the library complex with MagBeads Kit (PacBio®, Menlo Park, CA). This polymerase-SMRTbell-adaptor complex was loaded into zero-mode waveguides. The SMRTbell library was sequenced by 2 PacBio® SMRT cells (PacBio®, Menlo Park, CA) using the DNA sequencing kit 4.0 with C4 chemistry (PacBio®, Menlo Park, CA). A 1×240-minute movie was captured for each SMRT cell using the PacBio® RS sequencing platform.

Genome Assembly, Annotation and Features Prediction—The genome was assembled by DNA link, Inc. with HGAP.3. Genome annotation was carried out using a custom annotation pipeline by combining several prediction tools. Coding sequences, transfer RNA and transmembrane RNA were predicted and annotated using Prokka (28-30). Ribosomal binding site (RBS) prediction was carried out using RBSFinder (31). TransternHP was used to predict Rho-independent transcription terminators (TTS) (32). Ribosomal RNA and other functional RNAs such as riboswitches and non-coding RNA was annotated with Infernal (33). Operons were predicted based on primary genome sequence information with Rockhopper v2.0.3 using default parameters (34). Insertion sequence prediction was done using ISEscan v.1.7.2.1 (40). Prophage prediction was done using PhiSpy v4.2.6 which combines similarity- and composition-based strategies (41).

Genome-based strain identification and comparative genomic analyses—Taxonomic labelling of the assembled microbial genomes was carried out using CA MITAX (35). CAMITAX is a scalable workflow that combines genome distance-, 16S ribosomal RNA gene-, and gene homology-based taxonomic assignments with phylogenetic placement. OrthoFinder v2.3.1 (36) was used to determine orthologous relationships (37).

Phylogenetic analysis—Phylogenetic relationships of the genomes were explored with UBCG v3.0 using default settings (38). This software tool employs a set of 92 single-copy core genes commonly present in all bacterial genomes. These genes then were aligned and concatenated within UBCG using default parameters. The estimation of robustness of the nodes is done through the gene support index (GSI), defined as the number of individual gene trees, out of the total genes used, that present the same node. A maximum-likelihood phylogenetic tree was inferred using FastTree v.2.1.10 with the GTR+CAT model (39).

Patent depository of *Bacillus amyloliquefaciens* ATCC PTA-126784 and PTA-126785, and *B. subtilis* ATCC PTA-126786 —*Bacillus amyloliquefaciens* ATCC PTA-126784 and PTA-126785, and *B. subtilis* ATCC PTA-126786 strains were deposited in the ATCC culture collection (Manassas, VA). For simplicity, *Bacillus amyloliquefaciens* ATCC PTA-126784 and PTA-126785, and *B. subtilis* ATCC PTA-126786 strains are referred to as Ba PTA84 and Ba PTA85, and Bs PTA86, respectively.

Global untargeted metabolomic analysis—*Bacillus* strains Bs PTA86, Ba PTA84, and Ba PTA85 were grown as three single strain cultures, and then were analyzed as a two-strain (Ba-PTA84 and PTA85) or three-strain (Bs-PTA86, Ba-PTA84, and Ba-PTA85) consortia in 5 mL of minimal or rich liquid media. For growth in minimal media, medium containing 1×M9 salts, and glucose at a final concentration of 0.5% (w/v) was used. Rich medium contained the following entities (g/L): peptone 30; sucrose 30; yeast extract 8; KH2PO4 4; MgSO41; and MnSO4 0.025. The culture was grown at 37° C. overnight. *Bacillus* cells were pelleted by centrifugation at 10,000×g for 10 min, cell pellets were washed three times with ice-cold PBS. The resulting cell pellets and cell-free supernatants were stored at −80 C and sent to metabolon Inc. (Durham, NC) for global untargeted metabolomic profiling. Detailed description of metabolomic analysis is presented in Supplementary Methods.

In-vivo assessment of *Bacillus* DFM for improvement of growth performance in broiler chickens Spore generation—*Bacillus* spores were generated employing a modified protocol as described in (42). *Bacillus* spp. was grown in a liquid Difco sporulation medium containing Nutrient Broth (BD Difco, Franklin Lakes, NJ, USA), 8.0 g/L; KCl, Ig/L, and MgSO4·7H2O, 0.12 g/L. The mixture was adjusted to pH 7.6 with additions of NaOH. After adjusting the pH and sterilizing the media by the use of an autoclave at 121° C., 1 mL of each of the following mineral sterile stock solutions were added to broth media, 1.0 M CaCl2, 0.01 M MnSO4, 1.0 mM FeSO4, A sterile glucose solution was also added to the medium mixture to a final concentration of 5.0 g/L. A single colony was taken from an agar plate and was inoculated into 100 mL of the sporulation medium. The culture was incubated overnight at 37° C. with shaking at 200 rpm. This culture served as a seeding culture for 1 L of liquid culture. All growth were done employing vented baffled flasks. This culture was incubated at 37° C. while shaking at 200 rpm for at least 72 hours. The presence of spores was monitored with a bright-field microscope. The spores were harvested at 17,000 rpm and washed three times with pre-chilled sterile distilled water. The spores were then resuspended in 30 mL of pre-chilled sterile distilled water and the spore suspension was mixed with irradiated ground rice hulls (Rice Hull Specialty Products, Stuttgart, AR), dried at 60° C. for 3-4 hours to eliminate vegetative cells. To determine spore inclusion in the rice hulls, 0.25 g of the material containing spores was heat treated at 90° C. for 5 min. One milliliter of water was added to the material and allowed to soak for 15-30 min. The suspension was vortexed for 30 see and serially diluted 10-fold for colony counts on agar plates.

Study Design

A total of 2,500 one-day-old male broiler chicks (Cobb 500) were randomly allocated to two treatment groups on Study Day (SD) 0. The control group received only the basal diet, while the treated group received the basal diet plus 1.5×105 CFU of Ba PTA84 per gram of final feed. The control group consisted of 30 pens of 50 birds per pen, and the Ba PTA84 group consisted of 20 pens of 50 birds per pen.

Birds were housed in floor pens in a single environmentally controlled room with ad libitum access to treatment diets and water. Basal diets were formulated to be iso-nutritive, and to meet or exceed the nutrient requirements recommended for broilers (Table S9). Feed was issued in four study phases: Starter Phase I (SD 0-12); Grower Phase II (SD 12-26); Finisher Phase III (SD 26-35), Withdrawal Phase IV (SD 35-42). Diets did not contain antibiotics, anticoccidials or growth promoters and were fed to the birds as a mash in all phases.

Bird weights (pen weight) were measured and recorded at SD 0, 12, 26, 35 and 42. Feed issued and weighed back were recorded for each feeding phase. Bird general health, mortality and environmental temperature were recorded daily.

Statistical Analysis

The experimental unit was the pen. All statistical analysis was conducted using the SAS® system version 9.4 (SAS Institute, Cary, NC),) and all tests were performed comparing the control group to the treated group using a one-sided test at $P<0.05$ level of significance.

Performance variables of interest for each feeding period and overall included: live final body weight (LFBW), average daily gain (ADG), average daily feed intake (ADFI), gain to feed efficiency (GF), feed to gain efficiency (FCR), mortality, and the European Broiler Index (EBI). These variables were calculated and evaluated for each study phase (Starter, Grower, Finisher, Withdrawal and Overall (SD 0-42)) and both adjusted for mortality and unadjusted.

Microbiome Profiling of Cecal Content from Birds Treated with Ba PTA84

DNA Extraction, Library Preparation and Sequencing—Total DNA from cecal content samples were extracted employing the Lysis and Purity kit (Shoreline Biome, Farmington, CT) following manufacturer's protocol. The resulting DNA was used as template for library preparation using Shoreline Biome's V4 16S DNA Purification and Library Prep Kit (Shoreline Biome, Farmington, CT). Briefly, PCR amplification of the V4 region of the 16S rRNA gene was performed using the extracted DNA and the primers 515F (5'GTGGCCAGCMGCCGCGGTAA) (SEQ ID NO: 308) and 806R (5'-GGACTACHVHHHTWTCTAAT) (SEQ ID NO: 309). The resulting amplicons were then sequenced using 2×150 bp paired-end kits on the Illumina iSeq platform. To increase diversity, PhiX 50 pM was added to a final concentration of 5% into the amplicon library.

Bioinformatic analysis—Forward and reverse reads were processed with cutadapt (v 2.5) (43) to remove primer sequences. Read pairs without primer sequences present or more than 15% primer mismatches were discarded. The DADA2 pipeline (v. 1.12.1) (44) was used to generate a count matrix of amplicon sequence variants (ASVs) across samples. Due to the short length of iSeq reads, forward and reverse reads were trimmed to a length of 110 bp and merged with DADA2's justConcatenate option. The DADA2 parameters maxN=0, truncQ=2, rm.phix=TRUE and maxEE=2 were used. Taxonomic labels were assigned to each ASV using the DADA2 assignTaxonomy method and the Silva v. 138 database (45). Diversity and richness per sample were quantified from the ASV matrix using the Simpson, Shannon and Chao indices (46-48) and compared across treatments with the Mann-Whitney U test. Comparison of microbiome structures across treatments was performed using PERMANOVA and ANOSIM analysis based on the Bray-Curtis dissimilarity between samples. PERMANOVA and ANOSIM were performed using code in the scikit-bio python package (49). Principal component analysis of the Bray-Curtis dissimilarity matrix was used to analyze sample clustering according to treatment group.

Supplementary Methods

In vitro microbial inhibition assay—The assays were modified from a protocol described in (113) and performed in duplicate. Briefly, 10 μl of *Bacillus* freezer stock was inoculated into 2 mL of 0.5× LB in a 15 mL round bottom shaker tube. The cultures were incubated at 37° C. for 48 hours while shaking at 200 rpm. For APEC strains and S. *Typhimurium,* 50 μl of freezer stock was inoculated into 5 mL of LB in a 15 mL round bottom shaker tube. The cultures were incubated at 37° C. overnight while shaking at 200 rpm. Once pathogens had grown overnight in liquid culture, 1.0×105 cfu/ml of the overnight culture were inoculated into freshly prepared LB soft agar (0.8% w/v) that was cooled in a water bath set to 45° C. after autoclave sterilization. 5 mL of the molten agar was aliquoted into each well of a 6-well cell culture plate (2 wells per *Bacillus* strain plus the negative control). The soft agar was solidified and air-dried for 3-4 hours. Onto this agar, 5 dl of 48-hour *Bacillus* culture were applied to the center of each well. The plates were inverted and allowed to incubate overnight at 37° C. for 24 hours and zones of inhibition were observed and recorded.

For *Clostridium perfringens* screening, 5 mL of molten LB agar (1.5%, w/v) were aliquoted into each well of a 6-well cell culture plate and allowed to solidify, overnight. Then 5 μl of 48-hour *Bacillus* culture were spotted onto the center of each well. The plates were inverted and allowed to incubate overnight aerobically at 37° C. A colony of *Clostridium perfringens* NAH 1314-JP1011 was inoculated in liquid BYC broth an incubated overnight at 39° C. in the anaerobic chamber. Freshly prepared BYC soft agar (0.8%, w/v) was autoclaved and allowed to cool in a water bath set to 45° C. Once cooled, the overnight *C. perfringens* culture was inoculated into molten soft agar at 1.0×105 cfu/ml and mixed on a stir plate. 5 mL of the molten agar was aliquoted on top of each well of the 6-well cell culture plates containing *Bacillus* spots. As a negative control, *C. perfringens*-containing molten agar was poured onto LB agar without *Bacillus*. Once solidified, plates were inverted and allowed to incubate anaerobically overnight at 39° C. for 24 hours. Then, zones of inhibition were observed and recorded.

Enzyme activities—β-mannanase assay was adapted from a protocol as described by Cleary, B., et. al. (114). Assays for amylase and protease followed protocols in (113). For testing β-mannanase activity, *Bacillus* strains were grown in 5 milliliters of LB medium in a 15 mL culture tube overnight at 37° C. while shaking at 200 rpm. Then 5 μl of 24 hour *Bacillus* culture were spotted in duplicate onto the center of an LB agar plate containing 100 mM CaCl2). The agar plates were incubated overnight at 37° C. Fresh soft agar containing Azo-carob Galactomannan (0.5%, w/v), agar (0.7%, w/v), dissolved in 50 mM Tris-HCl pH 7.0 buffer was autoclaved and allowed to cool in a water bath set to 45° C. Once cooled, the soft agar substrate was overlayed on to agar plates containing *Bacillus* colonies until each colony was surrounded by substrate. The plates were incubated overnight at 37° C. and allowed to incubate for 48 hours. The zone of clearance due to β-mannanase activity could be directly visualized and recorded.

For the amylase assay, agar plates containing the following ingredients were used (entity, g/L): Tryptone, 10, Soluble starch, 3, KH2PO4, 5, Yeast extract, 10, Noble Agar, 15. An overnight culture of *Bacillus* isolates in 0.5× LB was used as an inoculum. The *Bacillus* culture was spotted onto the above plate containing soluble starch and the inoculated plates were incubated at 37° C. for 48 hours. The zone of clearance due to amylase activity was visualized by flooding the surface of the plates with 5 mL of Gram's iodine solution.

For testing protease activity, agar plates containing the following ingredients were used (entity, g/L): skim milk, 25, noble agar, 25. An overnight culture of *Bacillus* isolates in 0.5× LB was used as inoculum. The *Bacillus* culture was spotted onto the above plate containing soluble starch and the inoculated plates were incubated at 37° C. for 24 hours. The zone of clearance due to protease activity could be directly visualized.

Cytotoxicity Assay—*Bacillus* spp. strains were grown in 5 mL Brain Heart Infusion (BHI) liquid medium at 30° C. overnight. This overnight culture served as an inoculum for 5 mL fresh LB, the inoculated medium was then incubated at 30° C. for 6 hours without shaking. The expected cell density was at least 108 CFU/mL. The culture was then centrifuged at 1,700×g for 1 hour to generate cell-free culture supernatant.

200 μL serum-free medium were added to the 100% confluent Vero cells grown on 96-well plates generated following the protocol described in Materials and Methods. The cells were then exposed to 100 μL of cell-free culture supernatant of *Bacillus* spp. and the mixture was incubated inside a CO2 incubator (5% v/v headspace of CO2, Thermo Scientific, Waltham, MA) at 37° C. for 3 hour. The corresponding cell-free culture supernatant was used in the control wells. *B. cereus* and *B. licheniformis* were used as positive and negative controls, respectively, and 0.1% TRITON-X Triton-X, 100 μL was used as a positive cytotoxicity control. The assay was performed in three technical replicates with three biological replicates.

At the end of the incubation period, culture supernatants were collected by centrifugation at 300×g for 5 min. Culture supernatants from technical replicate wells were combined. Four micro liters of the culture supernatant were used for a lactate dehydrogenase assay (Sigma Aldrich, St. Louis, MO) with a total volume of 100 μL, following the protocol as described in (115). The reaction was monitored at an absorbance of 450 nm at 37° C. for 10 minutes measuring the generation of NADH from NAD+ as products from lactate dehydrogenase reaction. The percent cytotoxicity level was calculated by the following formula.

$$\%\ \text{Cytotoxicity} = \frac{(A460\ \text{nm\_sample} - A460\ \text{nm\_media control})}{(A460\ \text{nm\_Triton}\ X\ \mathit{TRITON}\ X - A460\ \text{nm\_media control})}$$

The A450 nm value is an average of three biological replicates. A cytotoxicity percentage value higher than 20 was considered cytotoxic. The assays were repeated if cytotoxicity percentage of *B. cereus*, a positive control, was less than 40 or that of *B. licheniformis*, a negative control, was higher than 20.

Global untargeted metabolomic analysis—Metabolite analysis was performed at Metabolon, Inc. utilizing non-targeted UPLC-MS/MS approach employing a Waters ACQUITY ultra-performance liquid chromatography (Waters, Milford, MA) and a Q-Extractive high resolution/accurate mass spectrometer (Thermo Scientific, Waltham, MA) interfaced with a heated electrospray ionization (HESI-II) source and Orbitrap mass analyzer operated at 35,000 mass resolution. The samples were dried, reconstituted and aliquoted into four samples for the following analyses, a) Analysis of hydrophilic compounds employing acidic positive ion conditions with a C18 column (Waters UPLC BEH C18-2.1×100 mm, 1.7 μm) using water and methanol, containing 0.05% perfluoro pentanoic acid (PFPA) and 0.1% formic acid (FA), b) Analysis of more hydrophobic compounds employing a similar system as mentioned above except the mobile phase used was methanol, acetonitrile, water, 0.05% PFPA and 0.01% FA and was operated at an overall organic content. c) Analysis of basic negative ion employing a C18 column with methanol and water as mobile phase that contained 6.5 mM Ammonium Bicarbonate at pH 8. d) negative ionization following elution from a HILIC column (Waters UPLC BEH Amide 2.1×150 mm, 1.7 μm) using a gradient consisting of water and acetonitrile with 10 mM Ammonium Formate, pH 10.8. The MS analysis covered approximately 70-1000 m/z.

Metabolic compounds were identified by comparison to the Metabolon libraries of purified standards and recurrent unknown metabolites. The identification was based on retention index within a narrow RI window of the proposed identification, accurate mass match to the library+/−10 ppm, and the MS/MS forward and reverse scores.

Data from cell pellets and culture supernatants were analyzed separately. Raw intensity values were re-scaled for each identified metabolite by dividing them by the median intensity across samples. Missing values for a given metabolite and sample were imputed by assigning the minimum value for the metabolite across samples. The scaled and imputed data were Log 10 transformed for subsequent analyses. Principal component analysis (PCA) was used to analyze the similarity of metabolic profiles between samples. For supernatant samples, secreted metabolites were identified by comparing the scaled and imputed intensities to the respective metabolites in media controls. A 1.5-fold increase in scaled intensities over media was used to define metabolites secreted. A similar 1.5-fold increase between an individual strain and the remaining 2 strains, or between strain consortia and the corresponding individual strains, was used to define uniquely secreted metabolites.

Results

Isolation and Identification *Bacillus* Spp. From Healthy Animals

*Bacillus* spp. strains were isolated from the cecal contents and fecal materials of healthy chickens. The taxonomic identities of the isolates were determined by 16S-rRNA amplicon sequencing. These isolates belonged to 30 different *Bacillus* species with the top hits of *B. velezensis, B. amyloliquefaciens, B. haynesii, B. pumilus, B. subtilis*, and *B. licheniformis.*

Due to safety considerations, *Bacillus* spp. isolates chosen for further screening included only those that belong to the species listed as DFMs in the Association of American Feed Control Officials, Inc. (AAFCO) Official Publication since they "were reviewed by FDA Center for Veterinary Medicine and found to present no safety concerns when used in direct-fed microbial products" (50), and to the species listed as Qualified Presumption of Safety (QPS) status according to the European Food Safety Authority (EFSA) BIOHAZ Panel (3). These were *B. subtilis, B. amyloliquefaciens, B. pumilus*, and *B. licheniformis.*

In-Vitro Screening for Probiotic Properties of *Bacillus* Spp. Strains

*Bacillus* spp. strains were tested to determine their effect on selected microorganisms and their ability to secrete selected enzymes (23). For the former, Gram-negative and Gram-positive microorganisms (*E. coli* 02, 018, and 078, and *Clostridium perfringens* NAH 1314-JP1011) and *Salmonella enterica* serovar *Typhimurium* ATCC 14028, were used. For the latter, plate-based assays for determining the secretion of amylase, protease, and β-mannanase were performed.

A total of 266 *Bacillus* strains were first screened against *E. coli* 02, and 71% of the strains showing positive *E. coli* 02 inhibition were selected for a second-round of assays targeting *E. coli* 018, then *E. coli* 078, S. *Typhimurium* and lastly *C. perfringens* JP1011. The top 8 *Bacillus* strain candidates were selected according to their cumulative inhibition scores, and selected data is provided in TABLE 46. These included *B. amyloliquefaciens* (Ba): Ba ELA006, Ba ELA071, Ba PTA84, Ba PTA85, and *B. subtilis* (Bs) isolate Bs PTA86.

TABLE 46

In Vitro Pathogen Inhibition and Digestive Enzyme Activities of Selected *Bacillus* Spp.

| Pathogen inhibition and digestive enzyme activities | Ba-006 | Ba-PTA84 | Ba-PTA85 | Ba-071 | Bs-PTA86 |
|---|---|---|---|---|---|
| Pathogen inhibition[a] | | | | | |
| *Salmonella Typhimurium* ATCC 14028 | 1 | 1 | 2 | 1 | 0 |
| *Clostridium perfringens* JP1011 | 4 | 4 | 4 | 4 | 3 |
| APEC O78 | 1 | 0 | 1 | 1 | 0 |
| APEC O2 | 1 | 1 | 1 | 1 | 1 |
| APEC O18 | 1 | 1 | 2 | 1 | 1 |
| Cumulative pathogen inhibition Score | 8 | 7 | 10 | 8 | 5 |
| Digestive enzymes[b] | | | | | |
| Amylase | 1.83 | 1.8 | 2.1 | 1.59 | 2.04 |
| Protease | 2.05 | 2.58 | 2.05 | 2 | 1.95 |
| Beta-mannanase | 2.2 | 1.49 | 1.95 | 1.14 | 2 |
| Cumulative REA Score | 6.08 | 5.87 | 6.1 | 4.73 | 5.99 |

[a]Pathogen inhibiton scores were assigned based on the size of clearance zone as follows, 0, no inhibition; 1, 2, 3, 4, clearance zone values of 0-0.9, 1.0-1.9, 2.0-2.9, and 3.0-4.0 mm, respectively. A clearance zone value is defined as the distance from the outer part of *Bacillus* colony to the end of pathogen growth inhibition zone.
[b]Relative digestive enzyme activities were measured in Relative Enzyme Activity values (REA) that were calculated as a ratio between a diameter of clearance zone from enzyme activity and the diameter of *Bacillus* colony.

The cumulative inhibition score was calculated as the sum of the inhibition score values of a *Bacillus* strain against the five microorganisms tested. The data showed that selected Ba strains had better cumulative microbial inhibition scores compared to the Bs strain. The average cumulative inhibition scores were 8.5 and 5.5 for Ba and Bs, respectively.

The *Bacillus* strain candidates were also evaluated for their ability to secrete enzymes. *Bacillus* strains are known to produce a variety of enzymes (51, 52). In vitro plate-based assays for protease, amylase, and β-mannanase activities showed that six Ba and two Bs showed comparable amylase, protease, and β-mannanase activities, Ba ELA071 and Ba PTA85 showed the lowest and highest cumulative REA values of 4.73 and of 6.1, respectively.

Safety Assessment of *Bacillus* Spp. Probiotic Candidates

To evaluate the safety of *Bacillus* spp. as microbial feed ingredients, the *Bacillus* candidates were tested for antimicrobial susceptibility to medically relevant antimicrobials. Microbial feed ingredients should not carry or be capable of transferring antimicrobial resistance genes to other gut microbes. This is especially important in the case of medically relevant antimicrobials that are used in humans, given the rise of multidrug resistant bacteria.

The results from antimicrobial susceptibility tests for 8 *Bacillus* strains showed that all strains were susceptible to the tested antibiotics. The only exception was Bs ELA082 which exhibited a borderline resistance to streptomycin. The minimum inhibitory concentration of streptomycin for this strain was 16 μg/mL, which is 2-fold higher than the EFSA threshold cut-off of streptomycin for *Bacillus* as DFM, FIG. 43A.

To determine the potential toxicity of *Bacillus* strains on the host cells, culture supernatants of *Bacillus* spp. were tested for cytotoxicity toward Vero cells according to (25). The cytotoxicity assay was performed by monitoring the lactate dehydrogenase (LDH) enzyme originated from compromised Vero cells as described in (53). FIG. 43 B shows the cytotoxicity levels of each *Bacillus* strain tested. The results suggested that all 8 *Bacillus* strains were non-cytotoxic with toxicity levels far below 20%, a percentage that is considered cytotoxic according to the EFSA guidelines. Of all isolates, the cytotoxicity level of Ba PTA84 was closest to that of the negative control. In general, Ba strains exhibited toxicity levels that were lower than those of Bs strains. Within the *B. subtilis* group, the cytotoxicity level of Bs PTA86 was the lowest, 5%.

Selection of *Bacillus* Spp. As Direct Fed Microbial Candidates

Based on their performance on microorganism inhibition, enzymatic activities, antimicrobial susceptibility, and low toxicity against Vero cells, the strains Ba PTA84, Ba PTA85, and Bs PTA86 were chosen for more detailed characterization employing genomic and metabolomic approaches described in the following sections.

Untargeted Global Metabolomic Analysis of Cell Pellets and Culture Supernatants of Ba PTA84, Ba PTA85, and Bs PTA86 as Single Strains and as Consortia Untargeted metabolomics analysis of cell pellets and culture supernatants of the three candidate strains was performed to assess differences in metabolite profiles. Cells were cultured in both rich and minimal media as individual strains, as well as a consortium of Ba PTA84 and Ba PTA85, and a consortium including all three strains. Named metabolites were identified in the supernatant and pellet samples, respectively (TABLE 47 and 48).

TABLE 47

Metabolites uniquely secreted by individual strains or strain consortia in rich media. For individual strains, secreted metabolites with intensities >1.5 fold than remaining two strains on same media. For strain consortia, secreted metabolites with intensitries >1.5 fold than corresponding individual strains

| Super Pathway | Pathway | Metabolite | Ba PTA84 | Ba PTA85 | Bs PTA86 | Ba PTA84 + Ba PTA85 | Ba PTA84 + Ba PTA85 + Bs PTA86 |
|---|---|---|---|---|---|---|---|
| Amino Acid | Alanine and Aspartate Metabolism | N,N-dimethylalanine | 0 | 0 | 0 | 0 | 1 |
| Amino Acid | Glutamate Metabolism | N-acetylglutamine | 0 | 0 | 1 | 0 | 0 |
| Amino Acid | Glutathione Metabolism | glutathione, oxidized (GSSG) | 0 | 0 | 1 | 0 | 0 |
| Amino Acid | Glutathione Metabolism | 2-hydroxybutyrate/2-hydroxyisobutyrate | 0 | 0 | 1 | 0 | 0 |
| Amino Acid | Glycine, Serine and Threonine Metabolism | N-acetylthreonine | 0 | 0 | 1 | 0 | 0 |
| Amino Acid | Glycine, Serine and Threonine Metabolism | N-acetylserine | 0 | 0 | 1 | 0 | 0 |
| Amino Acid | Histidine Metabolism | N-acetylhistidine | 0 | 0 | 1 | 0 | 0 |
| Amino Acid | Histidine Metabolism | trans-urocanate | 0 | 0 | 1 | 0 | 0 |
| Amino Acid | Leucine, Isoleucine and Valine Metabolism | N-acetylvaline | 0 | 0 | 1 | 0 | 0 |
| Amino Acid | Leucine, Isoleucine and Valine Metabolism | isovalerate (C5) | 0 | 0 | 1 | 0 | 0 |
| Amino Acid | Leucine, Isoleucine and Valine Metabolism | N-acetylisoleucine | 0 | 0 | 1 | 0 | 0 |
| Amino Acid | Lysine Metabolism | N-acetyl-cadaverine | 0 | 0 | 1 | 0 | 0 |
| Amino Acid | Lysine Metabolism | N6-acetyllysine | 0 | 0 | 1 | 0 | 0 |
| Amino Acid | Lysine Metabolism | N6,N6-dimethyllysine | 0 | 0 | 0 | 1 | 0 |
| Amino Acid | Methionine, Cysteine, SAM and Taurine Metabolism | S-methylcysteine | 0 | 0 | 1 | 1 | 0 |
| Amino Acid | Methionine, Cysteine, SAM and Taurine Metabolism | N-acetylmethionine | 0 | 0 | 1 | 0 | 0 |
| Amino Acid | Methionine, Cysteine, SAM and Taurine Metabolism | S-adenosylmethionine (SAM) | 0 | 0 | 1 | 0 | 0 |
| Amino Acid | Methionine, Cysteine, SAM and Taurine Metabolism | 2-hydroxy-4-(methylthio)butanoic acid | 0 | 0 | 1 | 0 | 0 |
| Amino Acid | Phenylalanine Metabolism | N-acetylphenylalanine | 0 | 0 | 1 | 0 | 0 |

TABLE 47-continued

Metabolites uniquely secreted by individual strains or strain consortia in rich media. For individual strains, secreted metabolites with intensities >1.5 fold than remaining two strains on same media. For strain consortia, secreted metabolites with intensitries >1.5 fold than corresponding individual strains

| Super Pathway | Pathway | Metabolite | Ba PTA84 | Ba PTA85 | Bs PTA86 | Ba PTA84 + Ba PTA85 | Ba PTA84 + Ba PTA85 + Bs PTA86 |
|---|---|---|---|---|---|---|---|
| Amino Acid | Phenylalanine Metabolism | phenyllactate (PLA) | 0 | 0 | 1 | 0 | 0 |
| Amino Acid | Polyamine Metabolism | acetylagmatine | 0 | 0 | 1 | 0 | 0 |
| Amino Acid | Tyrosine Metabolism | 3-(4-hydroxyphenyl)lactate (HPLA) | 0 | 0 | 1 | 0 | 0 |
| Amino Acid | Urea cycle; Arginine and Proline Metabolism | N-acetylcitrulline | 1 | 0 | 0 | 0 | 0 |
| Amino Acid | Urea cycle; Arginine and Proline Metabolism | N-acetylarginine | 0 | 0 | 1 | 0 | 0 |
| Carbohydrate | Aminosugar Metabolism | glucuronate | 0 | 0 | 1 | 0 | 0 |
| Carbohydrate | Glycolysis, Gluconeogenesis, and Pyruvate Metabolism | Isobar: hexose diphosphates | 0 | 0 | 0 | 0 | 1 |
| Cofactors and Vitamins | Nicotinate and Nicotinamide Metabolism | nicotinamide ribonucleotide (NMN) | 1 | 0 | 0 | 0 | 0 |
| Cofactors and Vitamins | Nicotinate and Nicotinamide Metabolism | nicotinamide riboside | 0 | 0 | 1 | 0 | 0 |
| Cofactors and Vitamins | Nicotinate and Nicotinamide Metabolism | NAD+ | 0 | 0 | 1 | 0 | 0 |
| Cofactors and Vitamins | Vitamin B6 Metabolism | pyridoxamine phosphate | 0 | 0 | 1 | 0 | 0 |
| Cofactors and Vitamins | Vitamin B6 Metabolism | pyridoxamine | 0 | 0 | 1 | 0 | 0 |
| Energy | TCA Cycle | succinate | 1 | 0 | 0 | 0 | 0 |
| Energy | TCA Cycle | alpha-ketoglutarate | 1 | 0 | 0 | 0 | 0 |
| Energy | TCA Cycle | 2-methylcitrate | 0 | 0 | 1 | 1 | 1 |
| Energy | TCA Cycle | aconitate [cis or trans] | 0 | 0 | 1 | 0 | 0 |
| Lipid | Fatty Acid, Dihydroxy | 2R,3R-dihydroxybutyrate | 0 | 0 | 1 | 0 | 0 |
| Lipid | Fatty Acid, Monohydroxy | 5-hydroxyhexanoate | 1 | 0 | 0 | 0 | 0 |
| Lipid | Inositol Metabolism | inositol 1-phosphate (I1P) | 1 | 0 | 0 | 0 | 0 |
| Lipid | Monoacylglycerol | 1-linoleoylglycerol (18:2) | 0 | 1 | 0 | 0 | 0 |
| Nucleotide | Dinucleotide | (3'-5')-adenylylguanosine* | 0 | 0 | 0 | 0 | 1 |
| Nucleotide | Purine Metabolism, (Hypo)Xanthine/Inosine containing | 5-aminoimidazole-4-carboxamide | 0 | 0 | 1 | 0 | 0 |
| Nucleotide | Purine Metabolism, Adenine containing | N6-methyladenosine | 1 | 0 | 0 | 0 | 0 |
| Nucleotide | Purine Metabolism, Adenine containing | 2'-O-methyladenosine | 1 | 0 | 0 | 0 | 0 |
| Nucleotide | Purine Metabolism, Guanine containing | guanine | 1 | 0 | 0 | 0 | 0 |
| Nucleotide | Purine Metabolism, Guanine containing | guanosine-2',3'-cyclic monophosphate | 0 | 1 | 0 | 0 | 0 |
| Nucleotide | Purine Metabolism, Guanine containing | guanosine 3'-monophosphate (3'-GMP) | 0 | 1 | 0 | 0 | 0 |
| Nucleotide | Pyrimidine Metabolism, Cytidine containing | cytidine 2',3'-cyclic monophosphate | 0 | 1 | 0 | 0 | 0 |
| Nucleotide | Pyrimidine Metabolism, Orotate containing | orotidine | 0 | 0 | 1 | 0 | 0 |
| Nucleotide | Pyrimidine Metabolism, Orotate containing | dihydroorotate | 0 | 0 | 1 | 0 | 0 |
| Nucleotide | Pyrimidine Metabolism, Orotate containing | N-carbamoylaspartate | 0 | 0 | 1 | 0 | 0 |
| Nucleotide | Pyrimidine Metabolism, Thymine containing | thymine | 0 | 0 | 1 | 0 | 0 |
| Nucleotide | Pyrimidine Metabolism, Uracil containing | 5,6-dihydrouridine | 1 | 0 | 0 | 0 | 0 |
| Peptide | Gamma-glutamyl Amino Acid | gamma-glutamylhistidine | 0 | 0 | 1 | 0 | 0 |
| Xenobiotics | Food Component/Plant | quinate | 1 | 0 | 0 | 0 | 0 |
| Xenobiotics | Food Component/Plant | 4-hydroxybenzyl alcohol | 1 | 0 | 0 | 0 | 0 |
| Xenobiotics | Food Component/Plant | 3-dehydroshikimate | 1 | 0 | 0 | 0 | 0 |
| Xenobiotics | Food Component/Plant | homocitrate | 0 | 0 | 1 | 0 | 0 |

TABLE 48

Metabolites uniquely secreted by individual strains or strain consortia in minimal media.
For individual strains, secreted metabolites with intensities >1.5 fold than remaining two strains on same media. For strain consortia, secreted metabolites with intensitries >1.5 fold than corresponding individual strains

| Super Pathway | Pathway | Metabolite | Ba PTA84 | Ba PTA85 | Bs PTA86 | Ba PTA84 + Ba PTA85 | Ba PTA84 + Ba PTA85 + Bs PTA86 |
|---|---|---|---|---|---|---|---|
| Amino Acid | Alanine and Aspartate Metabolism | N-acetylasparagine | 0 | 1 | 0 | 0 | 0 |
| Amino Acid | Alanine and Aspartate Metabolism | N-acetylaspartate (NAA) | 0 | 1 | 0 | 0 | 0 |
| Amino Acid | Creatine Metabolism | guanidinoacetate | 0 | 0 | 1 | 0 | 1 |
| Amino Acid | Glutamate Metabolism | glutamine | 1 | 0 | 0 | 0 | 0 |
| Amino Acid | Glutamate Metabolism | S-1-pyrroline-5-carboxylate | 0 | 1 | 0 | 0 | 0 |
| Amino Acid | Glutamate Metabolism | N-acetylglutamine | 0 | 1 | 0 | 0 | 0 |
| Amino Acid | Glutamate Metabolism | 2-pyrrolidinone | 0 | 1 | 0 | 0 | 0 |
| Amino Acid | Glutamate Metabolism | N-acetylglutamate | 0 | 1 | 0 | 0 | 0 |
| Amino Acid | Glutamate Metabolism | carboxyethyl-GABA | 0 | 0 | 1 | 0 | 0 |
| Amino Acid | Glutamate Metabolism | beta-citrylglutamate | 0 | 0 | 0 | 0 | 1 |
| Amino Acid | Glutathione Metabolism | 2-hydroxybutyrate/2-hydroxyisobutyrate | 1 | 0 | 0 | 0 | 0 |
| Amino Acid | Glutathione Metabolism | cysteinylglycine | 0 | 0 | 1 | 1 | 0 |
| Amino Acid | Glycine, Serine and Threonine Metabolism | 2-methylserine | 0 | 1 | 0 | 0 | 0 |
| Amino Acid | Glycine, Serine and Threonine Metabolism | betaine | 0 | 0 | 1 | 0 | 0 |
| Amino Acid | Glycine, Serine and Threonine Metabolism | N-carbamoylserine | 0 | 0 | 0 | 0 | 1 |
| Amino Acid | Histidine Metabolism | cis-urocanate | 0 | 1 | 0 | 0 | 0 |
| Amino Acid | Histidine Metabolism | trans-urocanate | 0 | 1 | 0 | 0 | 0 |
| Amino Acid | Histidine Metabolism | formiminoglutamate | 0 | 1 | 0 | 0 | 0 |
| Amino Acid | Histidine Metabolism | 4-imidazoleacetate | 0 | 1 | 0 | 0 | 0 |
| Amino Acid | Histidine Metabolism | 3-methylhistidine | 0 | 0 | 1 | 0 | 0 |
| Amino Acid | Histidine Metabolism | N-acetylhistidine | 0 | 0 | 0 | 1 | 0 |
| Amino Acid | Histidine Metabolism | histidine | 0 | 0 | 0 | 1 | 0 |
| Amino Acid | Leucine, Isoleucine and Valine Metabolism | 2-hydroxy-3-methylvalerate | 0 | 1 | 0 | 0 | 0 |
| Amino Acid | Leucine, Isoleucine and Valine Metabolism | N-acetylvaline | 0 | 1 | 0 | 0 | 0 |
| Amino Acid | Leucine, Isoleucine and Valine Metabolism | isovalerate (C5) | 0 | 1 | 0 | 0 | 0 |
| Amino Acid | Leucine, Isoleucine and Valine Metabolism | 3-methyl-2-oxobutyrate | 0 | 1 | 0 | 0 | 0 |
| Amino Acid | Leucine, Isoleucine and Valine Metabolism | methylsuccinate | 0 | 1 | 0 | 0 | 0 |
| Amino Acid | Leucine, Isoleucine and Valine Metabolism | N-acetylleucine | 0 | 1 | 0 | 0 | 1 |
| Amino Acid | Leucine, Isoleucine and Valine Metabolism | N-acetylisoleucine | 0 | 1 | 0 | 1 | 0 |
| Amino Acid | Leucine, Isoleucine and Valine Metabolism | 3-methyl-2-oxovalerate | 0 | 1 | 0 | 0 | 0 |
| Amino Acid | Leucine, Isoleucine and Valine Metabolism | N-butyryl-leucine | 0 | 0 | 1 | 0 | 0 |
| Amino Acid | Leucine, Isoleucine and Valine Metabolism | isovalerylglycine | 0 | 0 | 0 | 1 | 0 |
| Amino Acid | Leucine, Isoleucine and Valine Metabolism | 4-methyl-2-oxopentanoate | 0 | 0 | 0 | 0 | 1 |
| Amino Acid | Lysine Metabolism | N6-acetyllysine | 0 | 1 | 0 | 0 | 0 |
| Amino Acid | Lysine Metabolism | N,N-dimethyl-5-aminovalerate | 0 | 0 | 1 | 0 | 0 |
| Amino Acid | Lysine Metabolism | pipecolate | 0 | 0 | 1 | 0 | 0 |
| Amino Acid | Lysine Metabolism | saccharopine | 0 | 0 | 1 | 0 | 1 |
| Amino Acid | Lysine Metabolism | cadaverine | 0 | 0 | 0 | 0 | 1 |
| Amino Acid | Lysine Metabolism | N6,N6,N6-trimethyllysine | 0 | 0 | 0 | 0 | 1 |
| Amino Acid | Lysine Metabolism | N6-methyllysine | 0 | 0 | 0 | 0 | 1 |
| Amino Acid | Lysine Metabolism | N6,N6-dimethyllysine | 0 | 0 | 0 | 0 | 1 |
| Amino Acid | Methionine, Cysteine, SAM and Taurine Metabolism | methionine sulfone | 1 | 0 | 0 | 0 | 0 |
| Amino Acid | Methionine, Cysteine, SAM and Taurine Metabolism | homocystine | 0 | 1 | 0 | 0 | 0 |
| Amino Acid | Methionine, Cysteine, SAM and Taurine Metabolism | N-acetylmethionine | 0 | 1 | 0 | 1 | 0 |
| Amino Acid | Methionine, Cysteine, SAM and Taurine Metabolism | S-adenosylmethionine (SAM) | 0 | 1 | 0 | 0 | 0 |

TABLE 48-continued

Metabolites uniquely secreted by individual strains or strain consortia in minimal media. For individual strains, secreted metabolites with intensities >1.5 fold than remaining two strains on same media. For strain consortia, secreted metabolites with intensitries >1.5 fold than corresponding individual strains

| Super Pathway | Pathway | Metabolite | Ba PTA84 | Ba PTA85 | Bs PTA86 | Ba PTA84 + Ba PTA85 | Ba PTA84 + Ba PTA85 + Bs PTA86 |
|---|---|---|---|---|---|---|---|
| Amino Acid | Methionine, Cysteine, SAM and Taurine Metabolism | N-acetylmethionine sulfoxide | 0 | 1 | 0 | 0 | 0 |
| Amino Acid | Methionine, Cysteine, SAM and Taurine Metabolism | S-methylcysteine | 0 | 0 | 1 | 0 | 0 |
| Amino Acid | Methionine, Cysteine, SAM and Taurine Metabolism | 2-hydroxy-4-(methylthio)butanoic acid | 0 | 0 | 1 | 0 | 0 |
| Amino Acid | Phenylalanine Metabolism | N-acetylphenylalanine | 0 | 1 | 0 | 0 | 0 |
| Amino Acid | Phenylalanine Metabolism | phenylpyruvate | 0 | 1 | 0 | 0 | 0 |
| Amino Acid | Phenylalanine Metabolism | phenethylamine | 0 | 1 | 0 | 0 | 0 |
| Amino Acid | Phenylalanine Metabolism | N-butyryl-phenylalanine | 0 | 0 | 1 | 0 | 0 |
| Amino Acid | Phenylalanine Metabolism | phenyllactate (PLA) | 0 | 0 | 0 | 1 | 0 |
| Amino Acid | Phenylalanine Metabolism | 2-hydroxyphenylacetate | 0 | 0 | 0 | 0 | 1 |
| Amino Acid | Phenylalanine Metabolism | N-succinyl-phenylalanine | 0 | 0 | 0 | 0 | 1 |
| Amino Acid | Polyamine Metabolism | spermine | 0 | 1 | 0 | 1 | 0 |
| Amino Acid | Polyamine Metabolism | spermidine | 0 | 1 | 0 | 1 | 0 |
| Amino Acid | Polyamine Metabolism | (N(1) + N(8))-acetylspermidine | 0 | 1 | 0 | 0 | 0 |
| Amino Acid | Polyamine Metabolism | 5-methylthioadenosine (MTA) | 0 | 1 | 0 | 0 | 0 |
| Amino Acid | Polyamine Metabolism | 4-acetamidobutanoate | 0 | 1 | 0 | 0 | 0 |
| Amino Acid | Polyamine Metabolism | putrescine | 0 | 0 | 1 | 0 | 0 |
| Amino Acid | Polyamine Metabolism | N(1)-acetylspermine | 0 | 0 | 0 | 0 | 1 |
| Amino Acid | Tryptophan Metabolism | anthranilate | 1 | 0 | 0 | 1 | 0 |
| Amino Acid | Tryptophan Metabolism | tryptophan | 0 | 0 | 1 | 1 | 0 |
| Amino Acid | Tryptophan Metabolism | N-acetyltryptophan | 0 | 0 | 0 | 1 | 1 |
| Amino Acid | Tryptophan Metabolism | indolelactate | 0 | 0 | 0 | 1 | 1 |
| Amino Acid | Tyrosine Metabolism | 4-hydroxyphenylpyruvate | 0 | 1 | 0 | 0 | 0 |
| Amino Acid | Tyrosine Metabolism | 3-methoxytyramine | 0 | 1 | 0 | 0 | 0 |
| Amino Acid | Tyrosine Metabolism | tyramine | 0 | 1 | 0 | 0 | 0 |
| Amino Acid | Tyrosine Metabolism | N-acetyltyrosine | 0 | 1 | 0 | 0 | 0 |
| Amino Acid | Tyrosine Metabolism | 3-(4-hydroxyphenyl)lactate (HPLA) | 0 | 0 | 0 | 1 | 1 |
| Amino Acid | Tyrosine Metabolism | 1-carboxyethyltyrosine | 0 | 0 | 0 | 1 | 0 |
| Amino Acid | Urea cycle; Arginine and Proline Metabolism | N-acetylproline | 0 | 1 | 0 | 0 | 0 |
| Amino Acid | Urea cycle; Arginine and Proline Metabolism | N-alpha-acetylornithine | 0 | 1 | 0 | 0 | 0 |
| Amino Acid | Urea cycle; Arginine and Proline Metabolism | N-acetylcitrulline | 0 | 1 | 0 | 0 | 0 |
| Amino Acid | Urea cycle; Arginine and Proline Metabolism | N-acetylarginine | 0 | 1 | 0 | 0 | 0 |
| Amino Acid | Urea cycle; Arginine and Proline Metabolism | hydroxyproline | 0 | 1 | 0 | 0 | 0 |
| Amino Acid | Urea cycle; Arginine and Proline Metabolism | N,N,N-trimethyl-alanylproline betaine (TMAP) | 0 | 0 | 1 | 0 | 0 |
| Amino Acid | Urea cycle; Arginine and Proline Metabolism | ornithine | 0 | 0 | 1 | 1 | 0 |
| Amino Acid | Urea cycle; Arginine and Proline Metabolism | N-monomethylarginine | 0 | 0 | 1 | 0 | 1 |
| Amino Acid | Urea cycle; Arginine and Proline Metabolism | urea | 0 | 0 | 0 | 1 | 0 |
| Amino Acid | Urea cycle; Arginine and Proline Metabolism | dimethylarginine (ADMA + SDMA) | 0 | 0 | 0 | 0 | 1 |
| Amino Acid | Urea cycle; Arginine and Proline Metabolism | homocitrulline | 0 | 0 | 0 | 0 | 1 |
| Carbohydrate | Aminosugar Metabolism | N-acetyl-glucosamine 1-phosphate | 0 | 1 | 0 | 0 | 0 |
| Carbohydrate | Aminosugar Metabolism | N-acetylglucosamine/N-acetylgalactosamine | 0 | 1 | 0 | 0 | 0 |
| Carbohydrate | Aminosugar Metabolism | glucuronate | 0 | 1 | 0 | 0 | 0 |
| Carbohydrate | Aminosugar Metabolism | N-acetylmuramate | 0 | 0 | 1 | 0 | 0 |

TABLE 48-continued

Metabolites uniquely secreted by individual strains or strain consortia in minimal media.
For individual strains, secreted metabolites with intensities >1.5 fold than remaining two strains on same media. For strain consortia, secreted metabolites with intensitries >1.5 fold than corresponding individual strains

| Super Pathway | Pathway | Metabolite | Ba PTA84 | Ba PTA85 | Bs PTA86 | Ba PTA84 + Ba PTA85 | Ba PTA84 + Ba PTA85 + Bs PTA86 |
|---|---|---|---|---|---|---|---|
| Carbohydrate | Disaccharides and Oligosaccharides | sucrose | 0 | 1 | 0 | 1 | 0 |
| Carbohydrate | Fructose, Mannose and Galactose Metabolism | mannose | 0 | 0 | 1 | 0 | 0 |
| Carbohydrate | Fructose, Mannose and Galactose Metabolism | galactonate | 0 | 0 | 0 | 0 | 1 |
| Carbohydrate | Fructose, Mannose and Galactose Metabolism | fructose | 0 | 0 | 0 | 0 | 1 |
| Carbohydrate | Glycolysis, Gluconeogenesis, and Pyruvate Metabolism | 3-phosphoglycerate | 0 | 1 | 0 | 0 | 0 |
| Carbohydrate | Glycolysis, Gluconeogenesis, and Pyruvate Metabolism | phosphoenolpyruvate (PEP) | 0 | 1 | 0 | 0 | 0 |
| Carbohydrate | Glycolysis, Gluconeogenesis, and Pyruvate Metabolism | pyruvate | 0 | 0 | 1 | 1 | 0 |
| Carbohydrate | Glycolysis, Gluconeogenesis, and Pyruvate Metabolism | glucose 6-phosphate | 0 | 0 | 0 | 0 | 1 |
| Carbohydrate | Glycolysis, Gluconeogenesis, and Pyruvate Metabolism | Isobar: hexose diphosphates | 0 | 0 | 0 | 0 | 1 |
| Carbohydrate | Pentose Metabolism | sedoheptulose | 0 | 1 | 0 | 0 | 0 |
| Carbohydrate | Pentose Metabolism | ribulonate/xylulonate/lyxonate* | 0 | 0 | 0 | 0 | 1 |
| Carbohydrate | Pentose Metabolism | arabonate/xylonate | 0 | 0 | 0 | 0 | 1 |
| Carbohydrate | Pentose Metabolism | ribitol | 0 | 0 | 0 | 0 | 1 |
| Carbohydrate | Pentose Phosphate Pathway | sedoheptulose-7-phosphate | 0 | 1 | 0 | 0 | 0 |
| Cofactors and Vitamins | Ascorbate and Aldarate Metabolism | oxalate (ethanedioate) | 0 | 0 | 1 | 1 | 0 |
| Cofactors and Vitamins | Ascorbate and Aldarate Metabolism | glucarate (saccharate) | 0 | 0 | 0 | 0 | 1 |
| Cofactors and Vitamins | Nicotinate and Nicotinamide Metabolism | nicotinamide ribonucleotide (NMN) | 1 | 0 | 0 | 0 | 0 |
| Cofactors and Vitamins | Nicotinate and Nicotinamide Metabolism | nicotinate ribonucleoside | 0 | 1 | 0 | 0 | 0 |
| Cofactors and Vitamins | Nicotinate and Nicotinamide Metabolism | nicotinate | 0 | 1 | 0 | 0 | 0 |
| Cofactors and Vitamins | Nicotinate and Nicotinamide Metabolism | nicotinamide riboside | 0 | 0 | 1 | 0 | 0 |
| Cofactors and Vitamins | Nicotinate and Nicotinamide Metabolism | trigonelline (N'-methylnicotinate) | 0 | 0 | 1 | 0 | 0 |
| Cofactors and Vitamins | Nicotinate and Nicotinamide Metabolism | NAD+ | 0 | 0 | 0 | 1 | 0 |
| Cofactors and Vitamins | Pantothenate and CoA Metabolism | pantothenate (Vitamin B5) | 0 | 1 | 0 | 0 | 1 |
| Cofactors and Vitamins | Pantothenate and CoA Metabolism | pantoate | 0 | 0 | 0 | 0 | 1 |
| Cofactors and Vitamins | Pterin Metabolism | pterin | 0 | 1 | 0 | 0 | 0 |
| Cofactors and Vitamins | Vitamin B6 Metabolism | pyridoxine (Vitamin B6) | 0 | 0 | 1 | 0 | 0 |
| Energy | TCA Cycle | citraconate/glutaconate | 0 | 1 | 0 | 0 | 0 |
| Energy | TCA Cycle | fumarate | 0 | 0 | 0 | 1 | 1 |
| Energy | TCA Cycle | isocitric lactone | 0 | 0 | 0 | 0 | 1 |
| Energy | TCA Cycle | malate | 0 | 0 | 0 | 0 | 1 |
| Lipid | Carnitine Metabolism | deoxycarnitine | 0 | 0 | 1 | 1 | 0 |
| Lipid | Fatty Acid Metabolism (Acyl Carnitine, Monounsaturated) | 5-dodecenoylcarnitine (C12:1) | 0 | 1 | 0 | 0 | 0 |
| Lipid | Fatty Acid, Amide | eicosenamide (20:1)* | 0 | 0 | 1 | 0 | 0 |
| Lipid | Fatty Acid, Dicarboxylate | azelate (C9-DC) | 1 | 0 | 0 | 0 | 0 |
| Lipid | Fatty Acid, Dicarboxylate | 2-hydroxyglutarate | 0 | 1 | 0 | 0 | 0 |

TABLE 48-continued

Metabolites uniquely secreted by individual strains or strain consortia in minimal media.
For individual strains, secreted metabolites with intensities >1.5 fold than remaining two strains on same media. For strain consortia, secreted metabolites with intensitries >1.5 fold than corresponding individual strains

| Super Pathway | Pathway | Metabolite | Ba PTA84 | Ba PTA85 | Bs PTA86 | Ba PTA84 + Ba PTA85 | Ba PTA84 + Ba PTA85 + Bs PTA86 |
|---|---|---|---|---|---|---|---|
| Lipid | Fatty Acid, Dihydroxy | 2S,3R-dihydroxybutyrate | 0 | 0 | 1 | 0 | 0 |
| Lipid | Fatty Acid, Dihydroxy | 2R,3R-dihydroxybutyrate | 0 | 0 | 0 | 1 | 0 |
| Lipid | Fatty Acid, Monohydroxy | 5-hydroxyhexanoate | 0 | 1 | 0 | 0 | 1 |
| Lipid | Fatty Acid, Monohydroxy | 3-hydroxyoctanoate | 0 | 1 | 0 | 0 | 0 |
| Lipid | Fatty Acid, Monohydroxy | 3-hydroxyhexanoate | 0 | 0 | 0 | 0 | 1 |
| Lipid | Glycerolipid Metabolism | glycerol 3-phosphate | 0 | 1 | 0 | 0 | 0 |
| Lipid | Inositol Metabolism | chiro-inositol | 0 | 0 | 1 | 1 | 1 |
| Lipid | Inositol Metabolism | myo-inositol | 0 | 0 | 0 | 0 | 1 |
| Lipid | Lysophospholipid | 1-stearoyl-GPE (18:0) | 0 | 1 | 0 | 0 | 0 |
| Lipid | Lysophospholipid | 1-palmitoyl-GPE (16:0) | 0 | 0 | 1 | 0 | 0 |
| Lipid | Mevalonate Metabolism | 3-hydroxy-3-methylglutarate | 0 | 0 | 1 | 0 | 1 |
| Lipid | Mevalonate Metabolism | mevalonate | 0 | 0 | 0 | 0 | 1 |
| Lipid | Monoacylglycerol | 1-linoleoylglycerol (18:2) | 0 | 0 | 1 | 0 | 0 |
| Lipid | Phospholipid Metabolism | choline | 0 | 0 | 1 | 0 | 0 |
| Lipid | Phospholipid Metabolism | glycerophosphorylcholine (GPC) | 0 | 0 | 1 | 1 | 0 |
| Lipid | Phospholipid Metabolism | glycerophosphoinositol* | 0 | 0 | 0 | 0 | 1 |
| Lipid | Phospholipid Metabolism | glycerophosphoethanolamine | 0 | 0 | 0 | 0 | 1 |
| Lipid | Short Chain Fatty Acid | butyrate/isobutyrate (4:0) | 0 | 1 | 0 | 0 | 0 |
| Nucleotide | Dinucleotide | (3'-5')-uridylyladenosine | 1 | 0 | 0 | 1 | 0 |
| Nucleotide | Dinucleotide | (3'-5')-uridylyluridine | 0 | 0 | 1 | 1 | 0 |
| Nucleotide | Dinucleotide | (3'-5')-cytidylyladenosine | 0 | 0 | 0 | 1 | 0 |
| Nucleotide | Purine Metabolism, (Hypo)Xanthine/Inosine containing | xanthine | 0 | 1 | 0 | 1 | 0 |
| Nucleotide | Purine Metabolism, (Hypo)Xanthine/Inosine containing | xanthosine | 0 | 1 | 0 | 0 | 0 |
| Nucleotide | Purine Metabolism, (Hypo)Xanthine/Inosine containing | 5-aminoimidazole-4-carboxamide | 0 | 0 | 0 | 1 | 1 |
| Nucleotide | Purine Metabolism, Adenine containing | adenosine-2',3'-cyclic monophosphate | 1 | 0 | 0 | 0 | 0 |
| Nucleotide | Purine Metabolism, Adenine containing | adenosine | 1 | 0 | 0 | 0 | 0 |
| Nucleotide | Purine Metabolism, Adenine containing | adenine | 1 | 0 | 0 | 0 | 0 |
| Nucleotide | Purine Metabolism, Adenine containing | AMP | 1 | 0 | 0 | 1 | 0 |
| Nucleotide | Purine Metabolism, Adenine containing | N6-methyladenosine | 0 | 1 | 0 | 0 | 0 |
| Nucleotide | Purine Metabolism, Adenine containing | 1-methyladenine | 0 | 1 | 0 | 0 | 0 |
| Nucleotide | Purine Metabolism, Adenine containing | 2'-O-methyladenosine | 0 | 0 | 0 | 0 | 1 |
| Nucleotide | Purine Metabolism, Adenine containing | 2'-AMP | 0 | 0 | 0 | 0 | 1 |
| Nucleotide | Purine Metabolism, Adenine containing | N6-succinyladenosine | 0 | 0 | 0 | 0 | 1 |
| Nucleotide | Purine Metabolism, Guanine containing | guanosine | 0 | 1 | 0 | 0 | 0 |
| Nucleotide | Purine Metabolism, Guanine containing | 7-methylguanine | 0 | 1 | 0 | 0 | 0 |
| Nucleotide | Purine Metabolism, Guanine containing | guanosine 2'-monophosphate (2'-GMP)* | 0 | 0 | 0 | 0 | 1 |
| Nucleotide | Pyrimidine Metabolism, Cytidine containing | cytidine 2',3'-cyclic monophosphate | 1 | 0 | 0 | 0 | 0 |
| Nucleotide | Pyrimidine Metabolism, Cytidine containing | 5-methylcytidine | 0 | 1 | 0 | 0 | 0 |
| Nucleotide | Pyrimidine Metabolism, Cytidine containing | CMP | 0 | 0 | 0 | 1 | 0 |
| Nucleotide | Pyrimidine Metabolism, Cytidine containing | cytidine | 0 | 0 | 0 | 1 | 0 |
| Nucleotide | Pyrimidine Metabolism, Cytidine containing | 5-methylcytosine | 0 | 0 | 0 | 0 | 1 |

TABLE 48-continued

Metabolites uniquely secreted by individual strains or strain consortia in minimal media. For individual strains, secreted metabolites with intensities >1.5 fold than remaining two strains on same media. For strain consortia, secreted metabolites with intensitries >1.5 fold than corresponding individual strains

| Super Pathway | Pathway | Metabolite | Ba PTA84 | Ba PTA85 | Bs PTA86 | Ba PTA84 + Ba PTA85 | Ba PTA84 + Ba PTA85 + Bs PTA86 |
|---|---|---|---|---|---|---|---|
| Nucleotide | Pyrimidine Metabolism, Orotate containing | orotidine | 0 | 1 | 0 | 0 | 0 |
| Nucleotide | Pyrimidine Metabolism, Orotate containing | N-carbamoylaspartate | 0 | 1 | 0 | 0 | 0 |
| Nucleotide | Pyrimidine Metabolism, Orotate containing | dihydroorotate | 0 | 0 | 0 | 1 | 0 |
| Nucleotide | Pyrimidine Metabolism, Thymine containing | thymine | 0 | 1 | 0 | 0 | 0 |
| Nucleotide | Pyrimidine Metabolism, Uracil containing | uridine-2',3'-cyclic monophosphate | 1 | 0 | 0 | 0 | 0 |
| Nucleotide | Pyrimidine Metabolism, Uracil containing | pseudouridine | 0 | 1 | 0 | 0 | 0 |
| Nucleotide | Pyrimidine Metabolism, Uracil containing | 5,6-dihydrouridine | 0 | 1 | 0 | 0 | 0 |
| Nucleotide | Pyrimidine Metabolism, Uracil containing | 3-ureidopropionate | 0 | 0 | 1 | 0 | 0 |
| Nucleotide | Pyrimidine Metabolism, Uracil containing | UMP | 0 | 0 | 0 | 1 | 0 |
| Nucleotide | Pyrimidine Metabolism, Uracil containing | uridine | 0 | 0 | 0 | 1 | 0 |
| Nucleotide | Pyrimidine Metabolism, Uracil containing | uridine 2'-monophosphate (2'-UMP)* | 0 | 0 | 0 | 0 | 1 |
| Nucleotide | Pyrimidine Metabolism, Uracil containing | 2'-O-methyluridine | 0 | 0 | 0 | 0 | 1 |
| Partially Characterized Molecules | Partially Characterized Molecules | pentose acid* | 0 | 0 | 1 | 0 | 1 |
| Peptide | Dipeptide | cyclo(gly-phe) | 0 | 0 | 1 | 0 | 0 |
| Peptide | Dipeptide | tryptophylglycine | 0 | 0 | 1 | 0 | 0 |
| Peptide | Gamma-glutamyl Amino Acid | gamma-glutamyltyrosine | 1 | 0 | 0 | 0 | 0 |
| Peptide | Gamma-glutamyl Amino Acid | gamma-glutamylphenylalanine | 1 | 0 | 0 | 0 | 0 |
| Xenobiotics | Benzoate Metabolism | benzoate | 0 | 1 | 0 | 0 | 0 |
| Xenobiotics | Benzoate Metabolism | hippurate | 0 | 0 | 0 | 0 | 1 |
| Xenobiotics | Chemical | 2,4-di-tert-butylphenol | 0 | 1 | 0 | 0 | 0 |
| Xenobiotics | Drug - Topical Agents | 2,6-dihydroxybenzoic acid | 0 | 0 | 1 | 0 | 0 |
| Xenobiotics | Food Component/Plant | 1-kestose | 1 | 0 | 0 | 0 | 0 |
| Xenobiotics | Food Component/Plant | 2-isopropylmalate | 0 | 1 | 0 | 0 | 0 |
| Xenobiotics | Food Component/Plant | 4-hydroxybenzyl alcohol | 0 | 1 | 0 | 0 | 0 |
| Xenobiotics | Food Component/Plant | 3-dehydroshikimate | 0 | 1 | 0 | 0 | 0 |
| Xenobiotics | Food Component/Plant | maltol | 0 | 0 | 1 | 1 | 0 |
| Xenobiotics | Food Component/Plant | histidine betaine (hercynine)* | 0 | 0 | 1 | 0 | 0 |
| Xenobiotics | Food Component/Plant | histidinol | 0 | 0 | 0 | 0 | 1 |
| Xenobiotics | Food Component/Plant | homocitrate | 0 | 0 | 0 | 0 | 1 |
| Xenobiotics | Food Component/Plant | pyrraline | 0 | 0 | 0 | 0 | 1 |
| Xenobiotics | Food Component/Plant | 2-keto-3-deoxy-gluconate | 0 | 0 | 0 | 0 | 1 |

A principal component analysis (PCA) of the normalized metabolite abundances showed a clear separation between samples from rich and minimal media along the first principal component (~70% explained variance), both in the supernatant and pellet (TABLE 51 and TABLE 53). Additionally, the separation between samples along the two first principal components suggested that under the tested growth conditions the strains and consortia differ in their profiles of secreted/consumed metabolites as well as their cell-pellet small-molecule content.

Interestingly, looking at the metabolite profiles in the culture supernatant (TABLE 51), all strains and strain combinations tightly clustered in the rich media samples while they separated under minimal media conditions. Indeed, looking at the number of secreted metabolites under each condition (abundance>1.5 fold above media controls, FIG. 44A), cells in all cultures secreted approximately 100 named metabolites in rich media with a median Jaccard similarity of 0.8, compared to a range of 134 to 250 secreted metabolites in minimal media with only 0.54 median overlap (Mann-Whitney p-value=0.01). This shows that especially under minimal media conditions, each strain or consortia secretes distinct sets of small molecules.

In rich media, Ba PTA84 secreted the largest number of metabolites (104 metabolites) and it had the fewest uniquely secreted metabolites (abundance>1.5 fold higher than other individual strains) across both media. Thirteen unique metabolites related to amino acid, central carbon, nucleotide, and lipid metabolisms as well as some xenobiotic compounds (i.e. quinate, 4-hydroxybenzyl alcohol, and 3-dehydroshikimate) were detected.

As expected, the three-strain consortium was found to have the largest number of secreted metabolites in minimal media, a total of 250 metabolites. These include host beneficial metabolites such as betaine, kynurenine, indolactate, tyrosol, citrulline, tricarballylate, vitamins B5 and B6, hippurate, and kestose. Of all three single strains, the culture supernatant of Bs PTA86 carried the highest number of metabolites in minimal media (219 metabolites), followed by Ba PTA85 and Ba PTA84 with 195 and 130 metabolites, respectively. Ba PTA85 had the greatest number of unique secreted metabolites, a total 78 metabolites. The larger number of secreted metabolites under minimal media conditions was partly due to a higher number of amino acid metabolism intermediates, followed by nucleotide and carbohydrate metabolites (FIG. 44B). Thus, our results suggest that the different strains may use different metabolic strategies to synthesize amino acids/proteins, nucleotide, and carbohydrate molecules given a limited nutrient availability.

Genome Properties of Ba PTA84 and PTA85, and Bs PTA86

The genomes of Ba PTA84, Ba PTA85, and Bs PTA86 were sequenced by PacBio sequencing. Assembly of Ba PTA84 and Bs PTA86 genomes yielded 1 contig each while the Ba PTA85 assembly contained 2 contigs—a large 4,084,681 bp contig and a smaller 231,132 bp long contig. The genome properties and annotation of different features are summarized in TABLE 49. The whole-genome sequences were deposited at DDBJ/ENA/GenBank under BioProject numbers PRJNA701126 and PRJNA701127.

TABLE 49

Genome Assembly and Annotation Summary of *Bacillus* spp.

| Feature | PTA-84 | PTA-85 | PTA-86 |
|---|---|---|---|
| No. sequences | 1 | 2 | 1 |
| Total genome size (bp) | 4,090,715 | 4,315,813 | 4,089,676 |
| CDS | 3,957 | 4,277 | 4,027 |
| Miscellaneous feature | 8 | 12 | 8 |
| Mobile Elements | 2 | 2 | 2 |
| Non-coding RNA | 11 | 11 | 11 |
| Operons | 753 | 844 | 747 |
| Ribosomal RNA | 27 | 27 | 30 |
| Ribosomal binding sites | 4,004 | 4,212 | 4,026 |
| Transcription Terminators | 2,082 | 2,197 | 2,196 |
| Riboswitch | 44 | 45 | 48 |
| Transfer RNA | 86 | 87 | 86 |
| Transfer-messenger RNA | 1 | 1 | 1 |

Core-Genomes of Ba PTA84, Ba PTA85, and Bs PTA86

Ortholog analysis was performed to identify paralogous and/or orthologous relationships between the genomes of Ba PTA84, Ba PTA85, and Bs PTA86. Ba PTA84 shared the highest number of genes with 99.4% gene presentation in orthogroups while Ba PTA85, and Bs PTA86 shared 93.6% and 90.1%, respectively (TABLE 50). A total of 3,024 orthologs were shared among all three strains while 586 orthologs were shared only between Ba PTA84 and Ba PTA85, 60 orthologs between Ba PTA84 and Bs PTA86, and 34 orthologs were shared only between Ba PTA85, and Bs PTA86.

TABLE 50

Summary of Ortholog Statistics of the Ba PTA84, Ba PTA85, and the Bs PTA86

| Feature | PTA84 | PTA85 | PTA86 |
|---|---|---|---|
| Number of genes | 3,884[a] | 4,189 | 4,012 |
| Number of genes in orthogroups | 3,862 | 3,919 | 3,614 |
| Number of unassigned genes | 22 | 270 | 398 |
| Percentage of genes in orthogroups | 99.4 | 93.6 | 90.1 |
| Percentage of unassigned genes | 0.6 | 6.4 | 9.9 |
| Number of orthogroups containing species | 3,670 | 3,668 | 3,146 |
| Percentage of orthogroups containing species | 97.7 | 97.7 | 83.8 |
| Number of species-specific orthogroups | — | 24 | 28 |
| Number of genes in species-specific orthogroups | — | 53 | 62 |
| Percentage of genes in species-specific orthogroups | — | 1.3 | 1.5 |

Phylogenetic analysis of Ba PTA84, Ba PTA85, and Bs PTA86—Phylogenetic relationships of the three genomes were explored with UBCG v3.0 which employs a set of 92 single-copy core genes commonly present in all bacterial genomes. Ba PTA84, Ba PTA85 and Bs PTA86 genomes were compared against the genomes of *B. amyloliquifaciens, B. velezensis* and *B. subtilis* strains along with *Lactobacillus reuterii* as an outgroup (Accession numbers: AL009126, CP000560, CP002627, CP002634, CP002927, HE617159, HG514499, JMEF0100001, CP005997, CP009748, CP009749, CP011115, LHCC01000001, CP014471 and QVMX01000001). Both strains Ba PTA84 and Ba PTA85 showed closest relationship to *Bacillus amyloliquefaciens* B4 while Bs PTA86 showed closest relationship to *Bacillus subtilis* subsp. *Subtilis* 168.

Genome analyses ofBa PTA84, Ba PTA85, and Bs PTA86—The assembled genome sequences of3 *Bacillus* strains were annotated for the following potential probiotic properties, enzymes, antioxidants, bacteriocins, and secondary metabolites, and for the presence of genes of potential safety concerns such as genes encoding toxins, virulence factors, and antimicrobial resistance genes. A detailed description of each of the above-mentioned features is described below.

Selected enzymes analyses—TABLE 51 illustrates the presence and absence of genes encoding selected digestive enzymes identified in the *Bacillus* genomes. All three *Bacillus* genomes encode lipase, 3-phytase, alpha-amylase, endo-1,4-β xylanase A, β glucanase, β-glucanase, β-mannanase, pectin lyase, and alpha galactosidase. Bs PTA86 carried two copies of β-mannanase genes, Table 54. β-mannanase catalyzes the hydrolysis of β-1,4-linkage of glucomannan releasing mannan oligosaccharide (24, 54). This enzyme along with phytase, xylanase, amylase are added as feed ingredients to improve feed digestibility (55-57). Of the three *Bacillus* genomes, only Bs PTA86 possessed pullulanase, oligo-1,6-glucosidase, and glycogen degradating enzymes such as 1,4-alpha-glucan branching enzyme. A complete list of enzymes in the three *Bacillus* genomes are presented in TABLE 54.

TABLE 51

| Enzyme | Ba PTA84 (strain 24) | Ba PTA85 (strain 36) | Bs PTA86 (strain 105) |
|---|---|---|---|
| Lipase | Present | Present | Present |
| 3-phytase | Present | Present | Present |
| Alpha-amylase | Present | Presen Present t | Present |
| Endo-1,4-beta-zylanase A | Present | Present | Present |
| Beta-glucanase | Present | Present | Present |
| Beta-mannanase | Present | Present | Present (Multicopy) |
| Pectin lyase | Present | Present | Present |
| Alpha-galactosidase | Present | Present | Present |
| 1,4-Alpha-glucan branching enzyme | Absent | Absent | Present |

TABLE 51-continued

| Enzyme | Ba PTA84 (strain 24) | Ba PTA85 (strain 36) | Bs PTA86 (strain 105) |
|---|---|---|---|
| Pullulanase | Absent | Absent | Present |
| Oligo-1,6-glucosidase 1 | Absent | Absent | Present |

Secondary metabolites—Secondary metabolite clusters accounted for 20, 20, and 12% of the genomes of *Bacillus* Ba PTA84, Ba PTA85, and Bs PTA86, respectively. TABLE 52 illustrates the respective clusters for each *Bacillus* genome. Ba PTA84 and Ba PTA85 genomes contained 13 secondary metabolite clusters whereas Bs PTA86 genome encoded for 10 clusters. More than half of the clusters were contributed by biosynthetic genes for antimicrobial peptides (AMPs). Ba PTA84 and Ba PTA85 genomes encoded for ribosomally-synthesized lichenicidin A, circularin, LCI, and salicylate containing AMPs that were not found in Bs PTA86 genome. The latter possessed subtilosin A, a cyclic antimicrobial peptide that are potent against some Gram positive and Gram negative bacteria such as *Listeria monocytogenes, Enterococcus faecalis, Porphyromonas gingivalis, Klebsiella rhizophila, Streptococcus pyogenes* and *Shigella sonnei, Pseudomonas aeruginosa* and *Staphylococcus aureus* (58-60). For non-ribosomally synthesized AMPs, Ba PTA84 and Ba PTA 85 carried plipastatin, surfactin, bacillibactin, bacilysin, and gramicidin. Only the latter was absent in Bs PTA 86. TABLE 53 provides a tabulation and comparison of some antimicrobial peptides and TABLE 54 provides digestive enzymes provided by the strains.

TABLE 52

| Secondary Metabolites Gene Clusters of Ba PTA84, Ba PTA85, and Bs PTA86 | | | |
|---|---|---|---|
| Type | PTA8 | PTA | PTA |
| Class/Cluster* | 4 | 85 | 86 |
| Bacteriocin and RiPPs class | | | |
| Amylocyclicin | 1 | 1 | 0 |
| ComX1 | 1 | 1 | 0 |
| LCI | 1 | 1 | 0 |
| Lanthipeptide_class_II | 1 | 1 | 0 |
| Competence | 0 | 0 | 1 |
| Subtilosin_(SboX) | 0 | 0 | 1 |

TABLE 52-continued

| Secondary Metabolites Gene Clusters of Ba PTA84, Ba PTA85, and Bs PTA86 | | | |
|---|---|---|---|
| Type | PTA8 | PTA | PTA |
| Secondary metabolite biosynthesis gene cluster | | | |
| CDPS | 0 | 0 | 1 |
| NRPS | 1 | 1 | 2 |
| NRPS, PKS-like, T3PKS, transAT-PKS, transAT-PKS-like | 0 | 0 | 1 |
| NRPS, T3PKS, transAT-PKS, transAT-PKS-like | 1 | 1 | 0 |
| NRPS, bacteriocin | 1 | 1 | 0 |
| NRPS, betalactone | 0 | 0 | 1 |
| NRPS, betalactone, transAT-PKS | 1 | 1 | 0 |
| NRPS, trans AT-PKS | 1 | 1 | 0 |
| PKS-like | 1 | 1 | 0 |
| T3PKS | 1 | 1 | 1 |
| head_to_tail, sactipeptide | 0 | 0 | 1 |
| lanthipeptide | 1 | 1 | 0 |
| terpene | 2 | 2 | 2 |
| transAT-PKS | 1 | 1 | 0 |
| transAT-PKS, transAT-PKS-like | 1 | 1 | 0 |
| other | 1 | 1 | 1 |

*Abbreviations, RiPP, ribosomally synthesized and post-translationally modified peptides; NRPS, Non-Ribosomal Peptide Synthase; PKS, polyketide synthasePolyketide Synthase; T3PKS, type III polyketide synthase; trans-Type 3-PKS; AT-PKS, trans-acyltransferase polyketide synthase. Acyltransferase PKS.

TABLE 53

| Antimicrobial peptides | | | |
|---|---|---|---|
| PEPTIDE | Ba PTA84 (strain 24) | Ba PTA85 (strain 36) | Bs PTA86 (strain 105) |
| Ribosomally-synthesized antimicrobial peptides | | | |
| Lichenicidin A | Present | Present | Absent |
| Circularin | Present | Present | Absent |
| LCI | Present | Present | Absent |
| Subtilosin A | Absent | Absent | Present |
| Salicylate containing AMPs | | Present | Absent |
| Non-Ribosomally-synthesized antimicrobial peptides | | | |
| Plipastatin | Present | Present | Present |
| Surfactin | Present | Present | Present |
| Bacillibactin | Present | Present | Present |
| Bacilysin | Present | Present | Present |
| Gramicidin/Tyrocidin | Present | Present | Absent |

TABLE 54

| Putative digestive enzymes identified in the genomes of *B. amyloliquefaciens* PTA-84 and PTA85, and *B. subtilis* PTA-85 | | | | |
|---|---|---|---|---|
| Gene Description | Accession Number | *B. amyloliquefaciens* PTA-84 | *B. amyloliquefaciens* PTA-85 | *B. subtilis* PTA-86 |
| 1,4-alpha-glucan branching enzyme GlgB | AGA22754.1 | None | None | JS609_03093 |
| 6-phospho-beta-galactosidase | QDK89482.1 | JS608_01655 | JTE87_02630 | None |
| 6-phospho-beta-glucosidase GmuD | QDK91913.1 | JS608_00187 | JTE87_00044 | JS609_00629 |
| Alpha-amylase | BAT21551.1 | JS608_00728 | JTE87_03556 | JS609_00345 |
| Alpha-galactosidase | QDK91116.1 | JS608_03384 | JTE87_00899 | JS609_03025 |
| Alpha-galacturonidase | ASB68722.1 | None | None | JS609_00767 |
| Aryl-phospho-beta-D-glucosidase BglA | QDK90194.1 | JS608_02396 | JTE87_01892 | JS609_04055 |
| Aryl-phospho-beta-D-glucosidase BglC | ARV97270.1 | None | None | JS609_00386 |
| Aryl-phospho-beta-D-glucosidase BglH | QAS10023.1 | None | None | JS609_03976 |
| Beta-glucanase | AYL88759.1 | JS608_00217 | JTE87_00014 | JS609_03959 |
| Beta-glucanase | AYL88759.1 | JS608_00217 | JTE87_04069 | None |
| Beta-hexosaminidase | QDK88534.1 | JS608_00614 | JTE87_03671 | JS609_00211 |
| Beta-mannanase | | JS608_00188 | None | JS609_00618 |
| | | None | None | None |

TABLE 54-continued

Putative digestive enzymes identified in the genomes of *B. amyloliquefaciens* PTA-84 and PTA85, and *B. subtilis* PTA-85

| Gene Description | Accession Number | *B. amyloliquefaciens* PTA-84 | *B. amyloliquefaciens* PTA-85 | *B. subtilis* PTA-86 |
|---|---|---|---|---|
| Cephalosporin-C deacetylase | QDK88655.1 | JS608_00742 | JTE87_03542 | JS609_00359 |
| Cortical fragment-lytic enzyme | ATC51419.1 | JS608_00424 | JTE87_03863 | JS609_00022 |
| Demethyllactenocin mycarosyltransferase | QDK88875.1 | JS608_00988 | JTE87_03296 | JS609_00617 |
| Endo-1,4-beta-xylanase A | QDK91715.1 | JS608_04031 | JTE87_00249 | JS609_01995 |
| Endoglucanase | QDK90074.1 | JS608_02270 | None | JS609_01916 |
| Endoglucanase | CCF05300.1 | None | None | None |
| General stress protein A | QDK91887.1 | JS608_00162 | JTE87_00069 | JS609_03892 |
| GlcNAc-binding protein A | QEQ03549.1 | JS608_02218 | JTE87_02071 | None |
| Glycogen phosphorylase | AIX08721.1 | None | None | JS609_03089 |
| Glycogen synthase | QAW13524.1 | None | None | JS609_03090 |
| Intracellular maltogenic amylase | AMR45682.1 | None | None | JS609_03485 |
| L-Ala--D-Glu endopeptidase | QGT57119.1 | JS608_03605 | JTE87_00677 | JS609_03258 |
| Maltose-6'-phosphate glucosidase | QDK89133.1 | JS608_01270 | JTE87_03016 | JS609_00864 |
| Melibiose/raffinose/stachyose import permease protein MelC | QEK97784.1 | JS608_03383 | JTE87_00900 | JS609_03024 |
| Membrane-bound lytic murein transglycosylase F | QDK89432.1 | JS608_01601 | JTE87_02684 | JS609_01215 |
| Membrane-bound lytic murein transglycosylase F | QDK90428.1 | JS608_02724 | None | None |
| N-acetyl-alpha-D-glucosaminyl L-malate deacetylase 1 | QEQ03843.1 | JS608_03770 | JTE87_00512 | JS609_02193 |
| N-acetylglucosamine-6-phosphate deacetylase | ASB54801.1 | JS608_03873 | JTE87_01560 | JS609_03525 |
| N-acetylglucosamine-6-phosphate deacetylase | ASB54800.1 | None | None | None |
| N-acetylglucosaminyldiphosphoundecaprenol N-acetyl-beta-D-mannosaminyltransferase | QDK91629.1 | JS608_03942 | JTE87_00338 | JS609_03617 |
| Oleandomycin glycosyltransferase | QDK89494.1 | JS608_01668 | JTE87_01911 | JS609_01294 |
| Oleandomycin glycosyltransferase | QDK90176.1 | JS608_02376 | JTE87_02617 | JS609_02068 |
| Oligo-1,6-glucosidase | AKD24292.1 | JS608_03494 | JTE87_00789 | JS609_03151 |
| Oligo-1,6-glucosidase 1 | QAW18252.1 | None | None | JS609_03479 |
| 3-phytase | | JS608_02425 | JTE87_01863 | JS609_02112 |
| Pectate lyase | QDK89071.1 | JS608_01201 | JTE87_03083 | JS609_00804 |
| Pectate lyase C | AIC99792.1 | None | None | JS609_03519 |
| Pectin lyase | QDK91950.1 | JS608_00231 | JTE87_04055 | JS609_01975 |
| Penicillin-binding protein 1A/1B | QDK90466.1 | JS608_02709 | None | JS609_02178 |
| Penicillin-binding protein 1A/1B | QDK90466.1 | JS608_02709 | None | None |
| Penicillin-binding protein 1F | QDK89310.1 | JS608_01475 | JTE87_02812 | JS609_01067 |
| Penicillin-binding protein 2D | QDK91796.1 | JS608_00067 | JTE87_00164 | JS609_03799 |
| Penicillin-binding protein 4 | QDK91217.1 | JS608_03518 | None | JS609_03174 |
| Peptidoglycan-N-acetylglucosamine deacetylase | QDK89265.1 | JS608_01429 | JTE87_01216 | JS609_01025 |
| Peptidoglycan-N-acetylglucosamine deacetylase | QDK90813.1 | JS608_03066 | JTE87_02858 | None |
| Peptidoglycan-N-acetylmuramic acid deacetylase PdaA | QEQ05952.1 | JS608_01255 | JTE87_03031 | JS609_00844 |
| Peptidoglycan-N-acetylmuramic acid deacetylase PdaC | AIX06967.1 | None | None | JS609_01282 |
| Processive diacylglycerol beta-glucosyltransferase | QAV83859.1 | None | None | JS609_01417 |
| Processive diacylglycerol beta-glucosyltransferase | QDK90264.1 | JS608_02475 | JTE87_01812 | JS609_02138 |
| Pullulanase | AYA43052.1 | None | | JS609_02990 |
| putative 6-phospho-beta-glucosidase | QDK91899.1 | JS608_00173 | JTE87_00058 | JS609_03909 |
| putative esterase YxiM | AOY05484.1 | None | None | JS609_03964 |
| putative oligo-1,6-glucosidase 2 | AHC40869.1 | None | None | JS609_00325 |
| putative protein YqbO | QDK89544.1 | None | None | JS609_01344 |
| putative rhamnogalacturonan acetylesterase YesY | ASZ60459.1 | None | None | JS609_00761 |
| Putative sporulation-specific glycosylase YdhD | CAB12390.2 | None | None | JS609_00616 |
| Putative sporulation-specific glycosylase YdhD | QDK89600.1 | JS608_01783 | JTE87_02504 | JS609_03425 |
| Rhamnogalacturonan acetylesterase RhgT | QFY87628.1 | None | None | JS609_00756 |
| Rhamnogalacturonan endolyase YesW | QAT44941.1 | None | None | JS609_00759 |
| Rhamnogalacturonan exolyase YesX | AIX06475.1 | None | None | JS609_00760 |
| Trehalose-6-phosphate hydrolase | AVX18210.1 | JS608_01233 | JTE87_03053 | JS609_00827 |
| UDP-N-acetylglucosamine--N-acetylmuramyl-(pentapeptide)pyrophosphoryl-undecaprenol N-acetylglucosamine transferase | QDK89788.1 | JS608_00110, JS608_01977 | JTE87_00121, JTE87_02314 | JS609_01610, JS609_03834 |

Genes of Safety Concern

To search for genes encoding known virulence factors, toxins, and antimicrobial resistance (AMR), we applied a screening approach using cutoff values according to an EFSA guideline (61), sequence identity and coverage values higher than 80 and 70%, respectively. According to the analysis, genes for known virulence factors or toxins were not identified in the genomes of three *Bacillus* strains, Ba PTA84, Ba PTA85, and Bs PTA86.

TABLE 55 presents genes for putative genes encoding for antimicrobial resistance (AMR). Ba PTA84 and 85 had a similar set of putative AMR genes identified, namely putative genes encoding methyl transferase (cfr/cfr-like,clbA) (24), tetracyclin efflux protein (tet(L)) (25), Streptothricin-N-acetyltransferase (satA), and rifamycin-inactivating phosphotransferase (rphC) (27, 28). Bs PTA86 genome carried putative genes that encoded macrolide 2'phosphotransferase (mphK), ABC-F type ribosomal protection protein (vmlR), Streptothricin-N-acetyltransferase (satA), tetracyclin efflux protein (tet(L)), aminoglycoside 6-adenylyltransferase (aadK) (29), and rifamycin-inactivating phosphotransferase (rphC). The aadK gene from *B. subtilis* was originally found in susceptible derivatives of Marburg 168 strains. Heterologous expression of the gene in a plasmid in *E. coli* resulted in resistance phenotype toward rifamycin suggesting the need for high gene copies to confer resistance (30).

TABLE 55

Putative antimicrobial resistance genes identified through genome analysis

| *Bacillus* strain | Gene product | Gene id | % Coverage | % Identity | Accession number | Antibiotic Resistance |
|---|---|---|---|---|---|---|
| *B. amyloliquefaciens* PTA-84 | 23S rRNA (adenine(2503)-C(8))-methyltransferase ClbA | clbA | 100 | 96.86 | NG_062350.1 | Lincosamide; Macrolide; Streptogramin |
| | tetracycline efflux MFS transporter Tet(L) | tet(L) | 100 | 86.64 | NG_048204.1 | Tetracycline |
| | streptothricin N-acetyltransferase SatA | satA_Bs | 100 | 85.63 | NG_064662.1 | Streptothricin |
| | rifamycin-inactivating phosphotransferase RphC | rphC | 99.31 | 80.41 | NG_063825.1 | Rifamycin |
| | cfr(B) | cfr(B)_3 | 98.67 | 87.74 | KR610408 | Chloramphenicol; Florfenicol; Clindamycin; Lincomycin; Linezolid; Dalfopristin; Pristinamycin_Iia; Virginiamycin_M; Tiamulin |
| *B. amyloliquefaciens* PTA-85 | streptothricin N-acetyltransferase SatA | satA_Bs | 100 | 85.63 | NG_064662.1 | Streptothricin |
| | tetracycline efflux MFS transporter Tet(L) | tet(L) | 100 | 86.64 | NG_048204.1 | Tetracycline |
| | 23S rRNA (adenine(2503)-C(8))-methyltransferase ClbA | clbA | 100 | 96.86 | NG_062350.1 | Lincosamide; Macrolide; Streptogramin |
| | rifamycin-inactivating phosphotransferase RphC | rphC | 99.31 | 80.41 | NG_063825.1 | Rifamycin |
| | cfr(B) | cfr(B)_3 | 98.67 | 87.74 | KR610408 | Chloramphenicol; Florfenicol; Clindamycin; Lincomycin; Linezolid; Dalfopristin; Pristinamycin_Iia; Virginiamycin_M; Tiamulin |
| *B. subtilis* PTA-86 | macrolide 2'-phosphotransferase MphK | mphK | 100 | 97.72 | NG_065846.1 | Macrolide |
| | ABC-F type ribosomal protection protein VmlR | vmlR | 100 | 98.66 | NG_063831.1 | Lincosamide; Streptogramin; Tiamulin |
| | streptothricin N-acetyltransferase SatA | satA_Bs | 100 | 95.78 | NG_064662.1 | Streptothricin |
| | tetracycline efflux MFS transporter Tet(L) | tet(L) | 100 | 100 | NG_048204.1 | Tetracycline |
| | aminoglycoside 6-adenylyltransferase AadK | aadK | 99.77 | 98.12 | NG_047379.1 | Streptomycin |
| | rifamycin-inactivating phosphotransferase RphC | rphC | 99.39 | 82.18 | NG_063825.1 | Rifamycin |

Antioxidants, Adhesion, and Folate Biosynthesis

Genes encoding primary redox enzymes such as superoxide dismutase and catalase that scavenge reactive oxygen species were found in the three *Bacillus* genomes, TABLE 56. A thioredoxin system and genes for bacillithiol biosynthesis were also identified. All three genomes encoded for a thioredoxin reductase (locus tag for Ba PTA84, Ba PTA85, and Bs PTA86: JS608_03853, JTE87_00428, and JS609_03503 (BSUB105_03585), respectively) and two cognate thioredoxins for Ba PTA84 and Ba PTA85 (locus tags, JS608_02520 and JTE87_01059; JS609_02844 (BSUB105_02910) and JS608_03225) and a Trx for Bs PTA86 (locus tag, JTE87_01767). Thioredoxin systems maintain cellular redox homeostasis (62). Interestingly, despite lacking glutathione-glutaredoxin system, several genes for glutathione transport were found suggesting the potential transport of redox proteins, possibly bacillithiol, to the extracellular environment maintaining redox potential of the surroundings. Two genes for bacillithiol biosynthesis (63), bshA and B, were identified in genomes of Ba PTA84 and PTA85, and Bs PTA86, TABLE 56.

TABLE 56

Putative genes encoding antioxidant in the genomes of three *Bacillus* strains

| Description | Gene id | *B. amyloliquefaciens* PTA-84 | *B. amyloliquefaciens* PTA-85 | *B. subtilis* PTA-86 |
|---|---|---|---|---|
| Superoxide dismutase [Mn] | sodA | JS608_02998 | JTE87_01284 | JS609_02456 |
| Superoxide dismutase-like protein | yojM | JS608_02374 | JTE87_01913 | JS609_02066 |
| Thiol peroxidase | tpx | JS608_03312 | JTE87_00971 | JS609_02946 |
| Thiol-disulfide oxidoreductase | resA_1 | JS608_02246 | JTE87_01493 | JS609_01902 |
| | | JS608_02790 | JTE87_02043 | JS609_02262 |
| Thiol-disulfide oxidoreductase YkuV | ykuV | JS608_01870 | JTE87_02417 | JS609_01508 |
| Thioredoxin | trxA_1 | JS608_02520 | JTE87_01059 | JS609_02844 |
| | trxA_2 | JS608_03225 | JTE87_01767 | NA |
| Thioredoxin reductase | trxB | JS608_03853 | JTE87_00428 | JS609_03503 |
| Thioredoxin-like protein YdbP | ydbP | JS608_00883 | JTE87_03401 | JS609_00507 |
| Thioredoxin-like protein YtpP | ytpP | JS608_03357 | JTE87_00926 | JS609_02981 |
| Catalase | katA_1 | JS608_00191 | JTE87_00040 | JS609_03916 |
| Catalase HPII | katE | JS608_00215 | JTE87_00016 | JS609_03957 |
| | katE_2 | NA | JTE87_04071 | NA |
| Putative deferrochelatase/peroxidase EfeN | efeN | JS608_00150 | JTE87_00081 | JS609_03875 |
| Sporulation thiol-disulfide oxidoreductase A | stoA | JS608_01832 | JTE87_02455 | JS609_01470 |
| | ggt | NA | NA | NA |
| Glutathione hydrolase proenzyme | ggt_2 | JS608_02314 | NA | JS609_01947 |
| Glutathione hydrolase-like YwrD proenzyme | ywrD | JS608_03981 | JTE87_00299 | JS609_03652 |
| Glutathione transport system permease protein GsiC | gsiC | NA | NA | JS609_01195 |
| Glutathione transport system permease protein GsiD | gsiD | JS608_01344 | JTE87_02945 | NA |
| Glutathione-independent formaldehyde dehydrogenase | fdhA | JS608_00753 | JTE87_03531 | JS609_04068 |
| Glutathione-regulated potassium-efflux system protein KefB | kefB | JS608_01608 | JTE87_02677 | JS609_01222 |
| Putative peroxiredoxin bcp | bcp | JS608_01314 | JTE87_02974 | JS609_00912 |
| Bacillithiol biosynthesis gene | BshA | JS608_02670 | JTE87_01529 | JS609_02141 |
| | BshB | JS608_02671 | JTE87_01528 | JS609_02142 |
| | | JS608_02672 | JTE87_00504 | JS609_02023 |
| Free methionine-R-sulfoxide reductase | msrC | JS608_03327 | JTE87_00956 | JS609_02961 |
| Peptide methionine sulfoxide reductase MsrA | msrA | JS608_02454 | JTE87_01833 | JS609_02115 |
| Peptide methionine sulfoxide reductase MsrB | msrB | JS608_02453 | JTE87_01834 | JS609_02114 |

One of the key desirable traits in a probiotic candidate is the ability to adhere to epithelial cells. The two genes identified in all three strains putatively encode proteins involved in adhesion to mucus, epithelial cells and are known to be involved in host immunomodulation and unwanted microorganism aggregation, providing stability to the strains and the ability to compete with other undesirable resident gut bacteria, thereby enabling effective colonization of the gut and exclusion of pathogens (64, 65). Two genes each encoding for elongation factor Tu and 60 kDa chaperonin involved in adhesion of *Bacillus* species to intestinal epithelium were identified in all three genomes.

Probiotic bacteria confer several health benefits to the host, including vitamin production. We searched for key components of folate production pathways in *Bacillus* strains using the Enzyme Commission (EC) numbers associated with folate biosynthetic pathway. The analysis of genome sequences of *Bacillus* strains identified genes involved para-aminobenzoic acid (PABA) synthesis in all three strains (TABLE 57). However, strain Ba PTA84 has a frameshift mutation in pabB gene. The enzymes necessary for chorismate conversion into PABA are present in all three *Bacillus* probiotic strains. *Bacillus* probiotic strains also contain the genes of D-PPP de novo biosynthetic pathway. Previous studies have shown that *B. subtilis* genome harbor all the pathways components and have been engineered for folate production (66-68).

TABLE 57

Genes Involved in Folate Biosynthetic Pathway in Probiotic *Bacillus* spp.

| Annotation | Gene | EC Number | PTA-84 | PTA-85 | PTA-86 |
|---|---|---|---|---|---|
| Protein AroA(G) | aroA | 5.4.99.5 | JS608_03349 | JTE87_00934 | JS609_02973 |
| 3-phosphoshikimate 1-carboxyvinyltransferase 1 | aroA1 | 2.5.1.19 | JS608_02738 | JTE87_01546 | JS609_02206 |
| 3-dehydroquinate synthase | aroB | 4.2.3.4 | JS608_02748 | JTE87_01536 | JS609_02216 |
| Chorismate synthase | aroC | 4.2.3.5 | JS608_02749 | JTE87_01535 | JS609_02217 |
| 3-dehydroquinate dehydratase | aroD | 4.2.1.10 | JS608_01242 | JTE87_03044 | JS609_02255 |
| Shikimate dehydrogenase (NADP(+)) | aroE | 1.1.1.25 | — | — | JS609_02520 |
| Shikimate dehydrogenase (NADP(+)) | aroE_1 | 1.1.1.25 | JS608_01241 | JTE87_01221 | — |
| Shikimate dehydrogenase (NADP(+)) | aroE_2 | 1.1.1.25 | JS608_03061 | JTE87_03045 | — |
| Chorismate mutase AroH | aroH | 5.4.99.5 | JS608_02747 | JTE87_01537 | JS609_02215 |
| Shikimate kinase | aroK | 2.7.1.71 | JS608_00741 | JTE87_03543 | JS609_00356 |
| Aromatic amino acid transport protein AroP | aroP | — | — | — | JS609_00352 |
| Dihydroneopterin aldolase | folB | 4.1.2.25 | JS608_00496 | JTE87_03790 | JS609_00092 |
| Bifunctional protein FolD protein | folD | 1.5.1.5 | JS608_02930 | JTE87_01353 | JS609_02382 |
| GTP cyclohydrolase 1 | folE | 3.5.4.16 | JS608_02756 | JTE87_01528 | JS609_02224 |
| GTP cyclohydrolase FolE2 | folE2 | 3.5.4.16 | — | — | JS609_00375 |
| 2-amino-4-hydroxy-6-hydroxymethyldihydropterid ine pyrophosphokinase | folK | 2.7.6.3 | JS608_00497 | JTE87_03789 | JS609_00093 |
| Dihydropteroate synthase | folP | 2.5.1.15 | JS608_00495 | JTE87_03792 | JS609_00091 |
| Dihydropteroate synthase | folP1 | 2.5.1.15 | — | JTE87_03791 | — |
| Aminodeoxychorismate/anthranilate synthase component 2 | pabA | 2.6.1.85 | JS608_00493 | JTE87_03794 | JS609_00089 |
| Aminodeoxychorismate synthase component 1 | pabB | 2.6.1.85 | JS608_00492* | JTE87_03795 | JS609_00088 |
| Alkaline phosphatase D | phoD | 3.1.3.1 | JS608_00693 | JTE87_03591 | JS609_00303 |
| Alkaline phosphatase 3 | phoB | 3.1.3.2 | — | — | JS609_00619 |
| Alkaline phosphatase 4 | phoA | 3.1.3.3 | JS608_01407 | JTE87_02880 | JS609_01001 |
| Dihydrofolate reductase type 3 | dhfrIII | 1.5.1.3 | JS608_02513 | JTE87_01774 | — |

Screening for Prophages, Insertion Sequences and Transposases

All three strains were scanned for presence of mobile genetic elements such as prophages, insertion sequences (IS) and transposases. Ba PTA84 and Ba PTA85 have 3 transposases while BsPTA86 has 4 transposases. Ba PTA84, Ba PTA85 and Bs PTA86 share 2 copies of IS21 insertion sequence.

Effects of in-Feed Administration of Ba PTA84 on Growth Performance of Broiler Chickens As a proof of principle, Ba PTA84 was selected in an in-vivo pilot study as a direct fed microbial to evaluate its probiotic efficacy in supporting improved broiler growth performance. To accomplish this, 2,500 one-day old broiler chickens (Cobb 500) were randomly assigned to 50 pens of 50 birds each and split between two treatment groups; an untreated Control group and a group receiving 1.5×105 CFU of Ba PTA84 per gram of feed for the full 42-day production period. Despite similar feed intake, birds fed the DFM had 3.5% higher final body weight compared to the control (2.16 vs. 2.23 kg for Control and DFM, respectively; p=0.0018). This translated to a 3.3% improvement in feed conversion ratio (FCR) for the DFM-fed group compared to Control (1.50 vs. 1.45 for Control and DFM, respectively; p=0.011) and a 6.2% increase in the European Broiler Index (EBI), a metric of overall production efficiency (337 vs. 358 for Control and DFM, respectively; p<0.0001), FIG. 44. These results indicated that use of Ba PTA84 as a DFM can significantly improve weight gain and feed efficiency in broiler chickens.

Cecal Microbiome Structure Analysis from Chicken with and without in-Feed Administration of Ba PTA84

To gather insights into the in-vivo effects of in-feed administration of *B. amyloliquefaciens* on broiler chickens, we analyzed the cecal microbiomes of 20 animals in the control and treatment groups of our clinical study. Samples from 42-day old animals were used to build 16S rRNA amplicon libraries for sequencing. The median coverage was ~36,000 read pairs per sample, and 1,945 amplicon sequence variants (ASVs) were identified across samples.

Samples in the control and treatment groups showed similar values for ASV richness and diversity (FIGS. 45A and 45B, p-values=0.07, 0.44-0.36, respectively). Additionally, ANOSIM and PERMANOVA analyses based on the Bray-Curtis dissimilarity between samples did not support significant differences in community structures between treatment groups (ANOSIM p-value=0.66. PERMANOVA p-value=0.44). These results, which are evident by the lack of clustering of samples by treatment following principal components analysis (FIG. 45C), indicate that supplementation of Ba PTA84 at a dose sufficient to induce a positive effect on performance (FIG. 45) had minor effects on the diversity and structure of the cecal microbiome.

Discussion

A clear understanding of the physiology and safety of probiotic strains as well as their interactions with target host, and hosts' gut microbiota are essential to rationally develop the next generation of probiotics with improved safety and efficacy, and increased reproducibility. Here, we employed comprehensive multi-omics, biochemical, and microbiological approaches for the selection and characterization of *Bacillus* spp. strains to improve growth performance in poultry. Our data showed that the selected strain Ba PTA84 significantly improved growth performance indicating that the screening workflow helped to rationally design promising DFM candidates. Moreover, we generated information we expect will guide future efforts to decipher the gene clusters, metabolites, phenotypic traits, and microbiome impact of spore-formers as important characteristics of probiotic strains.

*Bacillus* spp. isolates were screened for their activities to inhibit poultry pathogens and ability to secrete digestive enzymes in-vitro. The best candidates were further selected based on their safety profiles (i.e. antimicrobial resistance profile and cytotoxicity level). Genomic and metabolomic analyses were performed on the select isolates to further investigate potential host-benefit properties and possible health/safety concerns. The top candidate was then tested for its effects on growth promotion in-vivo. This bottom-up approach ensures selection of the best candidates at each screening step. Strains that did not meet safety criteria were not selected. Only the best candidates that met phenotypic selection criteria moved forward to the next screening step. Genomic analysis of the top three *Bacillus* strains helped to create a link between phenotypic observations with genomic traits. Furthermore, genomic and metabolomic analyses of three candidate strains pointed to potential outcome differences when combining these three candidate strains in a consortium. Details from our findings are described below.

Host-adapted *Bacillus* strains. We expected that host-adapted *Bacillus* strains to exert better probiotic effects in the host environment than those isolated from other sources, thus, we targeted our isolation to those *Bacillus* spp. from animal GIT content or fecal samples of healthy animals (8). A higher diversity of isolates was obtained from the ethanol-treated samples compared to heat-treated samples, as reported previously (8, 22). Despite the general heat resistance feature of *Bacillus* spores, spore core, cortex, coat, and membrane composition determines the degree of the spores' heat resistance (10, 69, 70) resulting in different responses of spores toward heat stresses.

Desirable probiotic properties. With the continuing reduction in use of antibiotics in poultry farms, as driven by regulations, and some customer preferences, the development of microbial feed additives that support maintenance of poultry health in the face of undesirable organisms would be beneficial. Our screening results showed that *Bacillus* spp. controlled the growth of undesirable *E. coli* O2, O18, and O78, *C. perfringens*- and *Salmonella Typhimurium*. APEC strains cause colibacillosis, which is a major problem in commercial production (74, 75). Colibacillosis occurs when APEC originating from fecal materials translocate into the lung epithelium during fecal aerosolization. Thus, reducing the APEC load in feces as a potential effect of *Bacillus* spp. in the feed could help reduce the incidence of colibacillosis (76, 77). *C. perfringens* is a pathogen that causes necrotic enteritis in poultry (78) by the production of alpha oxin and NetB (79, 80). Necrotic enteritis is a multi-factorial disease that cost poultry farmers 6 billion dollar annually (81). *Salmonella Typhimurium*, a poultry gut commensal, is the major cause of *salmonellosis* in humans. This infection is facilitated by the consumption of *Salmonella*-containing poultry products (82, 83). The ability of *Bacillus* spp to suppress growth of these undesirable organisms might be due to the production of AMPs (bacteriocins). Genome analysis of Ba PTA84, BaPTA85, and BsPTA86 suggested that the genomes encoded distinct AMPs (TABLE 53).

*Bacillus* species are known to secrete host beneficial enzymes such cellulase, xylanase, amylase, protease, β-mannanase, phytase (23, 51, 84). These enzymes, when fed to animals, improve digestion of low-calorie diets or reduce intestinal inflammation by breaking down non-starch polysaccharides (NSPs). Some NSPs are anti-nutritional factors, and increase the gut content viscosity, slow down feed retention time in the gut, and thus reduce nutrient absorption (85). An accumulation of undigested NSPs can lead to the growth of pathogens that cause subclinical infection challenges (86, 87). Production of pro-inflammatory cytokines as a response to NSPs demands a significant amount of energy, which otherwise could be preserved for growth, lowering food efficiency and growth performance (reviewed in (88)). Ba and Bs showed comparable protease, amylase, and β-mannanase activities. These activities were supported by our genomic analysis showing that Ba and Bs possess genes encoding for amylase, protease, β-mannanase, and phytase. Bs PTA86 genome contained more genes for enzymes compared to those of Ba PTA84 and PTA 85.

It is noteworthy that genome analyses revealed other potential benefits the three *Bacillus* candidates for animals. Genes encoding a wide array of antioxidant proteins were identified, superoxide dismutase, catalase, thioredoxin, and methionine sulfoxide, and bacillithiol. These proteins when expressed and secreted in the GIT could provide protection toward oxidative stress (89-91). Oxidative stress occurs in the GIT when the level of free radicals generated by reactive oxygen/nitrogen species (RO/NS) is much higher than the level of antioxidant proteins for neutralization of these toxic compounds (57). This event is triggered by various factors including nutritional or environmental heat stress, or pathological factors which ultimately decrease growth performance and quality of meat and eggs (57).

Among proposed functions of probiotic bacteria are the reduction of potential pathogenic bacteria, immune modulation, removal of harmful metabolites in the intestine and/or providing bioactive or otherwise regulatory metabolites. Folate-producing probiotic bacteria enable better nutrient digestion and energy recovery. Folate-producing probiotic strains could potentially confer protection against cancer, inflammation, stress, and digestive disturbances (66, 92-95). Several studies exploring the commercial utility of probiotic strains for folate production have been reported (92, 96, 97). Genes encoding essential enzymes in the biosynthetic pathways of folate were also found in the genome of three *Bacillus* strains. The products of these pathways supply important cofactors which once secreted would be absorbed by the host improving health status ((92, 96, 97).

Safety profiles. In addition, *Bacillus* DFM candidates must have acceptable safety profiles as expected by regulatory authorities. Some *Bacillus* spp. are known to produce AMPs and enterotoxins that might exert deleterious effects on the host cells (25). Lack of detailed characterizations of probiotic strains resulted in the use of *B. cereus* (Bactisubtil, Biosubtyl, and Subtyl) probiotic strains harboring structural genes of known enterotoxins (99). Cytotoxicity assessment of our *Bacillus* spp. strains suggested that *Bacillus* spp. did not cause cytotoxicity of Vero cells. Moreover, genome analysis of Ba PTA84, Ba PTA85, and Bs PTA 86 suggested that enterotoxins and other known virulence factors were absent in the subject *Bacillus* spp. Another important safety criterion is that *Bacillus* DFM genomes must be devoid of transferable antimicrobial resistance genotypes (100). The data suggested that almost all of the tested *Bacillus* isolates were sensitive to the antimicrobials tested and the apparent MIC values were below the recommended cut-off values. Genomic analysis of three *Bacillus* spp. identified putative genes for antimicrobial resistance to tetracycline, lincosamide, and strepthrothricine. In the genome of Bs PTA86, putative genes conferring resistance to rifampicin and macrolides were found. However, these genes have been reported present in Ba and Bs isolates from the environment (101, 102), suggesting these genes may be intrinsic properties of Ba and Bs strains. Furthermore, transferable mobile genetic elements such as transposons, insertion sequences were absent in the proximity of these genes indicating the very low risk of these genes being horizontally transferred to other gut microbes pose little to no risk to public health safety.

Metabolomic analysis. Probiotic strains are also known to secrete beneficial metabolites as microbial fermentation by-products such as short chain fatty acids (SCFAs) that help with mucus secretion, mucosal epithelial integrity, immune cell regulation, and serve as energy sources for colonocytes (103, 104). To investigate the potential host beneficial metabolites secreted by the three *Bacillus* strains, we performed global untargeted metabolomic analyses of Ba PTA84 and PTA85, and Bs PTA86. A metabolite of particular interest was 1-kestose that was identified in the culture supernatants of all strains. 1-Kestose, the smallest fructooligosaccharide (FOS), is a trisaccharide molecule composed of a glucose and two fructose residues linked by glycosidic bonds. Kestose is a prebiotic that, when consumed, enriches the growth of gut commensals such as Bifidobacteria, *Lactobacillus*, and *Faecalibacterium prausnitzii* promoting gut health (105). Of the three strains, Ba PTA84 produced the highest amount of 1-kestose. Thioproline, an antioxidant molecule, was identified in the culture supernatant of Ba PTA84 and Bs PTA86. Thioproline was reported to inhibit carcinogenesis in humans, and is expected to act as a nitrite scavenger (106). Pantothenate (Vitamin B5) and pyridoxine (Vitamin B6) were found in the culture supernatants of Ba PTA85 and Bs PTA86, respectively. Betaine and choline were possibly secreted by Bs PTA86. These molecules are methyl donors required for the biosynthesis of acetylcholine and phosphatidylcholine, for neural transmission and cell membrane integrity, respectively (107). Betaine, when supplemented in feed, has shown improved growth performance of birds during heat stresses (108, 109). Inclusion of choline has been associated with reduced FCR in broiler chickens (110).

Genomic analysis of Ba PTA84, PTA85, and Bs PTA86 suggested that these three strains harbor genes with complimentary activities (i.e., AMPs and enzymes). Thus, we hypothesize that inclusion of these three strains in a consortium would exert a greater benefit to the animal than that of any single strain. It is noteworthy that the subject *Bacillus* spp. generated more unique metabolites when grown in consortia of two or three *Bacillus* strains, suggesting that a combination of strains would generate distinct outcomes compared to that of single isolate. Indoleacetate was detected only in the culture supernatant of consortia of Ba PTA84-Ba PTA85, and Ba PTA84-Ba PTA85-Bs PTA86, but not in the individual strains. Indoleacetate is an intermediate of microbial tryptophan biosynthesis that serves as a ligand for aryl hydrocarbon receptors (AhRs) enhances intestinal integrity and modulates host immune systems by exerting anti-inflammatory activities (32, 33). A higher abundance of tryptophan metabolites was also observed in animals treated with sub-therapeutic level of antibiotic Bacitracin Methylene Disalicylate (BMD) (34).

Feed inclusion of Ba PTA84 supported improved poultry growth performance. An in-vivo efficacy study employing daily feed inclusion of Ba PTA84 resulted in significantly improved overall growth performance of broiler chickens as shown by a significant increase of average daily gain, production efficiency, and a reduction in feed conversion ratio. To better understand the mechanism of action underlying the effect of Ba PTA84 supplementation on animal health, we investigated the effects of supplementation of Ba PTA84 on the modulation of intestinal microbiota. The chicken gut microbiota plays prominent roles in bioavailability of nutrients, immune system development, intestinal integrity, and exclusion of unwanted microorganisms (111). Growth promotion effects of probiotics have been linked to changes in cecal microbiome structure and function (18), (112). Interestingly, microbiome taxonomic profiling analyses of cecal contents from a control group and that with dietary supplement of Ba PTA84 suggested no significant differences between the cecal microbiome structures of the two groups according to both alpha and β-diversity parameters. Thus, it is likely that Ba PTA84 supports growth performance without altering the normal cecum microbiome. It is still possible that microbial communities in other organs are affected by supplementation of this strain. It is noteworthy that metabolomic analysis of culture supernatant of Ba PTA84 showed that it had a potential to produce 1-kestose, a microbiome modulator (105). In the future, it would be interesting to test whether 1-kestose is indeed produced in vivo.

With the advances of sequencing technologies allowing analysis of large number of samples at relatively low cost, it is possible to use genomic analysis as an initial high-throughput screening step to eliminate candidate strains harboring genes that might have negative impacts to the animal or to public health, and investigate the impact of individual genes and molecules on the observed clinical outcomes.

REFERENCES

1. FAO-UN (2018) The future of food and agriculture, Alternative pathways to 2050. in Supplementar Material (Food and Agriculture Organization of the United Nations).
2. US-FDA (2013) New animal drugs and new animal drug combination products administered in or on medicated feed or drinking water of food-producing animals: recommendations for drug sponsors for voluntarily aligning product use conditions with GFI #209. (Department of Health and Human Services).
3. EFSA Panel on Biological Hazards (BIOHAZ) et al. (2020) Update of the list of QPS-recommended biological agents intentionally added to food or feed as notified to EFSA 13: suitability of taxonomic units notified to EFSA until September 2020.
4. P. R. Moore, Evenson, A., Luckey, T. D., McCoy, E., Elvehjem, C. A. Hart, E. B., Use of sulfasuxidine, streptothricin, and streptomycin in nutritional studies with the chick. Journal of Biological Chemistry 2, 437-441 (1946).
5. C. Hill et al., The International Scientific Association for Probiotics and Prebiotics consensus statement on the scope and appropriate use of the term probiotic. Nature Reviews Gastroenterology & Hepatology 11, 506-514 (2014).
6. R. Jha, R. Das, S. Oak, P. Mishra, Probiotics (Direct-Fed Microbials) in Poultry Nutrition and Their Effects on Nutrient Utilization, Growth and Laying Performance, and Gut Health: A Systematic Review. Animals (Basel) 10 (2020).
7. A. Grant, C. G. Gay, H. S. Lillehoj, *Bacillus* spp. as direct-fed microbial antibiotic alternatives to enhance growth, immunity, and gut health in poultry. Avian Pathol 47, 339-351 (2018).
8. T. M. Barbosa, C. R. Serra, R. M. La Ragione, M. J. Woodward, A. Q. Henriques, Screening for *Bacillus* isolates in the broiler gastrointestinal tract. Appl Environ Microbiol 71, 968-978 (2005).
9. X. Guo, D. Li, W. Lu, X. Piao, X. Chen, Screening of *Bacillus* strains as potential probiotics and subsequent confirmation of the in vivo effectiveness of *Bacillus subtilis* MA139 in pigs. Antonie Van Leeuwenhoek 90, 139-146 (2006).
10. P. Setlow, Spores of *Bacillus subtilis*: their resistance to and killing by radiation, heat and chemicals. Journal of Applied Microbiology 101, 514-525 (2006).
11. S. Shivaramaiah et al., Evaluation of *Bacillus* species as potential candidates for direct-fed microbials in commercial poultry. Poult Sci 90, 1574-1580 (2011).
12. M. Bernardeau, M. J. Lehtinen, S. D. Forssten, P. Nurminen, Importance of the gastrointestinal life cycle of *Bacillus* for probiotic functionality. J Food Sci Technol 54, 2570-2584 (2017).
13. J. D. Latorre et al., Evaluation of germination, distribution, and persistence of *Bacillus subtilis* spores through the gastrointestinal tract of chickens. Poult Sci 93, 1793-1800 (2014).
14. T. T. IHoa et al., Fate and dissemination of *Bacillus subtilis* spores in a murine model. Applied and environmental microbiology 67, 3819-3823 (2001).
15. G. Casula, S. M. Cutting, *Bacillus* probiotics: spore germination in the gastrointestinal tract. Applied and environmental microbiology 68, 2344-2352 (2002).
16. S. Mingmongkolchai, W. Panbangred, *Bacillus* probiotics: an alternative to antibiotics for livestock production. J Appl Microbiol 124, 1334-1346 (2018). 17. A. Q. Grant, C. G. Gay, H. S. Lillehoj, *Bacillus* spp. as direct-fed microbial antibiotic alternatives to enhance growth, immunity, and gut health in poultry. Avian Pathology 47, 339-351 (2018).
18. Y. Ma et al., Supplemental *Bacillus subtilis* DSM 32315 manipulates intestinal structure and microbial composition in broiler chickens. Sci Rep 8, 15358 (2018).
19. J. S. Weese, H. Martin, Assessment of commercial probiotic bacterial contents and label accuracy. Can Vet J 52, 43-46 (2011).
20. J. S. Weese, Microbiologic evaluation of commercial probiotics. J Am Vet Med Assoc 220, 794-797 (2002).
21. D. H. Green et al., Characterization of two *Bacillus* probiotics. Appl Environ Microbiol 65, 4288-4291 (1999).
22. J. R. Koransky, S. D. Allen, V. R. Dowell, Use of ethanol for selective isolation of sporeforming microorganisms. Applied and Environmental Microbiology 35, 762-765 (1978).
23. J. D. Latorre et al., Evaluation and Selection of *Bacillus* Species Based on Enzyme Production, Antimicrobial Activity, and Biofilm Synthesis as Direct-Fed Microbial Candidates for Poultry. Front Vet Sci 3, 95 (2016).
24. B. V. McCleary, A simple assay procedure for β-d-mannanase. Carbohydrate Research 67, 213-221 (1978).
25. G. R. EFSA Panel on Additives and Products or Substances used in Animal Feed (FEEDAP), Gabriele Aquilina, Giovanna Azimonti, Vasileios Bampidis, Maria de Lourdes Bastos, Georges Bories, Andrew Chesson, Pier Sandro Cocconcelli, Gerhard Flachowsky, Jirgen Gropp, Boris Kolar, Maryline Kouba, Marta López-Alonso, Secundino López Puente, Alberto Mantovani, Baltasar Mayo, Fernando Ramos, Maria Saarela, Roberto Edoardo Villa, Robert John Wallace, Pieter Wester, Boet Glandorf, Lieve Herman, Sirpa Kurenlarnpi, Jaime Aguilera, Montserrat Anguita, Rosella Brozzi, Jaume Galobart (2018) Guidance on the characterisation of microorganisms used as feed additives or as production organisms. (EFSA (European Food Safety Authority)).
26. G. L. S. f. a. H. World (2021) Performance Standards for Antimicrobial Susceptibility Testing. (CLSI), p 352.
27. J. Rao et al., Tn2008-driven carbapenem resistance in *Acinetobacter baumannii* isolates from a period of increased incidence of infections in a Southwest Virginia hospital (USA). J Glob Antimicrob Resist 12, 79-87 (2018).
28. D. Hyatt et al., Prodigal: prokaryotic gene recognition and translation initiation site identification. BMC Bioinformatics 11, 119 (2010).
29. D. Laslett, B. Canback, ARAGORN, a program to detect tRNA genes and tmRNA genes in nucleotide sequences. Nucleic Acids Res 32, 11-16 (2004).
30. T. Seemann, Prokka: rapid prokaryotic genome annotation. Bioinformatics 30, 2068-2069 (2014).
31. B. E. Suzek, M. D. Ermolaeva, M. Schreiber, S. L. Salzberg, A probabilistic method for identifying start codons in bacterial genomes. Bioinformatics 17, 1123-1130 (2001).
32. C. L. Kingsford, K. Ayanbule, S. L. Salzberg, Rapid, accurate, computational discovery of Rho-independent transcription terminators illuminates their relationship to DNA uptake. Genome Biol 8, R22 (2007).
33. E. P. Nawrocki, D. L. Kolbe, S. R. Eddy, Infernal 1.0: inference of RNA alignments. Bioinformatics 25, 1335-1337 (2009).
34. B. Tjaden, A computational system for identifying operons based on RNA-seq data. Methods. 176, 62-70 (2020).
35. A. Bremges, A. Fritz, A. C. McHardy, CAMITAX: Taxon labels for microbial genomes. GigaScience 9 (2020).
36. D. M. Emms, S. Kelly, OrthoFinder: phylogenetic orthology inference for comparative genomics. Genone Biol 20, 238 (2019).
37. E. W. Sayers et al., Database resources of the National Center for Biotechnology Information. Nucleic Acids Res 49, D10-d17 (2021).
38. S. 1, Na et al., UBCG: Up-to-date bacterial core gene set and pipeline for phylogenomic tree reconstruction. J Microbiol 56, 280-285 (2018).
39. M. N. Price, P. S. Dehal, A. P. Arkin, FastTree 2—approximately maximum-likelihood trees for large alignments. PLoS One 5, e9490 (2010).
40. Z. Xie, H. Tang, ISEScan: automated identification of insertion sequence elements in prokaryotic genomes. Bioinformatics 33, 3340-3347 (2017).
41. S. Akhter, R. K. Aziz, R. A. Edwards, PhiSpy: a novel algorithm for finding prophages in bacterial genomes that combines similarity- and composition-based strategies. Nucleic Acids Res 40, e126 (2012).

42. W. N. P. Setlow, Molecular Biological Methods for *Bacillus*. C. H. S. Cutting, Ed. (John Wiley, New York, 1990).
43. M. Martin, Cutadapt removes adapter sequences from high-throughput sequencing reads. 2011 17, 3 (2011).
44, B. J. Callahan et al., DADA2: High-resolution sample inference from Illumina amplicon data. Nat Methods 13, 581-583 (2016).
45. P. Yilmaz et al., The SILVA and "All-species Living Tree Project (LTP)" taxonomic frameworks. Nucleic acids research 42, D643-D648 (2014).
46. E. H. Simpson, Measurement of Diversity. Nature 163, 688-688 (1949).
47. C. E. Shannon. The mathematical theory of communication. 1963. MD Comput 14, 306-317 (1997).
48. A. Chao, Nonparametric Estimation of the Number of Classes in a Population. Scandinavian Journal of Statistics 11, 265-270 (1984).
49. Anonymous (http://scikit-bio.orgl.
50. The Association of American Feed Control Officials, Inc., 2021 Official Publication (FASS Inc., Champaign, IL).
51. I. Danilova, M. Sharipova, The Practical Potential of Bacilli and Their Enzymes for Industrial Production. Frontiers in Microbiology 11 (2020).
52. F. J. Contesini, R. R. d. *Melo*, H. H. Sato, An overview of *Bacillus* proteases: from production to application. Critical Reviews in Biotechnology 38, 321-334 (2018).
53. A. Fagerlund, T. Lindbuck, A. K. Storset, P. E. Granum, S. P. Hardy, *Bacillus cereus* Nhe is a pore-forming toxin with structural and functional properties similar to the ClyA (HlyE, SheA) family of haemolysins, able to induce osmotic lysis in epithelia. Microbiology (Reading) 154, 693-704 (2008).
54. M. Saeed et al., The Role of 8-Mannanase (Hemnicell) in Improving Poultry Productivity, Health and Environment. Brazilian Journal of Poultry Science 21 (2019).
55. H. Fayek, M. Abou El-Ella, M. Attia, Y. Mady (1995) Evaluation of using some feed additives in layer diets. in Sci. Conf. Anim. Nutr, pp 313-321.
56. Y. Zhou, Z. Jiang, D. Lv, T. Wang, Improved energy-utilizing efficiency by enzyme preparation supplement in broiler diets with different metabolizable energy levels. Poult Sci 88, 316-322 (2009).
57. K. Sherif, Performance of broiler chicks fed plant protein diets supplemented with commercial enzymes. Journal of Animal and Poultry Production 34, 2819-2834 (2009).
58. K. Babasaki, T. Takao, Y. Shimonishi, K. Kurahashi, Subtilosin A, a new antibiotic peptide produced by *Bacillus subtilis* 168: isolation, structural analysis, and biogenesis. J Biochem 98, 585-603 (1985).
59. C. E. Shelburne et al., The spectrum of antimicrobial activity of the bacteriocin subtilosin A. Journal of Antimicrobial Chemotherapy 59, 297-300 (2007).
60. T. Stein, S. DUsterhus, A. Stroh, K. D. Entian, Subtilosin production by two *Bacillus subtilis* subspecies and variance of the sbo-alb cluster. Appl Environ Microbiol 70, 2349-2353 (2004).
61. E. F. S. A. (EFSA), EFSA statement on the requirements for whole genome sequence analysis of microorganisms intentionally used in the food chain. EFSA Journal, 1-15 (2021).
62. Y. Meyer, B. B. Buchanan, F. Vignols, J.-P. Reichheld, Thioredoxins and Glutaredoxins: Unifying Elements in Redox Biology. Annual Review of Genetics 43, 335-367 (2009).
63. A. Gaballa et al., Biosynthesis and functions of bacillithiol, a major low-molecular-weight thiol in Bacilli. Proc Natl Acad Sci USA 107, 6482-6486 (2010).
64. H. Antelmann, C. Scharf, M. Hecker, Phosphate starvation-inducible proteins of *Bacillus subtilis*: proteomics and transcriptional analysis. J Bacteriol 182, 4478-4490 (2000).
65. B. Sanchez, P. Bressollier, M. C. Urdaci, Exported proteins in probiotic bacteria: adhesion to intestinal surfaces, host immunomodulation and molecular cross-talking with the host. FEMS Immunology & Medical Microbiology 54, 1-17 (2008).
66. T. Zhu et al., Engineering of *Bacillus subtilis* for enhanced total synthesis of folic acid. Appl Environ Microbiol 71, 7122-7129 (2005).
67. V. de Crecy-Lagard, Variations in metabolic pathways create challenges for automated metabolic reconstructions: Examples from the tetrahydrofolate synthesis pathway. Comput Struct Biotechnol J 10, 41-50 (2014).
68. A. R. Salem, J. R. Pattison, M. A. Foster, Folic acid and the methylation of homocysteine by *Bacillus subtilis*. Biochem J 126, 993-1004 (1972).
69. S. Brul et al, Challenges and advances in systems biology analysis of *Bacillus* spore physiology; molecular differences between an extreme heat resistant spore forming *Bacillus subtilis* food isolate and a laboratory strain. Food Microbiology 28, 221-227 (2011).
70. E. M. Berendsen, M. H. Zwietering, 0. P. Kuipers, M. H. J. Wells-Bennik, Two distinct groups within the *Bacillus subtilis* group display significantly different spore heat resistance properties. Food Microbiology 45, 18-25 (2015).
71. F. Van Immerseel, J. L. Rood, R. J. Moore, R. W. Titball, Rethinking our understanding of the pathogenesis of necrotic enteritis in chickens. Trends Microbiol 17, 32-36 (2009).
72. K. Grave, M. C. Kaldhusdal, H. Kruse, L. M. Harr, K. Flatlandsmo, What has happened in norway after the ban of avoparcin?Consumption of antimicrobials by poultry. Prev Vet Med 62, 59-72 (2004).
73. L. Hughes, P. Hermans, K. Morgan, Risk factors for the use of prescription antibiotics on UK broiler farms. J Antimicrob Chemother 61, 947-952 (2008).
74. F. Dziva, M. P. Stevens, Colibacillosis in poultry: unravelling the molecular basis of virulence of avian pathogenic *Escherichia coli* in their natural hosts. Avian Pathol 37, 355-366 (2008).
75. M. Mellata, Human and avian extraintestinal pathogenic *Escherichia coli*: infections, zoonotic risks, and antibiotic resistance trends. Foodborne Pathog Dis 10, 916-932 (2013).
76. H. Duan et al., Transmission identification of *Escherichia coli* aerosol in chicken houses to their environments using ERIC-PCR. Sci China C Life Sci 51, 164-173 (2008).
77. Y. C. Chien, C. J. Chen, T. H. Lin, S. H. Chen, Y. C. Chien, Characteristics of microbial aerosols released from chicken and swine feces. J Air Waste Manag Assoc 61, 882-889 (2011).
78. K. K. Cooper, J. G. Songer, Necrotic enteritis in chickens: A paradigm of enteric infection by *Clostridium perfringens* type A. Anaerobe 15, 55-60 (2009).
79. A. L. Keyburn et al., NetB, a new toxin that is associated with avian necrotic enteritis caused by *Clostridium perfringens*. PLoS Pathog 4, e26 (2008).

80. A. L. Keyburn et al., Alpha-toxin of *Clostridium perfringens* is not an essential virulence factor in necrotic enteritis in chickens. Infect Immun 74, 6496-6500 (2006).
81. B. Wade, A. Keyburn, The true cost of necrotic enteritis. World Poult 31, 16-17 (2015).
82. M. B. Batz, S. Hoffnann, J. G. Morris, Jr., Ranking the disease burden of 14 pathogens in food sources in the United States using attribution data from outbreak investigations and expert elicitation. J Food Prot 75, 1278-1291 (2012).
83. S. L. Foley, A. M. Lynne, Food animal-associated *Salmonella* challenges: pathogenicity and antimicrobial resistance. J Anim Sci 86, E173-187 (2008).
84. S. Singh, B. K. Bajaj, Bioprocess optimization for production of thermoalkali-stable protease from *Bacillus subtilis* K-1 under solid-state fermentation. Preparative Biochemistry & Biotechnology 46, 717-724 (2016).
85. A. Raza, S. Bashir, R. Tabassum, An update on carbohydrases: growth performance and intestinal health of poultry. Heliyon 5, e01437-e01437 (2019).
86. M. Kaldhusdal, Necrotic enteritis as affected by dietary ingredients. World Poultry 16, 42-43 (2000).
87. F. Van Immerseel et al., *Clostridium perfringens* in poultry: an emerging threat for animal and public health. Avian Pathol 33, 537-549 (2004).
88. G. Cardoso Dal Pont, M. Famell, Y. Farnell, M.-I. Kogut, Dietary Factors as Triggers of Low-Grade Chronic Intestinal Inflammation in Poultry. Microorganisms 8, 139 (2020).
89. Y. Wang et al., *Bacillus amyloliquefaciens* SC06 alleviates the oxidative stress of IPEC-1 via modulating Nrf2/Keap1 signaling pathway and decreasing ROS production. Appl Microbiol Biotechnol 101, 3015-3026 (2017).
90. A. Abudabos, A. Alyemni, H. Zakaria, Effect of Two Strains of Probiotics on the Antioxidant Capacity, Oxidative Stress, and Immune Responses of *Salmonella*-Challenged Broilers. Brazilian Journal of Poultry Science 18, 175-180 (2016).
91. T. Inatomi, K. Otomaru, Effect of dietary probiotics on the semen traits and antioxidative activity of male broiler breeders. Scientific Reports 8, 5874 (2018).
92. M. Rossi, A. Amaretti, S, Raimondi, Folate production by probiotic bacteria. Nutrients 3, 118-134 (2011).
93. J. Zhang et al., Screening of folate-producing lactic acid bacteria and modulatory effects of folate-biofortified yogurt on gut dysbacteriosis of folate-deficient rats. Food Funct 11, 6308-6318 (2020).
94. C. S. Fuchs et al., The Influence of Folate and Multivitamin Use on the Familial Risk of Colon Cancer in Women. Cancer Epidemiology Biomarkers & Prevention 11, 227-234 (2002).
95. E. White, J. S. Shannon, R. E. Patterson, Relationship between vitamin and calcium supplement use and colon cancer. Cancer Epidemiol Biomarkers Prev 6, 769-774 (1997).
96. M. Schallmey, A. Singh, 0. P. Ward, Developments in the use of *Bacillus* species for industrial production. Can J Microbiol 50, 1-17 (2004).
97. U. Sauer, D. C. Cameron, J. E. Bailey, Metabolic capacity of *Bacillus subtilis* for the production of purine nucleosides, riboflavin, and folic acid. Biotechnology and Bioengineering 59, 227-238 (1998).
98. F. M. Asrar, D. L. O'Connor, Bacterially synthesized folate and supplemental folic acid are absorbed across the large intestine of piglets. J Nutr Biochem 16, 587-593 (2005).
99. L. H. Due, H. A. Hong, T. M. Barbosa, A. O. Henriques, S. M. Cutting, Characterization of *Bacillus* probiotics available for human use. Applied and environmental microbiology 70, 2161-2171 (2004).
100. V. Ciorba, A. Odone, L. Veronesi, C. Pasquarella, C. Signorelli, Antibiotic resistance as a major public health concern: epidemiology and economic impact. Ann Ig 27, 562-579 (2015).
101. D. B. Adirnpong et al., Antimicrobial susceptibility of *Bacillus* strains isolated from primary starters for African traditional bread production and characterization of the bacitracin operon and bacitracin biosynthesis. Appl Environ Microbiol 78, 7903-7914 (2012).
102. R. W. Phelan et al., Tetracycline resistance-encoding plasmid from *Bacillus* sp. strain #24, isolated from the marine sponge Haliclona *simulans*. Appl Environ Microbiol 77, 327-329 (2011).
103. L. R. Lopetuso, F. Scaldaferri, V. Petito, A. Gasbarrini, Commensal Clostridia: leading players in the maintenance of gut homeostasis. Gut pathogens 5, 1-8 (2013).
104. H. M. Hamer et al., Review article: the role of butyrate on colonic function. Aliment Pharmacol Ther 27, 104-119 (2008).
105. J. A. Patterson, J. . Orban, A. L. Sutton, G. N. Richards, Selective enrichment of Bifidobacteria in the intestinal tract of broilers by thermally produced kestoses and effect on broiler performance. Poult Sci 76, 497-500 (1997).
106. J. A. Patterson et al., Thioproline formation as a driver of formaldehyde toxicity in *Escherichia coli*. Biochem J 477, 1745-1757 (2020).
107. R. R. Zempleni J, McCormick D B, Suttie J W, Handbook of vitamins. (CRC Press, Boca Raton (FL), ed. 4th, 2007).
108. W. Liu et al., Effects of Dietary Betaine on Growth Performance, Digestive Function, Carcass Traits, and Meat Quality in Indigenous Yellow-Feathered Broilers under Long-Term Heat Stress. Animals (Basel) 9 (2019).
109. S. He, S. Zhao, S. Dai, D. Liu, S. G. Bokhari, Effects of dietary betaine on growth performance, fat deposition and serum lipids in broilers subjected to chronic heat stress. Anim Sci J 86, 897-903 (2015).
110. G. S. Santiago et al., Dietary choline affects field performance and broiler leg deviations. Livestock Science 240, 104127 (2020).
111. Y. Shang, S. Kumar, B. Oakley, W. K. Kim, Chicken Gut Microbiota: Importance and Detection Technology. Front Vet Sci 5, 254 (2018).
112. A.-R. Al-Fataftah, A. Abdelgader, Effects of dietary *Bacillus subtilis* on heat-stressed broilers performance, intestinal morphology and microflora composition. Animal Feed Science and Technology 198, 279-285 (2014).
113. J. D. Latorre et al., Evaluation and Selection of *Bacillus* Species Based on Enzyme Production, Antimicrobial Activity, and Biofilm Synthesis as Direct-Fed Microbial Candidates for Poultry. Front Vet Sci 3, 95 (2016).
114. B. V. McCleary, A simple assay procedure for β-d-mannanase. Carbohydrate Research 67, 213-221 (1978).
115. G. R. EFSA Panel on Additives and Products or Substances used in Animal Feed (FEEDAP), Gabriele Aquilina, Giovanna Azimonti, Vasileios Barnpidis, Maria de Lourdes Bastos, Georges Bories, Andrew Chesson, Pier Sandro Cocconcelli, Gerhard Flachowsky, Jirgen Gropp, Boris Kolar, Maryline Kouba, Marta Ldpez-Alonso, Secundino Ldpez Puente, Alberto Mantovani, Baltasar Mayo, Fernando Ramos, Maria Saarela, Roberto Edoardo Villa, Robert John Wallace, Pieter Wester, Boet Glandorf, Lieve Herman, Sirpa Karenlampi, Jaime Aguilera, Montserrat Anguita, Rosella Brozzi, Jaume Galobart (2018) Guidance on the characterisation of microorganisms used as feed additives or as production organisms. (EFSA (European Food Safety Authority)).

Example 19

*Bacillus* strains 06 (BAMY006), 71 (BAMY071) and 105 (BSUB105; PTA-126786 or PTA-86) were analysed and compared and classes of genes or secondary metabolite pathways unique to each strain identified. Some results are provided in the earlier examples and tables, such as bacteriocin predictions, secondary metabolites, carbohydrate metabolizing enzymes. Unique proteins (predicted proteins in one strain for which an equivalent or homologous protein encoding gene is not identified by identity searches in the other two strains) are provided: TABLE 58—selected gene and corresponding protein sequences unique for *Bacillus* strain 06 (BAMY006); TABLE 59—selected protein sequences unique for *Bacillus* strain 71 (BAMY071); TABLE 60—selected gene protein sequences for *Bacillus subtilis* 105 (BSUB105; PTA-126786 or PTA-86). Strain 105 includes 4 subtilosin genes, pullulanase (which helps break down branched chain carbohydrates to simple carbohydrates), cyclodextrin-binding protein, 9 sporulation related genes, beta-galactosidase YesZ and GanA genes, oxidoreductase YjmC.

TABLE 58

*Bacillus* strain 06 (BAMY006) protein sequences

| Gene | Annotation | Sequence |
|---|---|---|
| BAMY06_ 01888 | SPheta prophage-derived uncharacterized protein YopX | MNTAYRVWDGEQMHYWDDEGLSLTIKNNGDWTLKRLYTDVLVPVVDSTNRNAALMWGTGLKDKNEKMIY EKDVIKFKSVYCENKIIKAVVKFRDSLGSFVFNRGDDQDFWRMDVSLSEIEVIGDIYQNPELLEGAE (SEQ D NO: 263) |
| BAMY06_ 00183 | Transcription antiterminator LicT | MKIAKVNNNNVVSVLKEGNQELVIMGRGIAFQKKTGDPADEARIEKVLTLDNKDVSEVQNPFV (SEQ D NO: 264) |
| BAMY06_ 01794 | Uric acid permease PucK | MKNGYAKTLSLGIQHVLAMYAGAVVVPLIVGAALGLNAEQLTYLVSIDIFMCGAATLLQVWRNKCFGIG LPVVLGCTFTAVAPIISIGKEYGISAIYGSILASGLLVILLSFFFGKLVSFFPPVVTGSVVRIID (SEQ D NO: 265) |
| BAMY06_ 01845 | DNA-directed RNA polymerase YonO | MKRKKDGLSKQVHIYSVDTSAFYNDKENSLHNKILKSYRYRDYLKTLDNVNNKHKKYISQRITYLKECL YSAFEEHNDIRTLRTDSLRDNKVISLFDSVLTRTLGIKENTLSEEIMVVQTYHFEVLKDIIDQGFLHNN EKYVYFTSSAGQIRTKKSCFIKKSTYDKYQDALTCGLSIEKINSLGGSSINKWNSYMALSNSASSPWEI DIDKAIVVDDLETDVSSLVDYIDRDTYEITRKTMNIPIEHTDGCGMILPTLSSKSFMVRLPWVKGLLVP FDFRKFAEENKAFKVTDIYGKEWDVVKDDVQIIFTKSQFKMWKYYSSWEEYQGNYKKYGCLGAKLNEED PSVEGKLTYQMLQTLTDISGEELIQMSSKTVKEITTLGTDKETMLRVLGATEKKKHRTALQDALLLYPE LLNDDHTKEIIKNKKKSMIKDAKSGKLLVDGARYTYLCPDLYAFCEKLFLNIQNPKGLLSGNDVHCSLY DEGYIDILRSPHLFREHGVRWNKKDEKYEKWFITPGVYTSIHDPISKLLQFDNDGDKALIISDELIVNI AKRNMENIVPLYYEMSVAQKQKINSRNIYEALTLAYGINIGEYSNNITKIWNSDNINLDVIKWLCMENN FTIDFAKTLFMPTRPDHVDEKIKDYIKNKVPHFFINAKDKEEHSVELINESTVNKLDSIIPSDRINFAA VAGKFDYRFLLKNRDIKLDDAIIREYKRLDQNKKWLMNDEDIKPGQKLYVYKVIKDRLLKIYNDEQSVA DVLVKHLYKKKSKFKSTLWECFGDLILENMQNNLKRFKSCYSCGKMFKSISNKSKYCNKCALEIEKKNH RLRQKKYSKKKMTK (SEQ D NO: 266) |
| BAMY06_ 01849 | Tubulin-like protein CelZ | MFGFIGVGQAGGSIADEAMKRGFHSVAINYSLSDLNSLINIQDKLHLVGTEGVGKDRSVAAKHMKNNWE SSIEFIKNTMEKPSVQVIFVVFSAAGGTGSGVAPILLELLNECLTHKTIVAVPILPDNNEVLVNQMNTL ELLDDLSMPETCVLPLDNQMVLSKYEGKISESRLYKETNKMFLDLIEVLLNYTDRGSKISTLDRKDLNQ LFDTPGIMTIAQTDLNEFTIEGKYFDKLHEDIQKSWNNSIFTPVEFTNVMRAGVILDVHEFLTEHISYN ELFNVFDNKMPLDLFKGHYDKGNRAITILSGLTWINERMKQLDDLIESGNTEVKETTVYKAKNRRREDL FKPRKLENKESKKTSYMEALKRLKR (SEQ D NO: 267) |
| BAMY06_ 01874 | SPbeta prophage-derived uncharacterized protein YopK | MNLKQMIKNECEKDNQLAAKLSKIAGYKKVNGFYKFINTPEKEMDNLGGLINIVKSLFPDNEEQLLSDY FLSLDPNKKCARQSVEYSDINQWDTLTDKIVSRLSSSKNLASQEWGNIYSIHRRLSESKISLTDAIRAT GKCKTDEMLFFSNAMLMYEYLKVGEFGLMKSTLSLLNFNDLPEGFVKDCYMNRISLLNANIYLNDNEIE KSRYYSEQVIQNSNINRLKVFGHLTYGNTLIFESYSKAKEQYLKGLEFARDNEHHKYKLRLALCFLSNL WNKDNKWLDFDTDNIPDKIEVAYYYTNNKEFNKAEKVINELENMELYEYDSGILDYIKGILYQNKNYFY ESTAKLKKSGDKLFINLPLAELRKMGCDEKLLELIMV (SEQ D NO: 268) |
| BAMY06_ 01926 | DNA primase | MDVYDLKNHIIEKPEYIVLILEQTGFYNVDERGNEYRCARKKGRNPTSVKVNKTTLGATCFSTNLKGDL ITLVQNKLGLSFPKTIKRISEIVDYKSEEEYKPPELPFGGFYKNIRRLSNPMDLDLETYSDDILDQFVS VPNKLFYEDGILPLTQSLFQVGYDSVSGRITVPWKSLSGELCGVMGRLNKKEVNDEETKWLPIISFPKS KTLYGFVENYSSIREKSIVMIGESEKHSMALASKGLNVGVSLGGSFLSEIQANHIKSMFPKKSLVMMDE GLGEEHSVEIANSLKFENFFENEVGYIFDRENKYLPKGSKMAPADLDKSTLHRLIRDCTVWI (SEQ D NO: 269) |
| BAMY06_ 01930 | SPheta prophage-derived uncharacterized protein YorP | MPKFWSYPEGLKVIINENAKNACPHHVGREGKIIELLHSATYDYAVSDETGDITFFKEHELNPAKGG (SEQ D NO: 270) |

TABLE 58-continued

| *Bacillus* strain 06 (BAMY006) protein sequences | | |
|---|---|---|
| Gene | Annotation | Sequence |
| BAMY06_ 01933 | Putative 5'(3')-deoxyribo-nucltotidase | MKKVIAIDMDQVLADLLSDWVAYINTYDDPFLKEEDILCWDISKYSNTQNNVYRHLDYELFRNLDVIEG SQRAVKELAKKYEVYVVTTATNHPESLKAKLEWLTEHFPYIPHSNVVLCGNKNIIKADIMIDDGVHNLE TFDGMKILFDAPHNRNDNRFIRVMNWEEIERKLL (SEQ D NO: 271) |
| BAMY06_ 02840 | N-acetyl-neuraminate epimerase | MTEKYDKWTRLLDMIEPNYAFESAVVGNSIYVLGGARNQKYNKNYSFDTISQKWTQGLDIPTPRVGSCT AVIGNYIYVLGGYKGANVYSSVDVYDTKTNTWGRVPDIPTPTCHASAAVINDTIYLIGGFDTDAAHSQH YAFDTLSKTWSVKKAPPINIYATETEVFNGKIYLVGGQTKEVVQGHIRSDLNEYIYEYDPVMDRWNRKK FLGPLQNTSTAVLNNKIYIIGGRKNPSVIEPLTKVYDPIKDEISVEKPYPFERYDARIAAVGDNLYLFG GLTPSGYALEYLHALTPVKTEEDKDGEPKNPEEPPNKQPASNRAILLVTMTTGLEKEFDLSMEEIKDFI RWYDQKSSGIGLSRYVIEKHYNNIGPFQNRRDHIVFGNILTFNVSEYTLDK (SEQ D NO: 272) |
| BAMY06_ 03260 | Low molecular weight protein-tyrosine-phosphatase YfkJ | MAGYKKAAPRIARLLDYVPESDLADVPDPYYTGNFSEVYALVESGCRHLLETIKKDHHL (SEQ D NO: 273) |
| BAMY06_ | Tartrate dehydrogenase/ decarboxylase | MGKEVVPQAERVLNAIAELHGGIAFDFTSFPRSCEYYLEHGTMMPDDGLETLQHFDALFLGAVGNQKLV PDHVSLWGLPIKIRR (SEQ D NO: 274) |
| BAMY06_ 03859 | Mitomycin biosynthesis 6-O-methyl-transferase | MTNSVQQDKQVPKKYPQAAVMQMVSGLGFSLAVKTAVELDVFSAFQNGPASAEAIAEALELNPSALFRL LRALESVGLVAQAQNGYYDVTEYGATLMPGKAKSIEPLVEYLLHETVVQSMFKMDYSIKTGKSAFEAIY GDKWYENNSLDQDYLKTMDKAMEIYSKMSLPSILKAYSFEKFDVIVDVAGGMGQLITGILGVAPKSKGI LFDLPKTIQSAKKHLASSEMSERCQFTEGSMFEEIPSGGDLYVISKVLNDWDDEHVVAILENIAGAMSD HSKLIIVENVPEADRLSPEEAFRDLLFLVCSAGGRVRKITEFEQLIEKAGLTLLNVIQTPSKYTILECG KK (SEQ D NO: 275) |
| BAMY06_ | 1-hydroxy-cartenoid 3,4-desaturase | MKNTEENKTAIIIGGGIAGMAAGCYLQMNGYSTKIFEMGLLPGGLCTGWKRKGYFFDGCISWLVGSGPN NTFHKFWKELNVIQNMEFINDEEFAVVNFRNGDTFTLYADVDKLEQEFLRVAPEDAETIKLLTDGIRVV SDVELDLDKAPELFDLADFEAFKAKAGPYMKVMGQWGKVTIKEFAQRFKSSFVRENVNRLFWFNVDTPI SYFMATLGWANSKSSGHPVEGSLQFAKIIEARYVELGGEIQYKSPVSKVLVENDKAIGIELKNGQCHYG DIVISAADGYKTIFEMLDGKYTDDELTFCYDNLKTSAPQIYVGLGVSKTFEKYPHYLSLELEQPLNAYG CDNVKNIFVKIYNENPSFAPDGKTSIIVYAKTSAEYWETLQKNNREKYEEEKKAIANVMIDELDKWFGE IKSNIDVTDVSTPYTIRRYTNNRNGSWQGWEKQMEGIMHEKKLKRSLPGLKDFYMVGHWSQVGGGLPSV VLQARNLVQVLCKEDGKVFETKIN (SEQ D NO: 276) |

TABLE 59

| *Bacillus* strain 071 (BAMY0071) protein sequences | | |
|---|---|---|
| Gene | Annotation | Sequence |
| BAMY71_ 00040 | Cysteine/ O-acetylserine efflux protein | MNSPLRCIEKINNAILFFNFIYNYSYHTIKNGSITLANEGDLMSIIAFLSYVLMTSITPGPSNILMMNEA RRAGFIGSWRFNGGILTGFAVLGILSGLFTMSVYHWIPVVEPYFKIAGAVYLLYLAWQISLPKTSKGDSE KTRSSFLSGFLFQMINIKSILFFLTLMSAFILPFQHTYPLIAFWLASAILLGWAALLLWSAFGSVFKHLF EKHDKAFRIVMCLLLIYSAVSIYL (SEQ D NO: 277) |
| BAMY71_ 00089 | Immunity protein SdpI | MKKYLFSAGIIVLTVFTWVCTYSSLPDNLATHWGLNGSANDYQTKANAMMMLIGIMIILYILMVIIPKID PKNNYKTFIRPYMAIFNTMFAVLFVINLITILTGLGYDLPISYLGNFIVGVIFMVFGNFIQIVKPNFFLG IRTPWTLSSESVWKDTHRVSSKLFVLAGMLMMLAAFLPPVYRVSVIFMAAIGCIILSLLYSYIVYQRQLN K (SEQ D NO: 278) |
| BAMY71_ 00185 | Immunity protein WapI | MAKIGDGCLELEITPRRYHEAKDDPFISTTFELLEHNKAIARDYSAVLLESEYKMLISDIEALSAGNQDR IRLETIEPFFILSIDKENEHYRFIIRFMENHSNTTFYKLNCNEEKLEIFVKTLKSDLKDSKTLLGR (SEQ D NO: 279) |
| BAMY71_ 00194 | Immunity protein WapI | MSELVFTRINTKINTSGPIILSMNAAELIVLAQEKVRKEEYINHIFIFRNGDGHLRHRYQIQTSMNIIGV QKSGDLFLFLIHKDYEDGVIQEDPNIYIWHPLKGFYHSLYGGRYIRSMTVDSANNLWLGYDEAGIFSCLD DDISSKGVARFPFEDGTWKSCSDTFRTAPHLIDHFYGAYAKKDAMYLHYRTLGEDYIRKVDLQGETLSFH RADFDFSAQFKKDSSYYFLIRNQASCQIDKALKFHNMTKQAGEYQLTDKISRKPLRFTQVAAYQDKAAGI DESNRLYLLS (SEQ D NO: 280) |
| BAMY71_ 02759 | Tyrosine recombinase XerC | MASIEPRGKNSFRLIVENGYDAKGKRDRRKKTIRIEDPKLLKTKRKLQEYLEDQLHRFRIEVEAGEYIAP EKSTFDSFAEKWIEKKLFNKNGKPYSFTTSVKYSNHLKNHILPALGHKKIDKIKSLHIVDFIDDLSKDGA RKDGKPGGLGDQTIKDIFKILQALFKTATEEWKLIKDDPIEGLSSPEAENKEMNFLESDEAAECIKVLYE IDIKWRLYYLAALIGGLRRGEALACEWHLDVDWDKGGIYVNRSISKTINGEPHVKSPKSKSSQRFVKMPD FYMNELAKYYRLWKKEKLLLGDAWEGGEHQYVFHSGKGKPYYYTTPTAKWTKIKKKYGLKDVRLHDLRHT MVALLMEAGES (SEQ D NO: 281) |

TABLE 59-continued

| *Bacillus* strain 071 (BAMY0071) protein sequences | | |
|---|---|---|
| Gene | Annotation | Sequence |
| BAMY71_ 02900 | N-acetyl- transferase Eis | MNREKRLELKKVKPKHLQQFNQLLRYVFQVTNSNLHEVGWKEPEIASAKLPVLEQAHVLGWFDKDKLVSQ<br>AAVYPFQVRIFNKTFEMGGVTGVGTYPEYANMGLMAKLLYKALVDMRERGQSVSYLFPYSIPYYRRKGWE<br>IISDKMTFEVKDFQLPKMSTVSGEVERVEPEHEVIKEVYSRFAHKSHAAMIRNELAWDEYWRWDLEELTA<br>AVYYDQSRQANGYVLYWIADEVFHIKEMVYVNEEARRGLWNFISAHFSMVTKVVGDNYSNEPIAFLLEDA<br>EIEETISPYFMARIVDIEQFINQYPFKPQKEKRTWSFTLEDPLLEWNQGVFTAEISPEGKAVLSPGGDAD<br>AAKLDIQTMTALLFAYRKPEYLHRTGRLECSPDTLEFIEDLLETQTPYFSDYF (SEQ D NO: 282) |
| BAMY71_ 03233 | Trans- aconitate 2-methyl- transferase | MEIETIVRESEANRIQAQTWFSHPEKSKVSFRYDERETSSIRSISIETFLSFYSSKFNREPYSVLDIGCG<br>QGQVIQYLNSRFQKIELTGIDSSAQAISSAKKLGINASFICSNAENIMQYVSKKQDIIFIHLCFGLFKNP<br>IAIVNTLIHLLSDQSCIYIVDLDRNSLGEGLNTAQSREEEAYLKDQYRASLTLEEFKQLLHVVTKEQHGV<br>SFQVGNSFIGGFDETSSQFFSLMRNRNLQDALRTSVGEQFKQSQMPALLHGWIIKNKR<br>(SEQ D NO: 283) |
| BAMY71_ 03424 | Thymidylate synthase | MRKRTFHEAYTETLYDIYHNPEFFNSPRGQKSREQLNYHLTLENPIERVTYLSSRKTNIVFNFAEVLWYL<br>SGSNDLDFISYYNKKMPSYSMNKKTLTGTAYGPKIFEFGNAKLNQWNRIKNLLTQEDIDSKRAFIQIFDA<br>SELFVLENIDVSCTIGLQFFVREGELYMSSVMRANDAFRGMISDLFSFTFMQELMARELRVEVGEYFHNA<br>GSIHIYDSDHEWAKTVLEEAENHHDIPEFEFPKMPEGNNWPSIETVLKYEELLRKDQISMTKNDIEMLDL<br>PDYWKQILFLFSIYQHIAYKRDMDHSLFQSLLPIYQFFVRNKWFHYFSTEQKEEIQ<br>(SEQ D NO: 284) |

TABLE 60

| *Bacillus* strain 105 (BSUB 105) protein sequences | | |
|---|---|---|
| Gene | Annotation | Sequence |
| JS609_ 00762 | Beta- galactosidase YesZ | MRKLYHGACYYPELWDEETIQQDIDIMREVGVNVVRIGEFAWSVMEPEEGKIDVGFFKEIIARLYDSGIETIM<br>CTPTPTPPIWFSHGRPERMHANEKREIMGHGSRQHACTNNPYFRKKAAIITTAIAKELGRLPGLIGWQLDNEF<br>KCHVAECMCETCLRLWHDWLKNRYGVIERLNEAWGTDVWSETYQTFEQVPQPGPAPFLHHASLRTMYQLFSME<br>MIASFADEQAKIIRCYSDAPITHNGSVMFSVDNERMFQNLDFASYDTYASQENASAFLLNCDLWRNLKQGRPF<br>WILETSPSYAASLESSAYPHADGYLQAEAVSSYALGSQGFCYWLWRQQRSGSEISHGSVLSAWGEPTIGYQKV<br>LAVERARKEIEPIILSTEPVQAEAAMTYSDRAKAFIKTEPHRGLRHRSLVTHFYERILNTGIHRDLIPEGAPL<br>DGYRLLFTPFVPYLSSEFIKKASAFAEAGGIWITGPLTGGRTCEHTIHTDCGLGELEKTSGIKTLFTFPMNEN<br>VNTGKAFGITAPLGLWSAVFDTESGNTLGTVESGPGAGHAFLTEQNYGEGKIVMLGSLPSGKEGDAMLEALVR<br>HYAEEAVISSRSDVTPGTIVAPRKGENGLVWIVVNMDGKGGSVTLPEAGTDLLTHRLEKAGRLAVGPHEYRVI<br>QFDNHS (SEQ D NO: 285) |
| JS609_ 03436 | Beta- galactosidase GanA | MSKLEKTHVTEAKFMLHGGDYNPDQWLDRPDILADDIKLMKLSHTNTFSVGIFAWSALEPEEGVYQFEWLDDI<br>FERIHSIGGRVILATPSGARPAWLSQTYPEVLRVNASRVKQLHGGRHNHCLTSKVYREKTRHINRLLAERYGH<br>HPALLMWHISNEYGGDCHCDLCQHAFREWLKSKYDNSLKALNHAWWTPFWSHTFNDWSQIESPSPIGENGLHG<br>LNLDWRRFVTDQTISFYKNEIIPLKELTPDIPITTNFMADTPDLIPYQGLDYSKFAKHVDVISWDAYPVWHND<br>WESTADLAMKVGFINDLYRSLKQQSFLLMECTPSAVNWHNVNKAKRPGMNLLSSMQMIAHGSDSVLYFQYRKS<br>RGSSEKLHGAVVDHDNSPKNRVFQEVAKVGETLERLSEVVGTKRPAQTAILYDWENHWALEDAQGFAKATKRY<br>PQTLQQHYRTFWEHDIPVDVITKEQDFSPYKLLIVPMLYLISEDTISRLKAFTADGGTLVMTYISGVVNEHDL<br>TYTGGWHPDLQAIFGVEPLETDTLYPKDRNAVSYRSQIYEMKDYATVIDVKTASVEAVYQEDFYARTPAVTSH<br>EYQQGKAYFIGARLEDQFORDFYEGLITDLSLSPVFPVRHGKGVSVQARQDQDNDYIFVMNFTEEKQLVTFDQ<br>SVKDIMTGDILSGDLTMEKYEVRIVVNTH (SEQ D NO: 286) |
| JS609_ 02990 | Pullulanase | MVSIRRSFEAYVDDMNIITVLIPAEQKEIMTPPFRLETETTVFPLAVREEYSLEAKYKYVCVSDHPVTFGKIH<br>CVRASSGHKTDLQIGAVIRTAAFDDEFYYDGELGAVYTADHTVFKVWAPAATSAAVKLSHPNKSGRTFQMNRL<br>EKGVYAVTVTGDLHGYEYLFCICNNLEWMETVDPYAKAVTVNGEKGVVLRPDQMKWTAPLKPFSHPVDAVIYE<br>THLRDFSIHENSGMINKGKYLALTETDTQTANGSSSGLAYIKELGVTHVELQPVNDFAGVDEEKPLDAYNWGY<br>NPLHFFAPEGSYASNPHDPQTRKTELKQMINTLHQHGLRVILDVVFNHVYKRENSPFEKTVPGYFFRHDECGM<br>PSNGTGVGNDIASERRMARKFIADCVVYWLEEYNVDGFRFDLLGILDIDTVLYMKEKATKAKPGILLFGEGWD<br>LATPLPHEQKAALANAPRMPGIGFFNDMFRDAVKGNTFHLKAAGFALGSSESAQAVMHGIAGSSGWKALAPIV<br>PEPSQSINYVESHDNHTFWDKMSFALPQENDSRKRSRQRLAAAIILLAQGVPFIHSGQEFFRTKQGVENSYQS<br>SDSINQLDWDRRETFKEDVHYIRRLISLRKAHPAFRLRSAADIRRHLECLTLKEHLIAYRLYDLDEVDEWKDI<br>IVIHHASPDSVEWRLPNDIPYRLLCDPSGFQEDPAEIKKTVAVNGIGTVILYLASDLKSFA<br>(SEQ D NO: 287) |
| JS609_ 03083 | Spore coat protein SA | MKLAFICTEKLPAPAVRGGAIQMMIDGVTPYFSSRYNLTIFSIEDPSLPKRETKDGVHYIHLPKEHYREAVAE<br>ELRASSFDLIHVFNRPLNVSLYKKASPNSKIVLSLHNEMFSEKKMTFAQGKEVLDNVSMITTVSEFIKQTVIE<br>RFPEAEDITKVVYSGVDLNSYPPVWTMKGSAVRKTYRKKYGIEDKKVILFAGRLSPIKGPHLLIHSMRRILQQ<br>HPDAVLVIAGGKWFSDDSENQYVTYLRTLALPYRDHIIFTKFIPADDIPNLFLMADVFVCSSQWNEPLARVNY<br>EAMAAGTPLITTNRGGNGEVVKDEVTGLVIDSYNKPSSFAKAIDRAFTDQELMNKMTKSARKHVEALFTFTHA<br>AKRLNTVYQSVLTPKNKQFPPPFLTQNFDLSSINQLFVKAKT (SEQ D NO: 288) |
| JS609_ 03086 | Spore coat protein SA | MKIALIATEKLPVPSVRGGAIQIYLEAVAPLIAKKHEVTVFSIKDPNLADREKVDGVHYVHLDEDRYEEAVGA<br>ELKKSRFDLVHVCNRPSWVPKLKKQAPDAVFILSVHNEMFAYDKISQAEGEICIDSVAQIVTVSDYIGQTITS<br>RFPSARSKTKTVYSGVDLKTYHPRWTNEGQRAREEMRSELGLHGKKIVLFVGRLSKVKGPHILLQALPDIIEE<br>HPDVMMVFIGSKWFGDNELNNYVKHLHTLGAMQKDHVTFIQFVKPKDIPRLYTMSDVFVCSSQWQEPLARVHY<br>EAMAAGLPIITSNRGGNPEVIEEGKNGYIIHDFENPKQYAERINDLLSSSEKRERLGKYSRREAESNFGWQRV<br>AENLLSVYEKNR (SEQ D NO: 289) |

TABLE 60-continued

*Bacillus* strain 105 (BSUB 105) protein sequences

| Gene | Annotation | Sequence |
|---|---|---|
| JS609_ 03085 | Spore coat protein S | MYQKEHEEQIVSEILSYYPFHIDHVALKSNKSGRKIWEVETDHGPKLLKEAQMKPERMLFITQAHAHLQEKGL<br>PIAPIHQTKNGGSCLGTDQVSYSLYDKVTGKEMIYYDAEQMKKVMSFAGHFHHASKGYVCTDESKKRSRLGKW<br>HKLYRWKLQELEGNMQIAASYPDDVFSQTFLKHADKMLARGKEALQALDDSEYETWTKETLEHGGFCFQDFTL<br>ARLTEIEGEPFLKELHSITYDLPSRDLRILLNKVMVKLSVWDTDFMVALLAAYDAVYPLTEKQYEVLWIDLAF<br>PHLFCAIGHKYYLKQKKTWSDEKYNWALQNMISVEESKDSFLDKLPELYKKIKAYREAN<br>(SEQ D NO: 290) |
| JS609_ 02087 | Spore coat protein I | MAENHEVIEEGNSSELPLSAEDAKKLTELAENVLQGWDVQAEKIDVIQGNQMALVWKVHTDSGAVCLKRIHRP<br>EKKALFSIFAQDYLAKKGMNVPGILPNKKGSLYSKHGSFLFVVYDWIEGRPFELTVKQDLEFIMKGLADFHTA<br>SVGYQPPNGVPIFTKLGRWPNHYTKRCKQMETWKLMAEAEKEDPFSQLYLQEIDGFIEDGLRIKDRLLQSTYV<br>PWTEQLKKSPNLCHQDYGTGNTLLGENEQIWVIDLDTVSFDLPIRDLRKMIIPLLDTTGVWDDETFHVMLNAY<br>ESRAPLTEEQKQVMFIDMLFPYELYDVIREKYVRKSALPKEELESAFEYERIKANALRQLI<br>(SEQ D NO: 291) |
| JS609_ 03439 | Cyclodextrin-binding protein | MKMAKKCSVFMLCAAVSLSLAACGPKESSSAKSSSKGSELVVWEDKEKSIGIKDAVAAFEKEHDVKVKVVEKP<br>YAKQIEDLRMDGPAGTGPDVLTMPGDQIGTAVTEGLLKELHVKKDVQSLYTDASIQSQMVDQKLYGLPKAVET<br>TVLFYNKDLITEKELPKTLEEWYDYSKKTADGSNFGFLALFDQIYYAESVMSGYGGYIFGKDKDGSYNPSDIG<br>INNEGAVKGAALIQKFYKDGLFPAGIIGEQGINVLESLFTEGKAAAIISGPWNVEAFSKAGINYGITKLPKLE<br>NRKNMSSFIGVKSYNVSAFTKNEELAQELAVFLANEKNSKTRYEETKEVPAVKSLANDPAIMKSEAARAVTEQ<br>SRFSEPTPNIPEMNEIWTPADSALQTVATGKADPKQALDQAAETAKGQIKAKHSGK (SEQ ID NO: 292) |
| JS609_ 00739 | Spore coat protein YeeK | MTDTRHMYGGPGFGHYQGFGIGHPGYGMYGGHPGFGMYGGYPDHGIHGGVGGYPGYGTYGGYGGSGGYPSGGY<br>GGSPGTVNYPNMHHENDGHHHYYHHHHDGKDNLHHHHHDGHYGHHHHHMGHWGKDGYK<br>(SEQ D NO: 293) |
| JS609_ 00895 | Small, acid-soluble spore protein K | MVRNKEKGFPYENENKFQGEPRAKDDYASKRADGSINQHPQERMRASGKR (SEQ D NO: 294) |
| JS609_ 00935 | Sporulation-control protein spo0M | MSFFKKLAASAGIGAAKVDTILEKDAYFPGEEVQGTVHVKGGKIAQDIRYIDLQLSTRYVIVKDDEEHRKYAT<br>IHSFRVTGSFTIQPGEEHQFPFTFTLPLDTPITVGKVEVAVVTDLDIQGGIDKSDHDRIFVEAHPWIENVLEA<br>IENLGFRLNEADCEQAPYFQRRLPFVQEFEFVPTSGYYRQMLDELELIFLLDEDGLEIIFEVDRRARGLRGWL<br>EEMYNDGEQLVRVRFSQSELEDTEELEEVLEEILDQYAE (SEQ D NO: 295) |
| JS609_ 01239 | Sporulation protein YjcZ | MGFGYGFGGGYGGGCYGGYAGGYGGGYGSTFVLLVVLFILLIIVGASFF (SEQ D NO: 296) |
| JS609_ 01281 | Spore coat protein T | MDYPLNEQSFEQITPYDERQPYYYPRPRPPFYPPYYYPRPYYPFYPFYPRPPYYYPRPRPPYYPWHGYGGGYG<br>GGYGGGYGY (SEQ D NO: 297) |
| JS609_ 01305 | putative oxidoreductase YjmC | MKTITIAAKEAKELVRQKLASAGLNERDAEKVADVLVHADLRNVHSHGVLRTEHYVNRLLAGGINPGAQPVFK<br>ETGPVTGVLDGDDGFGHVNCDMAMDHAIDMAKKKGVGMVTAVNSSHCGALSYFVQKAADEKLIGIAMTHTDSI<br>VVPFGGRTPFLGTNPIAYGVPAKHKKPFILDMATSKVAFGKILQAREEGKEIPEGWGVDENGEAVTDPDKVVS<br>LSTFGGPKGYGLSIVVDVFSGLLAGAAFGPHIAKMYSGLDQKRKLGHYVCAINPAFFTDWDTFLEQMDAMIDE<br>LQQSPPAVGFERVYVPGEIEQLHEERNKKNGISIARSVYEFLKSR (SEQ D NO: 298) |
| JS609_ 03269 | Uric acid degradation bifunctional protein PucL | MFTMDDLNQMDTQTLTDTLGSIFEHSSWIAERSAALRPFSSLSDLHRKMTGIVKAADRETQLDLIKKHPRLGT<br>KKTMSDDSVREQQNAGLGKLEQQEYEEFLMLNEHYYDRFGFPFILAVKGKTKQDIHQALLARLESERETEFQQ<br>ALIEIYRIARFRLADIITEKGETQMKRTMSYGKGNVFAYRTFLKPLTGVKQIPESSFAGRSNSVVGVDVTCEI<br>GGEAFLPSFTDGDNTLVVATDSMKNFIQRHLASYEGTTTEGFLHYVAHRFLDTYSHMDKITLTGEDIPFEAMP<br>AYEEKELSTSHLVFRRSRNERSRSVLKAERSGNTITITEQYSEIMDLQLVKVSGNSFVGFIRDEYTTLPEDGN<br>RPLFVYLNISWQYENTNDSYASDPARYVAAEQVRDLASTVFHELETPSIQNLIYHIGCRILARFPQLTDVSFQ<br>SQNHTWDTVVEEIPGSKGKVYTEPRPPYGFQHFTVTREDAEKEKQKAAEKCRSLKA (SEQ D NO: 299) |
| JS609_ 03519 | Pectate lyase C | MKKFVSILFMFGLVMGFSQFQSSTAFAADKVVHETIIVPKNTTYDGKGQRFVAGKELGDGSQSENQDPVFRVE<br>DGATLKNVVLGAPAADGVHTYGNVNIQNVKWEDVGEDALTVKKEGKVTIDGGSAQKASDKIFQINKASTFTVK<br>NFTADNGGKFIRQLGGSTFHVDVIIDKCTITNMKEAIFRTDSKTSTVRMTNTRYSNVGQKWIGVQHIYENNNT<br>QF (SEQ D NO: 300) |
| JS609_ 03778 | Respiratory nitrate reductase 2 | MKKKKMSPLFRRLNYFSPIEHHSNKHSQTTREDRDWENVYRNRWQYDKVVRSTHGVNCTGSCSWNIYVKNGIV<br>TWEGQNLNYPSTGPDMPDFEPRGCPRGPVFHGISTARSV (SEQ D NO: 301) |
| JS609_ 03785 | Subtilosin-A | MKKAVIVENKGCATCSIGAACLVDGPIPDFEIAGATGLFGLWG (SEQ D NO: 302) |
| JS609_ 03786 | Antilisterial bacteriocin subtilosin biosynthesis protein AlbA | MFIEQMFPFINESVRVHQLPEGGVLEIDYLRDNVSISDFEYLDLNKTAYELCMRMDGQKTAEQILAEQCAVYD<br>ESPEDHKDWYYDMLNMLQNKQVIQLGNRASRHTITTSGSNEFPMPLHATFELTHRCNLKCAHCYLESSPEALG<br>TVSIEQFKKTADMLFDNGVLTCEITGGEIFVHPNANEILDYVCKKFKKVAVLTNGTLMRKESLELLKAYKQKI<br>IVGISLDSVNSEVHDSFRGRKGSFAQTCKTIKLLSDHGIFVRVAMSVFEKNMWEIHDMAQKVRDLGAKAFSYN<br>WVDDFGRGRDIVHPTKDAEQHRKFMEYEQNVIDEFKDLIPIIPYERKRAANCGAGWKSIVISPFGEVRPCALF<br>PKEFSLGNIFHDSYESIFNSPLVHKLWQAQAPRFSEHCMKDKCPFSGYCGGCYLKGLNSNKYHRKNICSWAKN<br>EQLEDVVQLI (SEQ D NO: 303) |

TABLE 60-continued

| *Bacillus* strain 105 (BSUB 105) protein sequences | | |
|---|---|---|
| Gene | Annotation | Sequence |
| JS609_ 03787 | Antilisterial bacteriocin subtilosin biosynthesis protein AlbB | MSPAQRRILLYILSFIFVIGAVVYFVKSDYLFTLIFIAIAILFGMRARKADSR (SEQ D NO: 304) |
| JS609_ 03789 | Antilisterial bacteriocin subtilosin biosynthesis protein AlbD | MNNIIPIMSLLFKQLYSRQGKKDAIRIAAGLVILAVFEIGLIRQAGIDESVLRKTYIILALLLMNAYMVFLSVTSQWKESYMKLSCLLPISSRSFWLAQSVVLFVDTCLRRTLFFFILPLFLFGNGTLSGAQTLFWLGRFSFFTVYSIIFGVVLSNHFVKKKNLMFLLHAAIFACVCISAALMPAATLPLCAVHMLWAVIIDFPVFLQAPPQQSKMHSFMRRSEFSFYKREWNRFISSKAMLLNYAVMAAFSGFFSFQMMNTGIFNQQVVYIVISALLLICSPIALLYSIEKNDRMLLITLPIKRKTMFWAKYRFYSGLLAGGFLLVVMIVGFISGRPISVLTFLQCIELLLAGAFIRLTADEKRPSFSWQTEQQLWSGFSKYRSYLFCLPLFLATLAGTAVSLAVIPIAGLVIVYYLQKQDGGFFDTSKRERLGS (SEQ D NO: 305) |

A listing and tabulation of the sequences provided herein and in the sequence listing is provided below in TABLE 61:

TABLE 61

| | |
|---|---|
| SEQ ID NO 1 | BAML24_part1 |
| SEQ ID NO 2 | BAML24_part2 |
| SEQ ID NO 3 | BAML24_part3.fna |
| SEQ ID NO 4 | BAML24_part4.fna |
| SEQ ID NO 5 | BVEN24.fna |
| SEQ ID NO 6 | BAML36_C01_part1.fna |
| SEQ ID NO 7 | BAML36_C01_part2.fna |
| SEQ ID NO 8 | BAML36_C01_part3.fna |
| SEQ ID NO 9 | BAML36_C01_part4.fna |
| SEQ ID NO 10 | BAML36_C01.fna |
| SEQ ID NO 11 | BAML36_C02.fna |
| SEQ ID NO 12 | BSUB105_part1.fna |
| SEQ ID NO 13 | BSUB105_part2.fna |
| SEQ ID NO 14 | BSUB105_part3.fna |
| SEQ ID NO 15 | BSUB105_part4.fna |
| SEQ ID NO 16 | BSUB105.fna |
| SEQ ID NO 17 | BAMY_00429 |
| SEQ ID NO 18 | BAMY_00854 |
| SEQ ID NO 19 | BSUB_00009 |
| SEQ ID NO 20 | pta_54 |
| SEQ ID NO 21 | pycA_51 |
| SEQ ID NO 22 | rpoD_30 |
| SEQ ID NO 23 | tpiA_53 |
| SEQ ID NO 24 | glpF_3 |
| SEQ ID NO 25 | ilvD_57 |
| SEQ ID NO 26 | pta_61 |
| SEQ ID NO 27 | purH_1 |
| SEQ ID NO 28 | pycA_4 |
| SEQ ID NO 29 | rpoD_1 |
| SEQ ID NO 30 | tpiA_1 |
| SEQ ID NO 31 | ilvD_61 |
| SEQ ID NO 32 | pta_54 |
| SEQ ID NO 33 | pycA_51 |
| SEQ ID NO 34 | rpoD_30 |
| SEQ ID NO 35 | tpiA_53 |
| SEQ ID NO 36 | bsubtilis.glpF-faa62a0d09e3a6a685bd7c6c75b60369 BVEN24.fna |
| SEQ ID NO 37 | bsubtilis.purH-0f3c240ed708269f5eae590bedd2c888 BVEN24.fna |
| SEQ ID NO 38 | bsubtilis.glpF-faa62a0d09e3a6a685bd7c6c75b60369 BAML36.fna |
| SEQ ID NO 39 | bsubtilis.purH-0f3c240ed708269f5eae590bedd2c888 BAML36.fna |
| SEQ ID NO 40 | Plantaricin C_*B. amyloliquefaceins* #24 |
| SEQ ID NO 41 | LCI_*B. amyloliquefaceins* #24 |
| SEQ ID NO 42 | CircularinA_*B. amyloliquefaceins* #24 |
| SEQ ID NO 43 | Plantaricin C_*B. amyloliquefaceins* #36 |
| SEQ ID NO 44 | Circularin A_*B. amyloliquefaceins* #36 |
| SEQ ID NO 45 | LCI #24 #36 |
| SEQ ID NO 46 | Subtilosin A #105 |
| SEQ ID NO 47 | DNAX24 |
| SEQ ID NO 48 | DNAX 24 DNA |
| SEQ ID NO 49 | DNAX36 |

TABLE 61-continued

| | |
|---|---|
| SEQ ID NO 50 | DNAX 36 DNA |
| SEQ ID NO 51 | FMT 24 |
| SEQ ID NO 52 | FMT 24 DNA |
| SEQ ID NO 53 | FMT 36 |
| SEQ ID NO 54 | FMT 36 DNA |
| SEQ ID NO 55 | DNAA24 |
| SEQ ID NO 56 | DNAA24 DNA |
| SEQ ID NO 57 | DNAA36 |
| SEQ ID NO 58 | DNAA36 DNA |
| SEQ ID NO 59 | BVEN24_01791 |
| SEQ ID NO 60 | BVEN24_01791-protein |
| SEQ ID NO 61 | BVEN24_01661 |
| SEQ ID NO 62 | BVEN24_01661-protein |
| SEQ ID NO 63 | BVEN24_01292 |
| SEQ ID NO 64 | BVEN24_01292-protein |
| SEQ ID NO 65 | BVEN24_01010 |
| SEQ ID NO 66 | BVEN24_01010-protein |
| SEQ ID NO 67 | BVEN24_02313 |
| SEQ ID NO 68 | BVEN24_02313-protein |
| SEQ ID NO 69 | BVEN24_00384 |
| SEQ ID NO 70 | BVEN24_00384-protein |
| SEQ ID NO 71 | BVEN24_03064 |
| SEQ ID NO 72 | BVEN24_03064-protein |
| SEQ ID NO 73 | BVEN24_01295 |
| SEQ ID NO 74 | BVEN24_01295 -protein |
| SEQ ID NO 75 | BVEN24_01358 |
| SEQ ID NO 76 | BVEN24_01358 -protein |
| SEQ ID NO 77 | BVEN24_03390 |
| SEQ ID NO 78 | BVEN24_03390-protein |
| SEQ ID NO 79 | BVEN24_00352 |
| SEQ ID NO 80 | BVEN24_00352-protein |
| SEQ ID NO 81 | BVEN24_00492 |
| SEQ ID NO 82 | BVEN24_00492-protein |
| SEQ ID NO 83 | BVEN24_00796 |
| SEQ ID NO 84 | BVEN24_00796-protein |
| SEQ ID NO 85 | BVEN24_01233 |
| SEQ ID NO 86 | BVEN24_01233-protein |
| SEQ ID NO 87 | BVEN24_01465 |
| SEQ ID NO 88 | BVEN24_01465 -protein |
| SEQ ID NO 89 | BVEN24_00187 |
| SEQ ID NO 90 | BVEN24_00187-protein |
| SEQ ID NO 91 | BVEN24_02209 |
| SEQ ID NO 92 | BVEN24_02209 -protein |
| SEQ ID NO 93 | BVEN24_00552 |
| SEQ ID NO 94 | BVEN24_00552 -protein |
| SEQ ID NO 95 | BVEN24_03922 |
| SEQ ID NO 96 | BVEN24_03922 -protein |
| SEQ ID NO 97 | BVEN24_00837 |
| SEQ ID NO 98 | BVEN24_00837-protein |
| SEQ ID NO 99 | BVEN24_02921 |
| SEQ ID NO 100 | BVEN24_02921-protein |
| SEQ ID NO 101 | BVEN24_02742 |
| SEQ ID NO 102 | BVEN24_02742-protein |
| SEQ ID NO 103 | BVEN24_01491 |
| SEQ ID NO 104 | BVEN24_01491 -protein |
| SEQ ID NO 105 | BVEN24_03613 |

TABLE 61-continued

| | |
|---|---|
| SEQ ID NO 106 | BVEN24_03613-protein |
| SEQ ID NO 107 | BVEN24_00979 |
| SEQ ID NO 108 | BVEN24_00979-protein |
| SEQ ID NO 109 | BVEN24_00495 |
| SEQ ID NO 110 | BVEN24_00495- protein |
| SEQ ID NO 111 | BVEN24_01455 |
| SEQ ID NO 112 | BVEN24_01455-protein |
| SEQ ID NO 113 | BVEN24_03643 |
| SEQ ID NO 114 | BVEN24_03643 -protein |
| SEQ ID NO 115 | BVEN24_00306 |
| SEQ ID NO 116 | BVEN24_00306 -protein |
| SEQ ID NO 117 | BVEN24_03047 |
| SEQ ID NO 118 | BVEN24_03047-protein |
| SEQ ID NO 119 | BVEN24_00685 |
| SEQ ID NO 120 | BVEN24_00685-protein |
| SEQ ID NO 121 | BVEN24_03249 |
| SEQ ID NO 122 | BVEN24_03249-proein |
| SEQ ID NO 123 | BVEN24_01479 |
| SEQ ID NO 124 | BVEN24_01479-protein |
| SEQ ID NO 125 | BVEN24_01155 |
| SEQ ID NO 126 | BVEN24_01155-protein |
| SEQ ID NO 127 | BVEN24_01174 |
| SEQ ID NO 128 | BVEN24_01174-protein |
| SEQ ID NO 129 | BVEN24_00826 |
| SEQ ID NO 130 | BVEN24_00826 -protein |
| SEQ ID NO 131 | BVEN24_02383 |
| SEQ ID NO 132 | BVEN24_02383-protein |
| SEQ ID NO 133 | BAML36_02571 |
| SEQ ID NO 134 | BAML36_02571-protein |
| SEQ ID NO 135 | BAML36_02703 |
| SEQ ID NO 136 | BAML36_02703-protein |
| SEQ ID NO 137 | BAML36_03077 |
| SEQ ID NO 138 | BAML36_03077-protein |
| SEQ ID NO 139 | BAML36_03361 |
| SEQ ID NO 140 | BAML36_03361-protein |
| SEQ ID NO 141 | BAML36_02047 |
| SEQ ID NO 142 | BAML36_02047-protein |
| SEQ ID NO 143 | BAML36_03989 |
| SEQ ID NO 144 | BAML36_03989-protein |
| SEQ ID NO 145 | BAML36_01284 |
| SEQ ID NO 146 | BAML36_01284-protein |
| SEQ ID NO 147 | BAML36_03075 |
| SEQ ID NO 148 | BAML36_03075-protein |
| SEQ ID NO 149 | BAML36_03012 |
| SEQ ID NO 150 | BAML36_03012-protein |
| SEQ ID NO 151 | BAML36_00964 |
| SEQ ID NO 152 | BAML36_00964-protein |
| SEQ ID NO 153 | BAML36_04020 |
| SEQ ID NO 154 | BAML36_04020-protein |
| SEQ ID NO 155 | BAML36_03879 |
| SEQ ID NO 156 | BAML36_03879-protein |
| SEQ ID NO 157 | BAML36_03575 |
| SEQ ID NO 158 | BAML36_03575-protein |
| SEQ ID NO 159 | BAML36_03137 |
| SEQ ID NO 160 | BAML36_03137-protein |
| SEQ ID NO 161 | BAML36_02905 |
| SEQ ID NO 162 | BAML36_02905-protein |
| SEQ ID NO 163 | BAML36_00061 |
| SEQ ID NO 164 | BAML36_00061-protein |
| SEQ ID NO 165 | BAML36_02156 |
| SEQ ID NO 166 | BAML36_02156-protein |
| SEQ ID NO 167 | BAML36_03818 |
| SEQ ID NO 168 | BAML36_03818-protein |
| SEQ ID NO 169 | BAML36_00426 |
| SEQ ID NO 170 | BAML36_00426-protein |
| SEQ ID NO 171 | BAML36_03533 |
| SEQ ID NO 172 | BAML36_03533-protein |
| SEQ ID NO 173 | BAML36_01431 |
| SEQ ID NO 174 | BAML36_01431-protein |
| SEQ ID NO 175 | BAML36_01616 |
| SEQ ID NO 176 | BAML36_01616-protein |
| SEQ ID NO 177 | BAML36_02877 |
| SEQ ID NO 178 | BAML36_02877-protein |
| SEQ ID NO 179 | BAML36_00739 |
| SEQ ID NO 180 | BAML36_00739-protein |
| SEQ ID NO 181 | BAML36_03392 |
| SEQ ID NO 182 | BAML36_03392-protein |
| SEQ ID NO 183 | BAML36_03875 |
| SEQ ID NO 184 | BAML36_03875-protein |
| SEQ ID NO 185 | BAML36_02915 |

TABLE 61-continued

| | |
|---|---|
| SEQ ID NO 186 | BAML36_02915-protein |
| SEQ ID NO 187 | BAML36_00708 |
| SEQ ID NO 188 | BAML36_00708-protein |
| SEQ ID NO 189 | BAML36_04065 |
| SEQ ID NO 190 | BAML36_04065-protein |
| SEQ ID NO 191 | BAML36_01301 |
| SEQ ID NO 192 | BAML36_01301-protein |
| SEQ ID NO 193 | BAML36_03683 |
| SEQ ID NO 194 | BAML36_03683-protein |
| SEQ ID NO 195 | BAML36_01102 |
| SEQ ID NO 196 | BAML36_01102-protein |
| SEQ ID NO 197 | BAML36_02890 |
| SEQ ID NO 198 | BAML36_02890-protein |
| SEQ ID NO 199 | BAML36_03214 |
| SEQ ID NO 200 | BAML36_03214-protein |
| SEQ ID NO 201 | BAML36_03195 |
| SEQ ID NO 202 | BAML36_03195-protein |
| SEQ ID NO 203 | BAML36_03545 |
| SEQ ID NO 204 | BAML36_03545-protein |
| SEQ ID NO 205 | BAML36_01977 |
| SEQ ID NO 206 | BAML36_01977-protein |
| SEQ ID NO 207 | BSUB105_03898 |
| SEQ ID NO 208 | BSUB105_03898-protein |
| SEQ ID NO 209 | BSUB105_03508 |
| SEQ ID NO 210 | BSUB105_03508-protein |
| SEQ ID NO 211 | BSUB105_03228 |
| SEQ ID NO 212 | BSUB105_03228-protein |
| SEQ ID NO 213 | BSUB105_03203 |
| SEQ ID NO 214 | BSUB105_03203-protein |
| SEQ ID NO 215 | BSUB105_02743 |
| SEQ ID NO 216 | BSUB 105_02743-protein |
| SEQ ID NO 217 | BSUB105_02464 |
| SEQ ID NO 218 | BSUB105_02464-protein |
| SEQ ID NO 219 | BSUB105_02447 |
| SEQ ID NO 220 | BSUB105_02447 protein |
| SEQ ID NO 221 | BSUB105_02319 |
| SEQ ID NO 222 | BSUB105_02319-protein |
| SEQ ID NO 223 | BSUB105_02159 |
| SEQ ID NO 224 | BSUB105_02159-protein |
| SEQ ID NO 225 | BSUB 105_02999 |
| SEQ ID NO 226 | BSUB105_02999-protein |
| SEQ ID NO 227 | BSUB105_01250 |
| SEQ ID NO 228 | BSUB105_01250-protein |
| SEQ ID NO 229 | BSUB105_01052 |
| SEQ ID NO 230 | BSUB105_01052-protein |
| SEQ ID NO 231 | BSUB105_01039 |
| SEQ ID NO 232 | BSUB105_01039-protein |
| SEQ ID NO 233 | BSUB105_01026 |
| SEQ ID NO 234 | BSUB105_01026-protein |
| SEQ ID NO 235 | BSUB105_01018 |
| SEQ ID NO 236 | BSUB105_01018-protein |
| SEQ ID NO 237 | BSUB105_00862 |
| SEQ ID NO 238 | BSUB105_00862-protein |
| SEQ ID NO 239 | BSUB105_00773 |
| SEQ ID NO 240 | BSUB105_00773-protein |
| SEQ ID NO 241 | BSUB105_00728 |
| SEQ ID NO 242 | BSUB105_00728-protein |
| SEQ ID NO 243 | BSUB105_00700 |
| SEQ ID NO 244 | BSUB105_00700-protein |
| SEQ ID NO 245 | BSUB105_03452 |
| SEQ ID NO 246 | BSUB105_03452-protein |
| SEQ ID NO 247 | BSUB105_00590 |
| SEQ ID NO 248 | BSUB105_00590-protein |
| SEQ ID NO 249 | BSUB105_00445 |
| SEQ ID NO 250 | BSUB105_00445-protein |
| SEQ ID NO 251 | BSUB105_00431 |
| SEQ ID NO 252 | BSUB105_00431-protein |
| SEQ ID NO 253 | BSUB105_00268 |
| SEQ ID NO 254 | BSUB105_00268-protein |
| SEQ ID NO 255 | BSUB105_00074 |
| SEQ ID NO 256 | BSUB 105_00074-protein |
| SEQ ID NO 257 | BSUB105_03255 |
| SEQ ID NO 258 | BSUB105_03255-protein |
| SEQ ID NO 259 | ELA191006 16SrRNA BVEN6_C18 |
| SEQ ID NO 260 | ELA202071 16SrRNA BVEN2071_C21 |
| SEQ ID NO 261 | BAMY06 ELA191006 strain genome na |
| SEQ ID NO 262 | BAMY071 ELA202071 strain genome na |
| SEQ ID NO 263 | BAMY06_01888 protein |
| SEQ ID NO 264 | BAMY06_00183 protein |
| SEQ ID NO 265 | BAMY06_01794 protein |

TABLE 61-continued

| | |
|---|---|
| SEQ ID NO 266 | BAMY06_01845 protein |
| SEQ ID NO 267 | BAMY06_01849 protein |
| SEQ ID NO 268 | BAMY06_01874 protein |
| SEQ ID NO 269 | BAMY06_01926 protein |
| SEQ ID NO 270 | BAMY06_01930 protein |
| SEQ ID NO 271 | BAMY06_01933 protein |
| SEQ ID NO 272 | BAMY06_02840 protein |
| SEQ ID NO 273 | BAMY06_03260 protein |
| SEQ ID NO 274 | BAMY06_03522 protein |
| SEQ ID NO 275 | BAMY06_03859 protein |
| SEQ ID NO 276 | BAMY06_03861 protein |
| SEQ ID NO 277 | BAMY71_00040 protein |
| SEQ ID NO 278 | BAMY71_00089 protein |
| SEQ ID NO 279 | BAMY71_00185 protein |
| SEQ ID NO 280 | BAMY71_00194 protein |
| SEQ ID NO 281 | BAMY71_02759 protein |
| SEQ ID NO 282 | BAMY71_02900 protein |
| SEQ ID NO 283 | BAMY71_03233 protein |
| SEQ ID NO 284 | BAMY71_03424 protein |
| SEQ ID NO 285 | JS609_00762 protein |
| SEQ ID NO 286 | JS609_03436 protein |
| SEQ ID NO 287 | JS609_02990 protein |
| SEQ ID NO 288 | JS609_03083 protein |
| SEQ ID NO 289 | JS609_03086 protein |
| SEQ ID NO 290 | JS609_03085 protein |
| SEQ ID NO 291 | JS609_03087 protein |
| SEQ ID NO 292 | JS609_03439 protein |
| SEQ ID NO 293 | JS609_00739 protein |
| SEQ ID NO 294 | JS609_00895 protein |
| SEQ ID NO 295 | JS609_00935 protein |
| SEQ ID NO 296 | JS609_01239 protein |
| SEQ ID NO 297 | JS609_01281 protein |
| SEQ ID NO 298 | JS609_01305 protein |
| SEQ ID NO 299 | JS609_03269 protein |
| SEQ ID NO 300 | JS609_03519 protein |
| SEQ ID NO 301 | JS609_03778 protein |
| SEQ ID NO 302 | JS609_03785 protein |
| SEQ ID NO 303 | JS609_03786 protein |
| SEQ ID NO 304 | JS609_03787 protein |
| SEQ ID NO 305 | JS609_03789 protein |

This invention may be embodied in other forms or carried out in other ways without departing from the spirit or essential characteristics thereof. The present disclosure is therefore to be considered as in all aspects illustrated and not restrictive, the scope of the invention being indicated by the appended Claims, and all changes which come within the meaning and range of equivalency are intended to be embraced therein.

Various references are cited throughout this Specification, each of which is incorporated herein by reference in its entirety.

SEQUENCE LISTING (309 sequences)

SEQ ID NO: 1 - DNA, 1000000 bp, Bacillus amyloliquefaciens
catcatatactgggccgtcgggagtaacgatattgactttaacggtcttcatgcttttaccctcctaggaccagattaaacttctacacccatctcttttgcattctcaatgacttcttcaatgcgtcccacaagacggaatgcatcttccggaagatggtcatatttaccggaaaggatttctttaaagcctcgtaccgtttctttaacaggcacgtaagaacccttttgtcccgtaaactgctcagctacgtggaagttttgagaaaggaagaactggatacggcgtgcgcggtgaacgacaagcttgtcttcttcacctaattcgtccataccgagaatcgcgataatatcctgaagttctttgtaacgctgaagcgttgactgaacttcacgcgccaccgcataatgctcttctccgacaatttccggagcaagcgcgcggaagtggaagccagcggatcaaccgcagggtagatacccatttcagttaatttacgctcaaggttagtcgttgcatccaagtgagcgaacgttgtcgccggagccgggtcagtgtagtcatcggcaggcacgtagatcgcctggatagatgtaactgaaccaacgtttgtagacgtaatacgctcttgaagctgacccatttctgtcgcaagcgtcggctgataaccaaccgcagaaggcatacggccgagaagcgcggaaacctctgaacccgcttgtgtgaaacggaaaatgttatcgataaagaacagtacgtcctgtccttgtttatcacggaaatgctcagccattgtaagacccgtcagtgctacacgcatacgtgcgcccggcggctcgttcatctgtccgaagaccatggctgttttcttgataacgcctgaatcgctcattcgtagaaaaggtcgttcccttcacgagtacgctctcctacaccggcgaatacggaaataccgccgtgctcttgcgcgatgttgttgattaattcctggattaatacggttttacctacgccggcgccgccgaacaatccgattttaccgcccttgatgtaaggagcgagcaggtcaacaaccttaatccccgtttcaagaatttcaacctcagttgaaagctcatcgaatgaaggagctgatctgtggatcgggtccttttgagcatccgcaggcagcggttcatttaaatcaattttatctcccagtacgttaaatacgcgtccgagagtcacatcaccgactggaacggaaatcggcgcacctgtatcaacggcttccattccgcgctgaattccgtccgtagatgccatggcaattgtacggactgtatcatcgcctaaatgaagagcaacctctagcgttaggtcgatgcctacttcattttcgcctgtagctggctgtgaaactttaatcgcattataaatcgcaggcaagtggccgtcctcgaaacgtacgtcgacaaccggtccaagcacctgacttacgcgtcctttcttcatcgctatccctcctgacaaaatctttctattctaaagcggctgcaccgccgacaatttcggtaatttcttgtgtaatcgccgcttgacgcgcgcggttatatgaaagcgaaagtgaatcaatgagttctttcgcattatcagtcgcatttttcattgctgtcattctcgcagcgtgttcacttgctttactgtcaagaagcgcgccgtaaattaagctttccgcatattgaggaagcagcacttcgagcacctcttcttcatccggttcgaactcgtaagaagccgtgcgcttcccgccgctcgttccgaaatccgttaaaggcagcacttttttctccgtcacttcctgtgaaatcgcactgacgaaatggttatacaccaaatgcagttcatcaaaagcgccgtcgataaacatttgaaccgtctgacgggtcaaatctttaatctgagcaaaagtgacctcgtcgccaagccccactaactcagacaaaatcggcatctcccgttttttgaagaaatcgcggccgactctgccgattgcaatcaccgtgtattcatctttagactgatggcgttcttgaatggtgcggtaagcgtttcgcaaaaccgaactgttaaacgcacccgcaagcccgcggtcagacgtaatgacgagatacgccgtctttttcacttctcttgagacaagcatcgggtgtttcgcgtttttcgcgccttttccgacgttaaacacaacctcctggatctatccatatacggagcaaatgacttcgcgttggtttccgcacggttcagcttcgcagcggataccatctgcatggcttttgtaatctggcttgtttttttcgttgacgtgatccttgacttaatatcgcgtaatgaggccaaagatttcaccacctttattcttcatttgcgtaaaaagagagaaaagagaacctttttctctcatcttctaagggttagttgcttggtgcaaatgtgcgtttgaagccttcgattgcagctttgaagtcttcatcagcaggaaggtttcctgttttcgcaatgccgtcaagcagatctttatggttttgatcaaggtacatgtagtactcttcttcaaaacgtctgatatccgcaaccggaatatcatcaagatatccttttgtcagcgcataaagaatggctacctgtttttcaaccggaagcggcttattcaagtcttgcttcagcacttcaactgtacgcgcaccgcggttcaatttcgcctgagtcgcctggtcaagatcagatccgaattgggcgaatgcttcaagttcacggtatgaagcaaggtcaagacgcaatgttccagctacctttttcatcgctttgatttgggctgacccgccgacacgggatacggataatccggcattgatcgcaggacgcacgcctgagaagaatagatcggattgaaggaaaatctgtccgtcagtaatggaaatgacgtttgtcgggatataagcggagatatctcctgcttgtgtttcgacgaacggcagcgccgtaattgatcctgcgcctttagcgtcactcagcttggctgcgcgctcaagcagacgggagtgaagatagaatacatccccagggaatgcttcacggccggcggacggcgaagaagcaatgacagctcacggtaagcggccgcttgtttggaaatcatcatatacgacgagaacgtgcttgccgttgtacatgaattcttcacccattgtcacccctgcatacggtgcaaggtaaagaagcggagccggctgtgaagcggatgccgtcacgacaatcgtgtaatcaagcgcgccgtgcttacgaagtgtttccaccacgccgcgtactgtagattctttttggccgatcgctacgtacacacagatcatgtcttgatctttttggtttaagattgtatcaatcgcaacagatgttttacctgtctgacgatccccgataatcagttcacgctgtccgcggccgatcggaattaacgcgtcgatcgctttgatacccgtttgcagcggctcatgtaccgatttacggtccattacgcctggagcctggctttcgatcgacgtgttttgcttgtcagaatcggacccagtccgtctaccggctgtccgagcgggttgacgatacgtccgattaattcttcacctacaggaacttccatgatgcggcccgttcttttgacctcatcaccttcgcggatatctctgtaaggtcctaagataacgatacctacgttggattcttcaaggttttgagccatacccaaaacgccgtttgaaaactcaacaagttcaccggccatacaattgtcaaggccgtgtacacgcgcaataccgtctccgacttggatgactgtacctacgtcatgaacttcaatttcagattggtaattttgaatttgctgctttatcagcgtgctaatctcttcagctttgatgctcacttaggtttcaccccttctatcgatttccccggcaagttgacgttccatgcgctcaagctttccgcttacgcttccgtcataatccggtttccaatgcggactttaatgccgcctattaaatccgtctgcacttcatttctgattctgagcgaagcgattccggctttttttgcaaacacttgagacaatgataacatttccgcttctgaaagcggctttactgaataaacaaccgcgtcctctgtctgacgggcctgattggcaagtttgataaactcgtctgtgagatcaggcacaatcgaagaccggcggcggtcaatcagaagaaaaatcgtatgcagcacagactcagacagtgcgccgaacgattgctgaatcagctctttttcttagcggccgataccttcggatggcttagcacttcctgtaatccggcttcgtttcggaacacttctttagtacggtaagctcttcttcgatttcattgatttgagaagtctcaacggcaatgtcgaaaagcgctgacgcgtatcgtttagagacagcagatccactcatcggctttctcctacctctttaagatagtcctgaatcagttgttcctgggcttgttcatcaagctctttttcaatcactttcgatgcgattaagacagaaagtgatgcgacttgctcgcgaagtgcggaaaccgcttgttctttttctttgacaatttcggttctcgccgcttctttcaatctttcagactcggcgcgtgcagcctggataatgtcttccttctgcttttcacccagttttttcgcattttcaatgagtgattgtgattcctgtttcgcttcttttaaaagaacgcgctgctcttcaatcagcttctgcgcttctttatttctttcttcagcggacgtaatttcgccggcgatatgatcttcacgctgtttcattatattttaatagcggtcccagagcgaatttcttgagaagcgctaataaaactaacatagctaacaattggaataggatatctccgccgttaaacgacagtcctaattcaagaggtaattgagacatctactacggcaactcccttctgcaggttttctctgctgataaaaagccgtttcgggacggcctgcttatcagacataaagcaatggcgaaggttctcttagagtgatcttcgccattttagttcatataaggcttttttgcttagccaaagaacgctaagaacgcgataacgacagcgataatcggaagggcctcaaccaatgcgatacccatgaacataagagttctaagttcttttcctgcttccggctgacgggcgattccctctaccgtacgtgaaacgatcagaccgttaccaatacctgcaccaagtgcacctaaaccgattgcaattgcagctgctattaaattcatgaaaaagttcctcctttaaaatgttatccgaatggatatatgattttaatgatcatgactgattttgtgtgacatgtacaccatcgtcagcatcgtaaagataaatgcctggatggtaccgatgaacaagctgaatgcctgccatgcaagcatcggaataatggctccgactgtgccgaccaaccgagaaagaaactgtttgagtagaaattcgtcgccagattcgcaagcaggccaagaagaatttcccggcgaaaatttaccgtaaagacgaagtccgagtgtcagcgtattcgcaaactcctcaatgatcttcatcgggaacataagcggaaccggtctgaggtaatccttagagtattccttcaaacctttcatcttcacgccgtaatagtgcgttaacgacacaaccataacggctagagtcagagtaatagccggatcagccgtcggtgatttccaccaaagctcgtgtccgaccgttacagaaaacggcagccctagcatattgatacaaatatgtaatcagcaggttacaccaagcgccaagaagttagcccctgtttttaaatccattgtactgcctataatattgcggacaaatcaacaatccattccatgaagttctgggcttttcccggacggatggacagcgttcttgtagtaagaatcgcaatcagcagcacaatcacacttgccacagtaatcatcagaatgtttgtcagattaaaagtaagaccaaacaaatcaatagttctgtaatcgtgattcaatgggttttcacctctcttccattgatgaacgtttgagctgataatggaatctatcataatgacgggataaattgtcattaatccaataatcacacttgccacactgactttatcgggatatttaaaggcgacagccatcgcaagtatcgcattgcaccaacgcgctgcgctcccgagtgatcgtatggactttcctttcgccacggccttgtcaaaagcattcattcttctggtcaagagccacaaattaaacaaactgaaaacagttccaaaaagaggcctaaaaaaacagttttatacgccgtaagaccatatcccagcaaatagattgctaagattacaaatacatatctccgttgtctgctgaatgtaagattgggatcgtccatcaactatctgtctcctgatgaaaatgtaatataattcctggatacggcaaaacatgcggttaacccttgcagaaggcttttttgtccgcaaaacggcctgttcgaaaaaaccactcatcctcctgatgctacgggatgctgtttcattcgcttagataaatcctcatataacgggtttttttggaggatttaaaatgaggatggatactagaaatgaaaggaatgaaaaccttctcataataccctcgtttagcatacaatagccctaacatgtgtcaatctgtttaaagttaaaaaactttttataccggagcatacacagaatgttcacaattcacctataaatgtatgacctctgccattcagctaaaatctggataaaaaaagaaaacccctgaatgaggttttccgatttatttggttccgtacagtctgtcaccgcgtcaccgaggcccggaacgatatagcctttttcattcagtttttcatcaagggcggcgatataaatatcaacgtcagaatgatgtttctgcagctcttccacgccttccggagccgctacaagacacataaaacgaatgtttctcgcgccgcgctttttcaggctgttgatcgcttccaccgcagagcctcccgtagcaagcatcggatccacgacaataaattcgcgttcttctacatcagaaggaagcttgacatagtattccaccggttttaaggtttccggatcacggtataatccgacatgtcccactttagcggccgggattaatttcagcatgccgtcaaccattccgagacccgctctcaggatcggcacgataccgagtttcttccctgaaatcactttggatgtcgctgtttgaacaggtgtttcacttccacttctttaagaggaagatcacgtgtaatttcaaacgccatcagtgatgcgacttcatccacaaggtctctgaaatcctttgtgcctgtattttcattccgaatatatgtcagcttatgctggattaaaggatgatcaaatacgtaaacctttcccatactgtgttcagctcctttttgttgtccgagtgactttttcacacttctattgattctacagaaaaagacaaacagtttcaagaaaatcataaaaaaacccgccggattaaggttccggcgggtttcttccttattaatagtccagttctttatataaaggaaacttttcagtcaaggcagatacgcgctgtttcgcttcttcaagttttgcttcgtcttcatgattttcagcgcgaggccgatgatggcgccgacttcttcaagcgcgtcaccgtcaaagccgcggcttgtcacagccgccgtaccgagacggattccgcttgtgacgaacggtttttccggatcgtaagggatcgcgtttttattagatgtaatgccgatttcatcaagaacgtgttcagcgacttttccggtcagtccgagagaacggaggtcgacaagcacaaggtggttatccgttccgcctgatacgagctgaataccctctttgttcagagactcagccaggcgcttcgcgttcgagatgacgttttgcgcatatgttttgaaatcatcttcaagcacttctccgaaagaaacggcttttgccgcgatgacatgcataagcggtccgccttggattcccgggaaaatggatttatcaatcttcttgccgaactcttcacggcaaaggatcattcctccgcggggtccgcgaagtgttttgtgagtcgttgtcgttacaaagtcagcgtaaggaaccggattcggatgaaggccggctgcgacaagacccgcgatatgcgccatgtctaccatgaagtaagcgccgacttcatcagcgatttcacggaattttttaaagtcgatcgtgcgggggtatgcgctcgctccggcaacgatgagtttcggcttatgcgccagcgctttttcacgcacatcttcataatctatatattgcgtgtctttatcgacaccgtattctacaaagttgtattgaacgccgctgaaattaaccgggcttccgtgtgttaagtggccgccgtgggagaggttcatcccgagcaccgtgtcgccgtgctctaaaatcgtgaagtaaacagccatgttcgcctgagcgcctgagtgcggctgaacgtttacatgctcagctccgaaaatctctttcgcgcggtcgcgggcgatgtcctcaacgacatcaacatgctcacagccgccgtagtagcgtttgccgggtagccttcagcatatttgtttgttaaaacagagccttgtgcttccattaccgcttccgtcacgaagttttcagaagcaattaattcgatcttagtctgttgacgcttacgctcatctttgatggcgttaaacacttgtttatcttgtacaggtaaatgtttcatcagcgagatcctctcctatccgtttcctgttctttatttttaccaccttattgtacatggtttttcaggtgaatgtaacagcttatttaaaaaaatcacaaaatttaattagaaaacacgaacattatagaggaaaagtattttcatcattcgcattcatatacggcgcgaattccgcctatcagcttcggtcttgtccgggccatcgtcacatgtgcttctccaagctcacggctcgatatccggacagggacggcaacgggtttcagatgcatgccgatgaacgtatcaccgatgtcaatcccggcgtcagcctgaatcgattcagcgagcactggagaacgcatctgccggtatgcataagaggccatcgctccgcccgctttcgggacggggacggctgaaacaatggggagcctgaaccgctcggccgtttccgcttcaatgacaagcgccctgtttaaatgctcgcagcattgaaaagcaagatgcacacccgttttttccttaaaccggttaagtccgccgtatatcaattcagcccaatccccgcttccggcggtgccgatccggcttccggcggcttcacttgtactgcacccgaccaccagcagactgccgtccgtcagtcctgcctgctcttgaaactcagtcagcatgtccgtccatttttgcttcatctcttccattgtccagcacctcttacagatttttttcttcgtaatctgcgattttgccgatccgccgttcgtggcggccgcccgtaaattcagtcgtcagccagacttttgcgatttcgcgcgccagccccgggccgatgacgcgttcgcccatcgcaagaacattcgtgtcattgtgttcacgcgtcgcttttgcgctgaaggtgtcatgggcaagcgcacagcgtatgcctttaccttatttgcggagatgctcatgccgatgcctgtgccgcaaattaaaattcccctgtcagcttcgccgttcaccactttttccgctaccggaaaagcgtagtctgaataatcgacagagccggcgccgcattcacagccatatcaatgtattcaatctgcaattcatccaaaagactttttatttcttcgcggatatggacgccgccgtgatctgacgcaatagctactttcattcatttacctcctaggtgtggctgggcgaagacagcccagtgtgcttgtcctttttattacgaaatccgttgatttcattctactctttcacattcgttttgcaaatgacctgtttgcagattttctgacagattacttgcttttcccgtcaagcaattgatcagccaaaagggtcagcagctcctccagttcgtcccgcgtctgtttataaacatcaagcggaccgccgaacgggtcagagatatcgccgctttcccccgtcacgtattctttaatggtaaaaactttgccctgactgttttgatatcggccttcaatcagctgtttatgctgttcggtcatcgccagcaccagatcggccgtctcgatatgttcttccgataagggagatgaactgtgattgagggcgatccgtttttcaaacagcgcttctacggcatgagccgacgcttttccgtgcggagacgcgaatacgccggccgagcttacgctgacatccagccctttcgtttctgctatggatttaaaaagagcctcagccatgggactgcggcacgtattgcctgtacaaacaaagattattttcatgtccgtcacctcttactacctattataaatgaagaaaaagaaacggcatcttcgtttctttttttacgtatcttatatcggtaaaagcagtttcagcccgaatccgatcaaaatggctccgccaagcgcttcgctgtaggagccgagccatgactgcacctttcttcccgccaaaaggcccgcccatgttaaaacggtgctgaagaccccgaacagcgtaacggccagaaacggattggagccgttcatcccgagactgagcccgacagaaaagctgtccagactgacaccgaccgcaaacagcaacagtcccgagcctgccggagatatgagcggcccgtccgattgtttaaacgcggcgatcatcatctgcacccctaaaatgaaaagaagagatccgccgatgtaaacggcgagcatcccagaaaaccggacagcagatgcccggccgccattcctacaagcggcatcatgacatgaaacagcccgatgacaacccctatatgaaaaatctgttttttcttcagctgaatcattcccattccgagcccgacggaaaaggcatccgtcccaaagcaaatgccatgatgcttaaggagacaagttccccgatgaatagattcgacatgaataaaaaccccttggacgtgcccgcttgtttagcttatgcatgtccgataaggggtagaacaagttaatggataacggtgccgcctgcggctttcatcagcctgttcataacggcgagccccactccggtatccggaaaggactcagaaataatcatatccacttccgcttcatcaaagctgcggagcgcatcgtataaggcggacgccactgtttcaaggtcggcgcgtctgccgcagaccttgatataatcagcctggtaactatcggcgttctcttctgttgtcaaaatgccgattcgttttccccggcttttatatgcgtctgccagttcttgaattctccgggcgccgccgtcggcaatagccatcggcgcagaaggcgcgtaatgtgtatatttcataccgggagaaataggaacctcatcttcttcggtcagtcctttatccacaagaaccggaccggcggcggattcaatctgctcttttgtcacgccgcccggacgaagcagcacgggctgtttccccgtacaggacagaacggttgattccactccgattcccgtcgcgccgccgtccacaataccggcaatacggccgtttaaatcatgagctacatgctcggccttcgtcgggctcggttttcctgataaattggcgctcggcgcggcgatcggcagtccggccgagctgatgagggctaatgctgccggatgatcaggcattctgaccgctaccgtctccagtcccgcggtgacacggggtgacagcacaccgggcttacacggcaggacaagggtcagcgcccccggccagaatagctccataagctttttcgccgtctcaggaatatggctgataaaacgatcaagctggctgatatgggatatatgcacaatcagcgggttatcgctcggccttcctttcgcctcatatattttcgttacggcttccgtattttcagcgttagcgcccagtccgtaaacggtttctgtcggaaaagccacaacctcattctgccggagcaattccgcggcttgtgtaatttggggatcggttgtggataattctgcggaacaatccacaaaccatcttcttgttttcatgtataaccaaactccttattttaaagcggtaaaactttattttctctcgtgtattccttttgaaagtataaaagatgtcctttaataaaacaagcgttatccacaaactgtggacaacactttttaataagtggataaccttgtgtataagttagatcaggcagaggttttcaccattaaaaacgaaccttctgtgcataacgagttgcggaaatgttcggacgtatacagttcctcaggcgcatcggcgcacgcttcaaatcccatcacattcagaaactcagcagatgagggctgattggcgactaagtagacatcttgaatttcatgttttttgcacagcacatccatactttgaaacagtgtaacgatatggctttgattcagcctgtccgacatgacgagtgaacggagaagcccttttccgccgctgaatttttcgatcccgagacaggcggcaatctttttttcgctgtcttccagcacgataaaccggctgatctgctgatcgatttccgcatgtgccgtatcagactttttcaaaaaggcctccagcgcctccgtatcttgatctcttgccactctcagctgataaaacatatatttccctccgtttcgatcaactctttcttccaatctatgaatcgaatccggatttatgccttttgcttcaggaaaatagatctgaaatccaatcgacgaggaaaaacttcacttcggtatcatcgtcatctttattttctttcttcgctttatcggcctttgcttttacgtcatccagcactttttctgtctgtttctgcgtttcttcctgcttctgtccgccgtcttcctgatctttcaccgcttcgccgtttgagaaatcaaggaagcacagcggcggaaacaagacgcaccaccagttggcgccctcgccattgccgagtgtaattaaaatggcttcatattttccggccggatagaccatattgccgtacagctttgtcggaaacgagattttattgaattgaactgaaacggattgatgcgcacccttttctttcatcgtttgtttggcgatttctttaatttcaggaagcttcgaacgaatgagccgccgcgcttcttcaatggaagtgatatctttcacccagtccgtgatttgcttgtttacagcatctctgatctggcgcttgagcttttgatcctcatcgttatcactgttggccaaaatcctgagccggatcgcttcatccggtatgacgacgggctcatcggctgatgcccgcgccgtttcttcttttgtcaaacccgcaagcgctcctgataataaaagaaaaatatatatgcagatcatcattgtctgtttcatcggtccccaccgttcctctccgtgctttttttatctagtcccattatggacatgacggaaaaggtttaaaccggcgggaagaaaaaaatctagcaagctgataatctgcattgacagattcaaaatatggtacgatattattttgataggaggttttcagatgaaatataattacaccgtgctgctgtcggcggcatgtatgtctgtcatttattctattttgtatgttcatcaattcattatcgcggctttcatttcgatggcgttttattttttgtttccttatttgatttttgcgctgccgcttcaatactttctgaataaaaagccgaagagatttcatccgctgtattttctttattatttgggggtgtcgttcattgcaaacgggatcatcttcggtcttttgcagccgtcaggccaatctctgttttctaattcagccttttatatctttgcggttttaacagccgtcgtctattgggtatgggattccgtattgctgcaaagacaaaatccggctacagaagcgtaatcagcagacagccggctgaagggagagcggcgcaaaagaaaacggcggccatctttaaacgggcgcgccgtccttcttctgtttcagaatgataattggcccgctgctccgctccgcttacggccagcccggaaacgatgaccgctgcgacgataagaacagccgtaacggcgccgagaatgatgtcaaagccaaacggcaggacaaatccagccgcataagctgcggcggcgagtatacatccgaaggcgaacgcttttttcaaggcggatgcccctttcattttctttccattgtaacaaaagcccgccgtgtgcgtcaccggcgggcttttttcatgatgtgatgaccgcggatacggttctgtcttttccgttgatgtcctgtacgacttccacttccgcattcggaaaggaatgacggaacaggtctttcacggcttttccctgattatatccgatttcaaagacgacaagcgctttatctttcatgacaagaggcagctcctccataaaccgcttgtagaatttcaaaccgtcaccgccgtccgtaagtgcatgaagcggctcatggaaacggacgatatccgacaaatccgccatttcttcttcagaaatatacggcggattggaaacaataatatccgcttttattcctgatgaaataaaaggagttaacagatctccctgcaaaaagcggacgtccgctccgaggttttgcgcatttctttccgccacctgaagcgcttcttttgaaatgtccgaagccgatactgaaaaatgtccgcattcaagcgcgagcgtcaccgcaatggctccgctccccgtaccgatatcaatgacgttcaggcgttctccctcagaaaacacccgcttctgtctgtccagcagatgaaagacgacttcttccgtttccggacgcggaatgagaacatcgtcattcacaaagaattctctgccgtaaaactgttctttcccgataatatattgaatcggaacgccttctttatgcatttccacatgccgtctgaatcggtaaagctcgtcctcgccgacgggctcctgcagacttgcgagaagcttgctccgatccattccggtatcatttaacagcagcagctcggccgcgtttttttctcttcccgcttcggttaaataagaagaagcccagcttagggcttcaaaaacggtcttcatcttaattttccgcctgctggagcttgcttgactggtcttctacgattaacgcttcaaccacttcatcaagcttgccttccaggatttgatccagcttttgaatcgtcaggccgatacggtgatccgtcacacggttttgcgggaaattgtatgtgcggatacgctcggaacggtcgcctgatccgacggctgatttacgggtctgatcatattcagcctgagcttcctgctggaatttgtcatagattctggcgcggagcaccttcatcgctttttctttatttttaatctgagatttttcatcctgacaggatacgacgacaccggtcggtaaatgcgtcaggcgtacggccgacatcgtcgtatttacgctttgtccgcccggtccgcttgatgcgaatgtatcgacgcggatgtctttttcgtggatgtccacttctacttcttccgcttcaggaagacacgccaccgtcgccgtggatgtatgaatacggccgcctgattccgtttccggcacacgctgtacgcggtgcgcgccattttcatacttcagcttggagtatgcgccttttcccgtaatcataaagatgatttctttgtaaccgcccgttccggtcacgtttgcttccatgacttcagtcttccagccttggatttcagcgtaacgggagtacattctgtagagatttcccgcaaacagcgcggcttcttctcctcccgctgctccgcggatctccatgattacgtttttgtcatcgttcgggtctttcgggatgaggagcactttcaaacgctctgataaggtttccgtctctccctgcagttcggagatttcttccttcaccatttctctcatatcggcatcaagcttttcctcaagcatcgctttcgcatcggcaagctgttctgatgcgtctctgtattgtctatagacttcaacggtttcttgtatatcagattgctctttcgaatattctctaagctttttcggatcgttgaccacttccggatcacttaaaagctcatttaatttttcgtatcgttgttcaattgactgtaaacggtctaacacggtcttcacctctgttttcctgtgcgtaacattctcattatagtatagggcttatcaccagtcaaaagcaattcgcctctgttatactgaagcaaaaaaggaggggcggatatgctgaaatccatccaccatatagcaatcatatgctctgattatgaaaagtcgaaagctttttacaccgagatactcggtttcggcattataaaagaaacataccgaaaggaacgggaatcttataaactcgatctggcgctggacggcgcgtatgcgattgaattgttttcctttcccgatccgcccgaacggccgaccagaccggaagccgcgggtctccggcatctcgccttcaccgtaaacgatcttgaagcagccgtcagggagttaaagaaaaagggcgtcggcacagaaccgatcagaaccgatccgctgacggggaaacggtttacctttttcttcgatcccgacaagcttccgcttgaattgtatgaagcgtaacgttttttgaagaaatgccgctttctttggcgaattccttcttgttttgtctaacatgaagggaacgccgcctcatggtcgaatacctagcaaaaaggaggtatgtgatcatgaatacaaacatggccgcgaaagagctcggcgtctccgcaaaaacggtgcaaaggtgggtcaagcagctgaatcttccggctgaacggaatgagctcggacattattcctttacacctgaggatcttgatgtgctgaaatcggtcaaacggcaaatttctgaaggcactgcccttctggacgttcaagtgccccggcagccgaaaaaacggacgggcttcattttgcagcgtccgaaaatcaatggcggcgctgaacaaaggttggcagagctggagcgcaaactggacattctcacgaaagagaaacaggatgagaaccatctgctttcaaggatagaggagcttgaacgccagctgaaacaaaaggcggatgaaggggtgtcttatcagcttcttcagcacagacgggaaattgacgacctcaataccgaattgcagacattggcctcccgcatccaggaacttgcccagacagctcccctctcagaaacagccgcttcttcagaacataagaaacccagaaaaaaaacgagattttcgccttttaaatttcaattctaatcaaaaaagctccctgaaacagggagcttttcattatgcagtcagcgcaatgatgatcggcagtgagataagagataaaatcgcactgatcacgaacgcggacgcagtttcttcctcttgtttttcgaaacgtgtggcaatcatcgccgctaccgcagatccagggaatgcgacgagcaataccgctttagtgatctggtcagccggaagtccgactgcaagagcgatcaagtacatcagcgcaggctgaacggcaacttttaacaaagcgataccgaaagccggcagactgagcttgatgttgcggataccgacagttacaccgacggcaaagagtgcaacacctgatgttgtgcttccgagctgatcaagcattttttcacccaagccagggagtgttacaccgcagagtaccaggatgatactgataagcggtgcagccgcaagcggttcggaaagaccgtgaagaatagacttaccagtcattttccagaagttctcgttttcgctgtcttgtttcttagatgactcaccgactgtagcgataatgatcgcaagcgggtcaaggatggcgttaaccacgatacccgtaacggcgataggaatcgctacttcgtttgctccgaataagcttccgagtaccggaatacccataaatgcaaatgtcggctgtgcagagtttaaagaaaatacagatgaattcgttaaatcatacttgaagataaatttgcaaaccaacaaaatgacgataaagaatccgacaatcccaatgatcaaagcgatcattaaaggaacctgtgataaaaacgcacttcttgaagtggttaaaatacttgcgataaaatgcgccggaagcgcgtacttcgtaactaaggtgcttaccccttttgctgacttcgcgtcataacttccgaagcgacctgcgaaccatcccagcacgatcacgaaaaagatcggcgccaggaggattaaaatatctaagaagctcaaaatattctcctccaaatccttaatgtccgtatactttagcctttacataaaagctttccctcggactgtaaaattaatcgtaaaaattatttagcgataacttgtttatattgcggtttccacattgcatcaagaacggcttgttctacattctcaggaatgcggtttgccacgccttctttaatggcagtttccgctacggcgatcgcaactttaattgaaacttcttgtaagtcgctcatgctcggcagaaggcctgcacccggtgtttcaaaatcaacgctttctgcgattgcgtcagcagttgccgcaaacattgcaggagtaatcactttcgcttctacaacgattgaaccgagaccaagtccagggaacgcgaatgcgttgttagattgtccgatttcatgagaaacgccattgtactctacattgtcaaacgggcttcctgtcgccacaagcactttgccgtcagtccatttgaatagatcgctaggaacggcttcagcaagcggtgtcgggttagacatcggcatgatgaccggacgctcaacgtgttttgccatttctttgacgatttcttcactgaacgcgccgctttggcctgatgtaccgattaagattgtcggtttcgcttgacggatcacttcaatgaaaggaatttgtccgttttcatcgcgtttccaatctttaatttcttcagctgtgcgcaggtacggctcttggaaatcaagaatgttttccataccttcaattaacaagcctctgtagtccattgtgtagaacgctttgttggcttcttcttcagaaagaccggcaagcaccatagtgtcgcggatttggtcagcgattccgattccggcagatcccgcaccgaagacaaccacacgctggtctttaatagacgcgcctgttttcttcatagccgcaagcacacctgcaagcgtaatcgcgcctgttccttgaatgtcatcgttgaatgtaagaatttcatgattgtatttcttcatgatattgcgcgcgtttttgtttccaaggtcttcccagtgaagaagagctttagggaaatatttaagcgcagcttttacataagcgtcaatgaaagcttcataacgttcgccttggatacgttcatggcggttaccgatgtataaaggatcgttcagaagtttttcgttgttcgtaccgacgtcaagaacgacaggaataacacggcttgggtcaataccggcagcagctgtgtatacggctaatttaccgatggcgatgttgataccgcctacaccccagtcaccgattccgaggatgctttctgagtctgtcgcaacgatcagatcaatatctccggcagtggcatgaaggttttcaaatgcctcttcgattccttctacattgtcgatagaaaggtaaatcccttgaggtcttctgtactcatggctgtattcttgaatcgcttcaccgacagtcggtgtgtaaacaaccggcagcatttcacgaagatggttttgaagcaatttaaagaaaagaacttcgttacggttttgcaaatcattcaaatacacgttttggcgaaggcggtccggctgagcttgaaactgctcgtatgcgcgttttgcctgctcatcaagagacagaatggtcggaggaagcagcccgtctaatccaaggctttttctttcttctgctgaaaacgcaacacctttatttaaagtagggatagatagaacttcttttcctcttaaagtagtttctaagttgccttccttcgttactttaatattattcaagaaaatctccttctttcttcaaatagttaacaaagttaagtaattacccattttggctagtgtgatcgcgatctgctatatctttttttgacaattattcgaacaatgtctcataactatttacattacttagtcattttatgcctgtaaaaatgaaaattcaagagatgaaaattacttaattttttcatactcttttttaagttaattaactacaatttttgaaaaaccgtcaaaaaaacaccggattttttaccgatgttttcatgaaaagggttatttatcagtctgttttttcagcacttcgtggtgatgtctgcatctcgcttcgtatgactccgacgcgccgactaaaatgaccggatcatcataggaagcgggcttcccgtcaatcaaacgctgcgtacggcttgccggcgacccgcaaacggagcagaccgcctgcagcttcgtcactgattcggcaaccgccatcagattcggcaccacaccgaacggctctccccggaaatccatatcaagtccggccgcgatgacacgatagcctttatccgcaagcaaggataaatcgccgatgattgattcgccgaaaaactgcacttcatctaccgcgatgacgtccgtgctttcactgatatgatcccatatttcagccgaagacgagatgacgtggcttgtcatggatgtgccgttgtgagaaacgacagcctcctcactgtagcgattatcaatggcaggtttgaacaccttgacctcctgcttcgcatatgtcgctcttttcactctgcggatcagctcttctgatttcccagagaacatgctgccgcatatcagctcaagccatccgctttgcttcattatgtacataggctatccgctcccctttttttcctgtttatggacataaaaaacaggcaagaagcaattcttgcctgcctgtaaaatctattattacttaagaccgtattttttgttaaagcgatcaacacgaccatcagcagaagcgaatttttgacgtccagtgtagaatgggtggcattcagagcaaatctcaacgcgtacctcttcttttactgagcctgtttcaaattcatttccgcaagcgcatttaactgttgcttttttgaaattaggatgaattcctgctttcattgtatccatctccttccgccctgaatcccgtgtggaaacagagttattattccggagcgaatccggaacgcatatgagagaattatatcagtcatttactgcatttgcaaatacattttttatcagcggcgggctgatgatgaaaggtttgcctgcttccattcttggttgatcagatcgaagaattcctgattcgtttttgtttttttcatttttctcataaacttctctgcgaagtccggagaatcagacatcgatttgcggatcgcccatagacggtcaagatgctctttcggcacgagcagctcttccttccgcgtgccggagcggcggatatcgatcgccgggaaaatccgtctttccgcaagagaacggtcaaggtgaagctccatgttgcccgttcctttaaactcttcatagatgacgtcatccatccgggagcccgtgtctacgagcgccgtcgccaaaatggtcaggctgccgccctcttcaatgtttctcgcggcaccgaaaaagcgcttcggacgatggaacgcagccgggtcaatcccgccggaaagcgtacgtccgcttggcgggataacgaggttgtaggcccgtgccaggcgggtaatgctgtccatcagaatgataacgtcttttttgtgttcaacgagacgcatcgcccgttcaagcacaagctccgctaccttaatgtgattttccggcacttcatcgaacgtcgagctgacgacatcgcccgctacggaacgttcaatatccgttacttcttccggtctttcatcaattaagagcacgatcaattcagcgtcaggctgatttgtcgtaatgctgttagcgatttcttttaacagcatggttttaccggctttcggcggcgccacgatcagaccgcgctggccgaaaccgacgggagccatcatatcgagaattcttgttgagagatagttcggtttcgtctcaagcaccatttggcggtccggataaagcggagtcagcgcaggaaaatgaacgcgctctttcgcagattccggatcgtctccatttaccgcttcaacgtgcaaaagtccgtaatagcgttcgttttctttcggcggacgcaccttgccggatactttgtcaccgtttcttaaatcaaagcggcggatctgggaagcagaaatgtagatgtcttctgagcttggcgagtaattaatcggtctgaggaagccgaatccttccgattggatgatttcgagcacgccttccataaacagaagatcctcctgctcggcgttggctttcaggatggcaaagattaattcttttttagtcagtttgctgtagtaggagattttataatgtctggccagttcatatagttcttttaatttcatattttccaaagaggaaatagatacgtctttcataaaaacaccacgcttttcatagtcaatgtattgctgttttcattcaaatcggctgcttcgcatgattccgccaaagcacattcttttataaaacgttcaggaacttctatcggtaacacttccacccatgatcggcgcttttttaaaaaaggaatgtcttaatgagttttgaaggaagcgaggacaaaaacttgagaagatcaatatttatatcgtctgtatgcggtagaatttgaaaatttcccagtactcaaaagaaggaatgacacagaaaaatcgcagcactctttatttttacctcatttcaaaaaattattcaacttaaataatgctttgacatataaatgatagggttgactcttttttgcaaaagaaaagcgggactttccgtcccgcttttctctatttatggccggatcacaagatttggttttttcttcaggctgtgtcttccgtcaacgaatcggaccgttcctgatttcgcccggatgaccaggctttcagtcgtgccgacggagcctttgaactgaacgcctttcagcagctctccgtccgtgacacccgttgcggcaaaaatggcgtcatcccctctcacaaggtcctccatccggagcactttggatacatcaaggcccattcgctcacagcgggcctgctcttccgcactttgcggcagaagcctgccgatgatttcgccgccgagcgcttttaacgcaacggcagacagcacgccttcaggagccccgcctgaaccgaagagaatgtctactcccgtatggtcaaaggccgtattgatggcgcccgcgacatcaccgtcgttgatcagtttgattctggcgcccgcctcacgcaattcagagatgattttttcgtgtctgtcacgatttaaaatggttgccacgacatcttcaatgtctttgtttttcgctttcgcaacggcttttaagttatcaatgacaggcgcttcgatatcgatgcagcctaccgcttcgggaccgaccgcgattttttccatatacatatccggggcgttcagcaatgttccatggtcggcgaccgcgatcaccgtcagcgcattccagccgccgctcgctacgatgtttgtgccttcaagaggatcgacggcgacatcgacgcgcgggccgtatccgtttccaagcttttcgccgatgtaaagcatcggcgcttcatccatctcgccttccccgatcacgaccgtgcctttcatcggcaccgtgtcaaacacgtcacgcattgcgcttgtcgccgcatcatcagcttcatcttttttcccgcggcccatccatctggcagatgctaaagccgccgcttcagtgactcgaaccaattccatcgataagcttctttccatttcaacacgatctcctctcaaaagtccgcatttctatgaattttggagctgttctatctcttcgtccgtcagcctttgccgccagattgtggcgcccagaccttcgagttttttctcaagattgctgtagccgcggtctaaatgctcaagaccggtaatttcggttacgccgtcagccatgagcccggcgacgaccagacaagcgcctgcacgcagatcgctcgcctttacttttgcgccctgaagctcggccggaccggtgataatggccgacctgccttccactttcatattggccccatccgtctcagctcatcaatatgtttaaatcgggccgagtagatggtgtcggttacgacgctcgtgccgctggctctcgttaacagagatgtcatcggctgctgaagatcagtcgggaatcccgggtaaacaagcgttttcacgtcgaccggttttatctgcttctgcccgccgagcataagaagctgatcgtcactcgtctcaatgtaaaaacccatttccctgagcttcgccgttaaagactccaggtgagtcggtatgacattatcaataatgacttctttccccatcgcggcgccggcgatcataaaggtgcccgcctcaattctgtccggaatgatcgtatgcctgcatccgtgcagctcttttacgccgtcgattctgattacattggttcccgcacctttgatctttgcgcccatgctggtgagcaatgtggcaacatcaataatctcaggttccttggcggcgttttctatcacggttttaccttcagccagtacagcggcaagcatgatattaatcgtcgctccgacgctgacgacatctaaataaatccgtgcgcctctcagcctttcggcgcgcagataaatcgcgccttgttcattggtgacttccgctccaagcgcctcaaaccctttgatatgctggtcaatcggccgcggaccgagatggcatccgcccggcagtccgatgaccgcctgtttgaagcggccgagcatcgcgcccattaagtaataggaagcgcggagttttttcactttgccgttgggaagcggcatgctgatcatcggggaagggtcaacgaccatttctcctttttcaaaatggacgtttccgccgatttctttcagcaggtcacgcagcgtttcaatatctgagatctccggaagcccttcgatcgttacttcggaatttgccagaatggttgcgggtatcaatgcgacggcgctgtttttcgcaccgctgatatgtacggttccgtttaacggatcgccgccggcaatattcaacttttccatgatagtctccttccataagaagatagctgcggagcgtaaataaaatggcattttattctgtctctgcaaataaagctcttgtccaaaatgtagccaattcgaagagaaagaatacaaggacattataaaataacaggaagaaaatagcgaagctttgcggggcatttttaacacaggatgcacagaggcccgccgggttcatattccggggaaacacactcttcactttgatactgaaggcccgctgccaaacaggaaaacataagggtgcggcaaacggatgcaaccggtttgccgcccttttcccccttatttattccagtcagccaagaattgctcgatgcctttatccgttaacggatgtttcgtcagctggtgaatgactttcagcggcatcgtaccgatatgcgcaccgcgtaaagcggcttcagtcacgtgctgcgcatgacggatggaagctgcgatgatttgagtatcaatgtcatgaatgtcaaaaatctgtcttatttctgaaatcagttcaagaccgttatggccgatgtcatccagacggcctaagaacggagatacataagtcgccccggctcttgccgccaaaagcgcctggttggcgctgaaaatgagcgttacgtttgttttaatgttcaggtcgctcagcgcttttacggcttttaacccttcagacgtcatcgggattttcaccgtaatattcggcgcgattttcgcaagttctttaccttcttcaatcatttcttcagcattcagggaaatgacttccgcgcttactgatccgctcacgacttccgtaatctcacgaagtctgtcatggaaagacacgtcagcttctttcgccactaaactagggtttgtcgtaactccggcaagaacgccaagttcataagcttctttaatctcgtcaatgtttgctgtatcaatgaaaaataacataaggaaagcctccccagtaataaattttcagaactgtaaaacatgattgcgctttctaaaggtaagacataaaaccgcctgtcaatgctgtcaggcggtttatggatgttacattggattaagcttggtttgaagaaccgaactcacgcattttgccgataaccgtttctttgatcgcttcacgagcaggtccaagatatttacgaggatcgtattcgttcggcttagctgccaatgtttcgcggacagcttttgcagaagaaatttggttttcagtgtttacgttgattttagccgtaccaagtgagattgattttttaatgtcggcagtcggaattcctgtaccgccgtgaagtactaacggaaggccggttgatttgccgatatcttccatttctttgaaaccgaggttcggttcgcctttgtaagggccgtgaacagaacccagtgcaggtgcaaggcagtcgatgccagtgcgctctacaagttcttgacactctttagggtcagcatagattacgccttcagcgatcacgtcatcttcctgtccgcctacagttccaagctcagcttcaactgaaacgccgtggaaatgagcaagctcaaccactttagctgtagttgctacgttttcctcaaacggatggtgagatgcgtcgatcattacagaagtgaaacctgcatgaatcgctttcgcacaagattcaaagcttgaaccgtggtctaagtgaatcgcgacaggaactgtcactttgtattcttccataagagctttaaccatggcaaccactgttttgaagccgcccatgtagcgtcccgcgccttctgaaacaccaagaataaccggggatttttcctcttctgctgcttgtaaaatagcttgagtgaactcaaggttatttaagttaaattgtccaacagcatatcctttttctttagctgtattcaacatttccgtcattgaaactaaaggcatgtcgaaagtcctccttatgtagcctgatttgcttcttctcgaaaaaagctttccacctatagcatgaccataaaaacctgtcatatgtaaaacaacagatcgctttttctccatctctaggataccaacttttcgacaaatcggcaacacaatgacataattgtttctaattttattaattcgattttagaggtaaatattttttcaccgcgtctctgatctcatcaatgtcaaaaggtttcgcaaaatgagtcagcgctccgagctcttttgattccttaatcatatcgagttctccgtaagcggtcatgataatgacgcggatggattcgtcgatcatcttcatgcgcttgagaatttcgattccgtccatgccggggattttcatatctaaaagcacgagatcgggccgttctttcgttacgatgtccagcgcctgtatgccgttggcggcctgaaacgtctggtacccttctttatggaacacttcattgagcaatatgcgtataccgtattggtcatctacgattaaaatcttttcattcatcattttacaccccaatattatcattttcgtcaaaaggaagcagttgtttatgtattctgtttgattttcacatttcctttaattataatagtctactttccgacattttctgagcattttctcttttgttgtatactgttcttgtatgtgtaaaggaggtttcactcatgttaaagatatttacgacgcagcttgcaggcattttttcccgcattcaggataaggagtccgatgcaatagaagacggcgcgcgcctgctggcgcaggcagccgtcagcggtcataccatttatttatacggcgcaaatgagatgcagggcattttgtgcgaggcggaactcggctcagaaccgatgccttctgtcaaagcgtttccggatacagctgattcgattacagaaagcgacagggtgctgatgttttgttcaggtccgggcacggctgaagaacaggcgctggctcaaaagctttatgaaaaaggggtcggcctcgtttgcgtatctcctgtcatcaaagatcaaaccgggattgaggaattttgtgatgttcatattgacagcaaattaaaaatgccgcttctgcccgatgaagacgggacaagatacggctttccttcattaatgacaggcctgtatgtctatcacgcgctgtcctttacgttaaaggaaatgatgcaggaatatgcctgatgcagaaaaaagacttgccgcttttaaaggaggcaagtctttttttattacttctgttctgcagcttgtacggaagcgccgataaagtctttgaataaaggctgaggtcttgtcggtcttgatttgaactcagggtggaactggcaagcgacataccaaggatggtctttcagctcgatgatttccacaagacggccgtcagggcttgttcctgagaacacaaaaccgttctcttccatttgctgtctgtattcgttgttgaattcataacggtggcggtggcgttcgtataccacttcatccgaatacgcttcgaaggctttcgtgtcttcctgaagcttacaagggtacagtccgagacgaagcgttcctccaagatcctcgacatctttttgttctggcagaaggtcgatgatcggataaggagtggacggatcgatctccgcagagtgagccccttccagacctaatacgtttcgcgcatattcaatggatgcaatctgcatcccgaggcagatgccgaagaacggaattttattctcacgcgcatacttggcggcgatgattttcccttctacgccgcggtccccgaaaccgccgggcacgatgattccgtctgtgccgccagtcagctcttgaatattgctttctgtcacttcttcggcgttaatccatttgatcttcacatcagcgtcaaacgcatagcccgcgtggcgcagtgattcaacgactgaaatgtaagcgtcctgaagctcgacgtatttaccgacaaggctgattgtaatggttttagacaagtttttcactttcgtgacaaggtctttccattccgtcatatccgggtctttgcattctaatttcatatgatcgcagacaagcttatcgagtccctgctcctgaaggttaagcgggatggagtaaaggttgtccgcatcttcacactcgatgaccgctttcgtgtcaatatcgcagaagagcgcaattttatctttcatatcttgagaaatcggcatttccgtgcgcacaacgatgatattaggctgaataccgaggcttctcagctcttttacgctgtgctgcgtcggttttgttttcagctcgcccgccgctttgatgtacggaacaagcgtacagtgaatgtacatcacgttttcatggccgatgtcgcttttcatttgacggatggcttcaaggaacggaagagattcgatgtctcccactgttccgccgatctcagtaatgactacatctgcgtttgtttctttgcctgcacggtacacacggtctttcagttcatttgtgatgtgcggaatgacctgaaccgttccgccgaggtagtccccgcggcgctcttttttcaatacggcagaatagattttacctgtcgtcacgttgctgaatctgttcagattaatgtcaatgaaccgctcataatgccctaagtcaaggtcagtctcagcgccgtcatcggtaacgaatacctcaccgtgctggtacgggctcatcgttcccgggtcaacgttgatataagggtcaaatttttggatggtgacgctcatgcctctgtttttcaaaaggcggccaagtgatgctgccacaattccttttccgagtgatgatacaactcccccggttacaaaaatatatttcgtcatttcgtttgctcctctcttcggtctgcgctacattccttaaaatgtgccgttttatagaaaatcatttcactaaaaacaaatgatgtgtaaaagaatttgggagatgaaaataagaaagctccctttcaatttcttgaaagggagcgtagcactcttatgaattctcttctttttgaagagcccaaaatacatactacatagttcgacaatgaaagtcaagatcgttttgctgatataaaatcagtctttgcgatcctcttcctcatcatcataatcttcctcatcttcttcaatcatctcatcttcaatctcaagctcgtcgtcatcttcttcatcgatatcttcgtcgtcaaagctgtctgcgtcaaggtcaatatcttcttccatttcatcgagatcgatgtcatcttcatcaacttcctcgaattcatcaaggtcgagatcttcctcaacggcttttttcgcttttttctttttcgcttttacagtcggctgtgtttcttcgtccagctgatcgtacggataccagctgcggagcccccatgtctgatctgacagagcaataaagcggccgtcaatgttgaggtctgtataaaattgggcgatacggtcgcccagttcctctttcgtaacaccgagtaaggagatcatttcattcagcagctcctggaacggaaccggttttttatgttctgagaaaatttcgtgagcgatttcaactaaagccatctgcttcagctgttcctgagaatattgtttgatactcaaggtcggacactccctttctattacttatatgtatctgtttctatcctataataagaacgaatttgtattgttttgttcataaaccatacctctcattataaacaaattaaaacagaatatgctaccctaaacagcgtaatttaagaaattttagagccgccccttcataaatcggctgatgtgcgaaaacaaagccgccggcatatgcgccggcggcccgcttctttctataaagactcttgtttttcggcgccgaatacagacatggcgagcaattcactgacatcataagtgccgatcgcgtcttcggcttctttcgctttcgtcccgtcaccgagcatggtcagacagtaaggacatccggagctgatgaccgtcggactgacagaaagcgcctgctcagtccgggccgtgttgatcctcgctcccgtttcttcttccatccacatgagccctcccccggcgccgcagcacatcccgttttcgcggctgcgctccatttccttcaattgaacgcccggaatggcttttaagatcgctctcggcggctcatacacttcgttgtatcttcctaaatagcacgagtcatggaaggtaatcgtttcattgaccgggtgaagcggttttagtttcccctgtgacacaagctcggctaataattcagtatgatgatagacttcggcccggaatccgaaatcagggtattcatttttgaacatattataggcgtgcggatcaattgtgacgatttttttgattccgtgtttttcaaattcgccgatgttgtgttccgccagctcttggaacagaaactcgttgcccaaacggcgcggcgtatcgcctgagtttttttccttattgccgagaatcgcaaaggatacgcccgcttcattgagcagctttgcaaatgaaacggcaatcttttggctcctgttgtcgtaggaacccattgagccgacccaaaacaaatagtcgaactctttgtcttgttttttcatttctttcactgtcggaatctctgtatcagcctgctcccgccagttctcccgctctttccggtttaagccccacgggtttccctgtctttcaatgcttgtcatggcccgctgcgcgtcgctgtccatcttcccttccgtaagcacaagatagcggcgcagatcgataattttatcaacgtgttcattcatgaccggacattgatcttcacagttgcggcaagtggtgcacgcccaaatctcctcttccgtgatgacctcgccgattaagctcgggttgtaatcaatggctgccgccgcttcacgcgatcctccccctgaggaagccgcggcgagctgattcgccttcgtgtgctgaaaaacgggcgcgggcacccacggagattttgatgtcacggcagcgcctttttccgtcaaatggtctctgagctttaaaatgaggtccatcggcgagagcatcttgcccgtaccggaggccggacacatatttgtacagcggccgcattcgacgcaggcgtaaaggtcgacaagctgagagcggcggaagtcttcaatctttccgacgccgtagctttctttcgtctcatcggtaaaatcgattttttccagctttccttttgaatccagcctgctgaggaacacattcgccggacccgcaattaagtgcgcatgctttgattgcggcacgtacactaaaaagctgagcaaaaacaacagatgaagccaccatgaaacataaaacacggcggcggccgccggcgctgaaagaccgccgagcacaaacgcaatggaggaagcgatcggttccgtccaagacagagaatgatcgtgccataaaaggttcatggcgttcccgagcagcaccgtcaccatcagtccgccgataaacagcaggacaagccccgctttaaacccgcgtttcaatctgacgagcttttcaatgtagcgccggtaaaacgcccagactacggcgattaaaatcagaaacgtgacgatttcctgaaaaaaggtaaatgccggataaagcgggccgaacggcagatgccggtcaggaagcagccctttcagaataaaatcaattgcgccgaactgaacgagtataaaaccgtaaaaaaacagaacgtggatgattccgctctttttatctttcagcaattttttctgtccgaacacattcacccatatcttctgaagacgttctttcaggcgtttatcaaattcttccctttggccgagcttaatataagcgatcctcgttctgatcaggtaaacgaataaataaacggcgtaagcggttacagctgaaaacagcagcgcgtttaccatgagaaatgcgttcatcttgtctccccctttgttctgattcccctcttcattgtcatatctttactttatcataaataatgaatgagtgttcagtcaataattaaattcacattctcagggcacactacggatacttcggaaaggagcgtcggtatgaaggtcatttttgtgttgcttgtcatttttatcatattgatcgcacttatgctgcttgatatgctgcttggccgggcggcgtacaaaaaacaggcgtatgagcccgtttttgaccccaaaaaaagtgatatcacactcattcactgcggcagcgagcttgtgcagcagatgacggctgatatccgccaagccgtctcttctattcatatgatgttttttattatgaagaacgaccaagtcagccatgagatgtttgatttattgaaagaaaaggcccgggccggcgtctccgtatatctgctgctcgattgggcgggcagccgccaagtgaaaaagccttccattcaaacgatgaaaaaagccggcgttcacgttcattttctaaataaaccggcatttccctttctttttttcaggctgcaaaaacggaatcaccggaaagtgaccgtcattgacggcaaaatcggctatgtgggcggctttaatatcgctgaagagtacctcggaaaaaaagcgaagttcggaaactgggaggattatcacctgcggatgaccggcgaaggcacggcagatcttcagactctttttgtaagcgacctgaaacgaaacaccggaaaaacacccgaatcacccggggtttatccggcattatccgaagggaatatctctcataggacatatgcatctgacggtttttcgcttgaatcgcattatgaaaactgcatccgtaaggcggagaaaaaaatcatcatcggcacgccttattatgtaccgagcaaaaagcttcaggaagcgcttatttcagcctgccgaaaaggcgtcaaagtcatcttgatcgttccgatgaaatcagatcacccgctcgttcgggaaacagcttttacctattatcccgagctcctgaaggccggctgcctcatctatcggtattatcaaggcttttatcatgttaaagccttcattatagatgaccgcatcagcattatcggcacgccgaattttgataaacggagcctgttctggaatgaagaggtaaatgtcatcattcatgatgaggcctttacaaaggaagtgctttcaaccataaagcaggacatcgaaaaatccgagcttctcacattagaaaaagtgaaacagcgctccgtcagacagcttcctgcagaatggctgggaaaggccatatcttactttttataaaggagaaaccatatgctgttcagattcggattcgtcgcaaacgccatgtgcctttgggacgcgtcccccgccaaaaccttaacatatgcgcgctataccaagctttcccgcagtgagcggaaagacgctctgctttctgtgacgaaagcaaatcttaccaatacgctgcgcaccctccactatgtggtcggccacggcatccctttgtacaggttctcaagctcaattgtgccgctcgccacgcacccggatgtactgtgggattttgtcacgccgtttcgccaggagtttcgtgagatcggcgggctggtcagaaaatatgacctcagaacgagctttcatccgaaccaattcacgctttttacaagcccgaaacgggagattaccgcaaatgcggtcaaggatatggcctatcattatgacatgctggacgcaatgggcatcgcggaccgttccgtcatcaacatccatgtcggaggcgcttacggtgacaaacaaagcgcgcttggccgtttccgcgtgaatctgaaagaacttcccgaagtcatcaaacagcggatgactttagaaaacgatgataaaacatatacgtccgaggaaacactcagtgtatgtgagcaagaaggcattccgtttgtgtttgattatcaccatttttacgccaatccggccgatgacgctgatttagatgacattcttccgcggatgatcaaaacatggcagcggatcggcttaaagccgaaggtccatctctcctcgccaaaatcagaatcagccgtacgcagtcatgcggactatgtggacgcgaattttattctgccggtgctggagcggttcagacaatgggatgcgggcatcgattttatgattgaggcgaaagagaaagaccgggcgctgctccggctcgtcgaagaattaagcgccatccgcggagttaaacgcctggcgggcggagtgctgaggtggaaggcataaccaggtttatcacccgttcatatggggaatttccgaaataacagaccatcagacggaggagaaaacacatgaaaaacattacatctttgaaaatagccgctaagaagttcactttaagaaacatgcttcagctttatcagctttgccacacgggaggccacgagctgtatatctactctaaaaaaacaatgtgcaaaatcaaagatatcattgagctggaaacgttcagaatggctcataaagaacaagaatatttaattgtagtggaaggaaagaaagcggtgcagcttgttgaccgtttcaaacatatcatcgaacctgcgcaaaaagaagcccattaaatacggactacataaaaaaaaggatagacaggaggctgcccggcccccgctcgtctatcctttttccattattcatgtatcagctcgccgaattgggcctgatggagtctctggtatatgccgccggatgccagcagttccttatgatgaccttgttcagcgatgccttctttcgtgacgacgacgatcctgtccgcatccttaatcgtagccagccgatgggcgatcacaagcgtcgtgcgtccttcagacagctcttgcagcgatttttgaatggcggcttccgtttctgtatcgagggctgatgtagcctcgtctaaaattaagatcgacgggtttttcaaaaacattctggcgatggaaagccgctgcttctgcccgcctgacagcttcacgccgcgctcgccgatcaccgtgtttaaaccgtcgggatacccgtttaccagctcctctaaatgcgcctggcggacggcctgccggatttcttcctcagacgcatcgagccgcccgtacgcaatgttttcccgcaatgtgccggaaaacagaaagacatcctgctggacgacgccgatttgtccgcgcaatgatgacagcgtcatgtccttaatatcaattccatcgatggaaatcacgccttcagacggatcataaaaacgcggcagcagacttgtcagcgttgattttccggctcccgaaggcccaacgaatgcgactgtctcccctgcatgaatggacaaattgattcccgacagaaccgggctgttttcttcgtaaccgaatgacacaccatcataacggatattcccttttaaaccggacacatgtctcgcgttcggggcgtccttgatatcaggctccgtttccattatttctataaagcttttaaaaccggctatgcctctcggatacagctcaataattgcgttgattttatcaatcggacggaacagaacgttcgtcagcagcacaaaagcgacgaattccccgtaagataacgatccgcggatcacgaaccatgtcccgcacaacaggacgaacagcgtgacgaatcttgtcagcatgtaactgatcgagccgtttttcgccatgattttatatgacgtcagctttgttttgcggaaacgctgattgttcacgtcaaaccgctgcgtttcaaacgcttcattgctgaaagcctgaacaagacggatgccgccgatattgttttcgaccctcgcgctgaagtctccgacgtctttgttcagttttgtaaacgcagaggtcatttttttattgaaatacaaagcaagccaaatgacgaccggcataatgataaaggtcaacagcgcgagctgccagttaatgaacagcatcacaccgaacgcgcccaaaatcgtcatgaccgcgataaacaggtcttcaggcccgtggtgggcggtttctccgatatacatcaaatcattggtgagcttggacattaaactgcccgttttgttgttatcgtaaaatttgaacgaaagcttttgcagatggtcaaaaagctttttacgcatatcggtttcaatgttaatgccgagcatatggccccaatacgtcacaacatactgaagcgccgagctgagggcgtagactccgaataaagcagcggaagtcaaaataatcagacgccaatcccgcccgggagcaatgtatcgataaagtaattaacaatcagaggaaaactcagctccatcaatccgccggcgatggcagaaaagaagtcgagaaaaaacagcttcttgtacggtttataataagaaaaaaattgtcgcagcacgtttccgtcctccttgtgcctcgttcctaatgataatatttctcaattatactatacacaaggagttttaaaagcgttttttataaaacgccggaaaataaccgcgcgaaggattccttcgttctttcccataatgtgcgcttatagaaacggacggggctgattttctcagactctctcatatcctccagataatgcgcttcaagatctttgatcgccttttgatctgtaaaaaagacattgacctcaaagttcagctgaaagcttctcatgtccatgttcgccgtcccgacagaggcgaggtttccgtcagtgatgagcaccttttgatgcataaagcctttttgataggaatagacttcgattccttcgcgaagaagctcggggaaatacgatctcgtcgcgtactgggttaaaaatccgtcattggtttccggcaccatgactcgcacccggacgcctctggcagcagcctcctttagcgctgtgcggatcggctcattcggcacgaaataaggcgtcgcgatccatacagatgattcggccgccgctatcatggcataatacagatcgctcatccgctccttcatatcggggcccgtcggaacgacttgatagacgccgccgctttctgcagggaccgggcggctgtatgctttctgatcaatcagcacctcatccgaaacgtattcccaatcaagcataaaaatgctgtggagcgtctgaacgatttctccttcgactttcatatgggtgtcccgccaaaaaccgacactttggtctttgccgatatactccttgccgacattcagcccgccgacaaaaccggttttcccgtcaacgatgacgatcttgcggtgatttctgaaattgaacttttggttgaaaaaaccgtatttcagcggcagaaacgggacgatgttcacgcccgcgcgtttcagttttttaatgtcttttccggccagcttcaggctgccggccgcgtcgaacaaaaaccgcacttccacgccttgacgcgctttttccatcataatgtccatcatcttgtgcccaagcatgtctgatttgaacatgtaatactcaatatgtataaatgatgctgccgaccggagcgcttcaaacagctccggaaatgtttcatccccgtttttgagcaccttcagcctgctttttgtattgatattcatatgagacgccttgattgaatattgaaagaaacgcttctgatttcctttcagcccggacagatcgggcgtctgttccatatcaaatatcgttctcagcttttcccggttgtatgtccgtttcgacctgaacagcttgcctttttcataaagctggccggaaaaaaggtaaaataagtacccggcgatcggaaaaaacacaagaatatgaatccataacagcgtgtgctgagaggtgcggttttcaagaattaacgaatagatgctgaacaaaataatgcttgcatagcaaagcaaccctccgtaaaactcaagcctggaaaccggaaaaaaccatatgacatatgctccgataagcatcatatataaaaagcaaaattccagtctccttttcagcatcccgactctctcccatctgatccgatatctctgtataccctctgttttccggcctgtaaacatatgaaaaatcctctccgcacgagcggaaaggattatgatgacacttcctgtgactggccggttgtgatgttctgaagcaatgccggattgagcgagcagctgcctttgattttatttttgaagatgccgatgatcagaccggtgaccgctatcgacactaaggagaagagccctttcagcaatccgacggaaaaaatgccggccagcacgacgccaaaatcgaagaggaaattaacggcacccggattccatccgcagcgcttttgcagaaataaagcgaggatattggcgccgccgagcgatgcctgatgataaaacatgagcgacaggccgaacccgatcagcgccccgccgcaaatcgccccggcaagcggtgaaacagagaccggcggcagccagtgatccgcgccggtaaacagagtcagcacagtgactgcaaaaacggtggatagagtgaatttgattcccattctgatgagagaaaatatataaaacgggatattgatcagaaagaagataatcgcaaatgaggaatgaaacaagtacgacaggcttagtgacagtcccgctgtgccgccggttaatacatgagaatgtctgagtgtcaggacgccggcgcttgtcatcagacaggcggctaaaatgaggaaaatccgcttcattcttcactctccttttgttgatattatttccacataaaacataacaggaatccccgccgcccagccattaccttggcagaaaatatcttatgtttttattttttcaccataaaaaaatccccctcttgcagggggatttttacgtgcgtttccgatagacaacatagctgcgggtcaaatacttgaggggcaggctgaacacgtgaaccaatcttgtaaacggccaaaggataaaaacgacgtaccctatgatgatatgaaacttaaaccatagcgggacactctccatcaaagaagcgtcaggccggaacaaaacaatttccctgaaccacggcccgactgttgccctgtaatcaaatcctttcgagtcaatgttgagaaacgtggccgcaacgcccgacagcatcatgaacagcagcagaataagcgtcaggatatccgatggcgagctggttttgcggattcttttgtcaaacagccttctgtatgtcaggatcactagtccggcacaagccgcgatcccagccggcaggcctgcgccgatcgccattttgtgatacgtatgctctgaaatgcccagtacagtatacacgccttccgggatcagaattcccatgacatgtccgccgacaacgaacagcagtccccagtgaaaaagtgtgctgcccgccgcaagttttttcttttctaacagctcgcttgatttcgccgtccagccaaactggtcatgctgatagcggtaaatatgcccgccgataaagatcgtcaataccatgtacggcataatcccccacaggatctgcccgctcatgcctgagcagccccttcttcagtgctttcacgtacaccgatgctttccagcgcggcctgcagcacgtgcagcagctcagcatagaggctgtcatttttttcgaggcgggaagccagctccctcacattggacaggtatttctcaaacacgcttctcgccgcttcaatctccgcaaccgcggcgaattccagcatcagcggcagataatcaggcaattctttctctgtcggcaggaaaccggattgctggtaggtgttttttaaatgcagcagttcaattccgcgctccctttgctcgcctgagttaaagtaggtgacgtacatattcgtttttttcccgaagtcgaacgtatacacatagtgttcaatcagcgcttgcggagaaaagccggctgccgcctctaaaaagtgcagcagtttctcacggatttgctgaatgccgatttcatggataagagccttccaatcgggaagcccggctctccactcttcatccggataagagagaagaatggaaagagcggagaatgtcatttgccggtctgtggtgttcatcttgttccacctcatttatcaaaagttagaaacaagagccggggccgcctgaaaatgacaagccgcagcttccttgttcagcgtataaatcagacacttcttctcgatggctgctcgggatcacaaagcggtcatcatatttggcgatcgccagcagccgatacatgtcttcaatttgcttttctgttaagccgacactggagatcagtgccgggtcgatggatttattcgtctggactgctctcatatactggcgcatgacagacattttctttaacgttgaccgaatatgatccgtatcaccggctgttaataactgggccaaatagtcaatcggaattctcatttggtcgatagccggaaaaatatcttccgccgtttgccggctgccttttccttcaaagagattcataatcgggctcagcggcggaatgtaccaaaccatcggcagtgtgcggtactcaggatgaagcggcagcgcaatcttccaatcgatgatcattttgtagatcggcgattgctgcgcggcctctatccattcagccgggatgccttgttcttttgccagtttggcaacttcaggatcattcggatcaagaaaaacgtctaattgggaatggtagagatccttttcattttcaatggaggccgcttcctccactttgtccgcgtcgtacagcatgacgccgagatagcggattctgcctacacacgtttcggagcagatggtcggcagccccgcctccaagcgcggaaagcagagtgtgcatttttccgctttgttcgtttgccagttaaaatagacttttttataaggacaggatgagacgcaatatctccatgaacggcatgcgttttgatcaacgagaacgatgccgtcttcctcgcgtttgtacatggcgccggacgggcaggaggacacgcacgccggattgatgcagtgctcacaaatacgcggcagatacatcataaagacttcatcgaattctgttttgatcgattcctccatcttttgcacgtttggatcttcaagacccgtaatgtggccgccagcgagatcatcctcccagttcgggccccattcgatattcataaaatcgcccgtcaaggacgatttcggccgcgccaccggctggtgctttttctgcgggctgtttgttaatgtttcataatcatagttccaaggttcatagtaatcatcaatcgtcggctggttcgggttatagaaaaggcctgcaagccggtttgttttcgggcctgatttcagttcaagctttccttttttcaacgtccagccgcctttatatttgtcctggtcctcccattgcttcgggtagccgataccgggctttgtttcaacattattgaagtacatatattccgcaccggaacggtttgtccacgtgtttttacaggtgacgctgcacgtgtggcagccgatgcatttatccaagttcatgaccattccgatctgcgctttaatcttcaagccaatcgacctccttcagcttgcggatgacgacattcagatcgcgctgattccccgtcggaccgtaatagttaaagccgtagctgagctgtgcgtagcccccgatcatctgggtcggcttgacgtgaatccttgtcgggctgttatgggtgcctccgcggttattcgtcagttttgtgccgggcacgttgatgtggcggtcctgggcatggtgcataaacgccattcctttaggaatccggtgagacaaaaccgctctcgccacgacaacgccgtttcggttgaagcattcaatccaatcgttgtctttgatatccgtgtcctttgcgtcatctttattcatccacacggtcggcccgccccggaacagcgtcagcatcggcagggaatcaaaatacatgctgtggacggaccatttattatgcggcgtcaaataattaagaacgatctctttgccctcttgatcaggccgcttgctcaggaacggacggtgctggaggatcggtttaaatgtcgccatcgtttcaccgaattccatcatcagttcatgatcgacataataggattgtctgccggtcagtgtcctccacgggattaatttttccacattcgtcgtaaacggcgagtacctgcgccctcctttttctgagccggtaaaggccggagacgtgatgaccgttttcggctgggctgtaatttgctcgaacgtaaagcattcttcctcgcgttcttccgccaggtctttcagcttcaggtttgtgatgttttcaagcgattcccatgcttttacggcgacctttccatttgaggtggacgacagggttaaaatcgcttctgccgcctgctttgcttcacttatattcgggcatcctttggcaacgccgtctgaatcggtttctcccagtctctttttgagtgattcatattcatccgcaatcgaccagctcatcccttttgttccgctcggttttaaagccgtatgagggccgagcgcggtcattttatgaaaaatgtgtttgtaatcccgttcagcgacttggatattcggcatcgtttttcccggaatggcttcacattcgcccttgctccagtcattgatttttccgaacggctgggccaattcctgcatcgtgtcgtggaggagcggcgtcgcgactacctctttcaccagctccatatcgacttcttccgccaggtcggaaacggcttttgacagtgctttgaaaatatcccagtctgacctcgattcccacggcgccgagatcgccggagcgaatggatgaatgaacgggtgcatatccgtgctgctgagatcgtgtttttcataccatgtcgctgccggcagcacgatatcggaatacagcgccgtaccggccattcgaaagtcgagattgattaacaagtcgagcttgccttccggcgcctgctcccgccatttgatttcttcagggcggatgctgtcgctgtcgtcattcatcaaaccgttcgtcgtccccagcagatgcttaagaaaatattcatgcccttttcctgagcttgagatcagatttgcccgccatacaaagagattccttgggaaattcacttcattgtccgggtcttcaatcgcgaatttcagttttttctcctgaagctgtgaggccacgtacgcacctacgtcttcaggtgtcgccgcccccgccttctcagcttctttgtacagatcaatgccgttttgattgaatgtcgggtaggacggcagccaccctaatcgcgccgccagcacattgtaatcggcgtgatgcttgtagcgggatgaagaagcgatcggtgaagccaagtcactgatcggctggtcttcgtaacgccactggtctgtcgcaaagtagaaaaatgaggtgccgttttgcagtttaggcacgccttcccagtcctttgcggttgcgatcgtctgccacccttcagcaggacggagcttttcctgaccgacataatgagcccagcctccgccgtttacgccttgggcgcctaccaataaaacaagatttaacaccgcgcggtaaatcgtgtcggagttgaaccagtggttgattcccgcccctacgataatcatcgatctgccgtctgtatcaatcgcattttgggcaaactccctggcaatctgtataacggcttctcttttaattcccgtgatctgttcctgccaggcaggtgtgaacggacggggatcatcataagatgcggctgattgtccgccgatgccccggttcacgccgtagttggccaatatcaagtcaaatacagtcgtgacacacacctcttcaccgttcagttccagttttttaataggaagattccgctcaagcactttgtttccgtcatttgaaaaatacggaatgcgcaccgtactgatttcgtcctctattccgagcacggagagacggggctcgatctgttccccggtgtcttcatcgatcatgtgcagattccatttctgctgcccgtcccagcgggagcccattgttccttgcggtatggcaaacgcacctgtctgttcattccagaccgccggcttccattgatcatgctttgtctgccgtccgatatccttcgcatgcagaaaccgtcccgctgtgtatacgccattttcttttgataaggtgacgaggaatggaaaatccgtgtattgcttcgcgtattccatgaaacgttccgtctcttgattcacgtaaaattcctgcagaatgacgtgacccatcgccatcgccagggctccgtcagtcccttggcggatactgagccagtcatccgcaaactttgaggattccgcaaaatcgggactgattgaaatcaccttggcccctttatagcgggcctccgccaaaaagtgcgcgtcaggcgttctcgttaacggaacgttggaaccccatgtgatgatgtagcctgaattgtaccaatcactgctttccggaacgtccgtctggtcaccccaaatttgcggggacgccggcgggagatccgcataccagtcataaaaactgagcattgggccgccgattaaagacatgaatcgcgaacctgacgcgtggctgatcatggacatcgccgggatcggagaaaaaccgacattccggtcaggcccgtatttcatcactgtatacagcagagaggctgaaatcagcttcagcacttccggccattccgcgcggacaaagccgcctttccctcttgcctgtttataggacttcgctttttcagggttttcaacgatcgatttccaggcatccagcggattttgatgcgtctgcaatgcttcccgccacaaattgatcagcacacctcgcacatatggatatttcacacggagcgggctgtagatgtaccatgaaaaactggccccccgcggacagcctctcggttcgaaatcaggcatatccggtcctgttgatggataattcaagttttgtccttcccacgtgacaattccgtttttcacataaatattccagctgcaagaacccgtgcagttgacgccgtgggtggagcgaacgactttgtcgtactgccatctgtttctgtatacattctcccaatcacgatcttcgcttgtcgtttggctatgtttatttgaatgatgttcgataggagaaaaatagtttaatctcctgagcaacggactcattttctttttcttcatgatcgttcactccttccgagtcaggtgatgctatgtacactataaacagagacggcgcatcaccttgtgaactaagtcacacactctgcttttttcacaaaacgttcacacagagcagcaggaaggatttttaaacgatatgaggacgcccgcgtcatcaaaaaaaccggttctgtttaagaaccgggttcggcgttttcatccagtgatgtatgcagataccgcaaaaacaactgataggaacagaagacattttgctgaagcatcgccaaaaagttcatttgcagccgcggatggtaagacatcatttgcttaaatatagaatatggaatatggagtaccagaatatccggtgaggcattgactgagataaaaggcgataaagagagcccgcctttttcatcaatcggaaacacatcgcctttttcccacagcgcaacggtttgcgacccttcagggagcctgctgtccgtaaaacggatattgccttttaatacaatataaacggattgtgaatgaagaaaggatggagattggtcagatgagccgcggataaacgtcccgtttttcagcaaggtttcgacaatggacagaggcacttcattaaacataggaagttgtttcagaaataataaatagtcacactgattcataggaaagcctcctgtgctattgatagctttagtgtagcccgattgagcccgcgcggcagtgatgtatttcacagcttgtatgatgaaagtcacttatcaggagagtgtttgcacttataatgaaataaaaaggagggtttcgatgaaagcgatgattccgaagcagcacggcgcatgggcgatgctgctgattccatttttactcggcatggtcaagggaggcccggttttctggcatattccgctctttctgggctggctgttcctttacttgacggtttatcccgtttcgctcgctttgaaaaagaaacagcttcagccttatcaaaagtggatatggtattacggttttccggcctgctgctttttgatcatttctgtctttcataagccgcagctcgtctggatcggcgtttttttattgccgctgtttctcatacatacgcattatgcccgccgaaaaaacgaacgggcgctcacgaatgatattgcgggagtcttgttcttttgttcaggcgggcttgcgagctgctggctgggaacgggaatccttgacggctgggcttggtttctattcttgcaatccgctttattttttgtcgggagttctttttatgtgaaatcggtcatacgggagagaaaaaacagaaggtttgcttactggtcgtggggatatcacctcttgctcccctttttatcggctcttctcggggcaggctgggcgtttctcgcttttatcccaagcagtctgcgggcctggttttttcacggaagagactggccggtgaaaacgatcggcattctggaaatcgtaaatgccggcttctttttcgccgtcatgtgtatatgtatcacaagctgaaaaacaaggacaccggctgcccttgttttttcagtcaatattgcagatctcaagcggacaattttcacactcgatctcgcatcgtaaatagtcccgcttgtgcaaaataatttttccggtttcgtctatcgaaataaccccttgtttgcggaggtctcccagcatgcggttgacgctctcccttgccgccgcgcaaaacttagccaaatcctgatttgtcagcacaatgttaatcagaatcccgtcgcttcgttccaccccgtagctgtttgataagcggataagggtggaatagagcgccccttttttgccgtgaagaagcagatccctgatcttagactggatttttcgcagatgggtgctcatccatttcataaattcaaacgtcaaaacaccgttttggaccaattccttttccagcctgtttttattaatgacgagcacctccccgtcctctaacactttcgcactgagcatatatctcggctcatctgtgaatagcgtcaattctccgacaatatcgtgtttttggcagattctaagtgtcaggtcttttccgtcagatgtcagcttgccgatttcaatgagtcctgattgaatcagataaagctcttctgcatccattccttcttgaaacaaatacgtgtgttttttcattttccttttcgtactgatcgattccagcaattcatgcagttcgcgggaaagaagttctttatcagattttcggacagagagaatattcatgagctcacctcgaagaaagtcacgttgcgtatgtatattgtaacgtgacttgatttgcactcacccagaaaaaactaacaatcttgtgaatggatcattatgaatcaaggctatgactgtttctctccgtatgtgttttcattctttcctgccaatacatccagatcacaaggacaaagctggctaacgcaacctctgaaagcgccataaacccgatcgcgtattgacccgttgcctgaaatacacttgccagaatcagcggagggaaaaaaccgcccagtccgcccatggcagacacaataccgttggcaatcccagcttgcttcgaaaaatagaaaggcaccagtttaaataccgtcccgtttccaatccctgagcagactgccaccgtcagcgatccgaacgcataaaggccgatcgccggggagaatgacagcatgacgcctgacagcgtaagccctgcgaaaacgaacatcagaatgcggagcgggctcagtttatctgcaagaaaccctcccacaggcctgagcagcgtagagaccgcaataaagccggccgtccgcagaccggcgtccgcagggctcagcccaaaatgctcaaccaaaaaattcggaagatagatggtaaaggcgacaaaggcgccgaacgtaataaaataaaacaggctcaacatccacagcacatgatttcggtaaacggctttcatttgtgtctttatggaaactttgactttcttctcatgccggtcgccgaacaaaacgtgcagtaatgcgaaaacagccagcaaaacaagatacatctgcacggttgctttccatcccgcggcttgagcgataaccggcgccgcaaaggtagtaacggcggtcccgatgtttccggcaccgtaaatcccattgacgacaccgtgcttttctttcggataatatttcgggagggacgtcactccgatggagaataccgctccgccgatccctaagaaaaagccgcccgtgattaaatcaaataaagaatccgcgatactgatccaaaatacgggaaacaaaagcaggatgaagctgatcataaacatcagccgcgcgccatacctgttcgttaaatatcctaaaggaatacggagaagcgatccgagaataacgggaatcgccgtcaccaatgaaatctcgcctttgcttaaatgaatatctgatgtcatttgagaaatgagcgatgaaatcagcacccacaccataaaccctgccactaagcttaaagactgcagcgataattgaatatgttgacgattgatcattcggcttgcccctttcactgattcaatatcagtcttatcatacaaaaactcagtgtgctggattgtgaattacatcacacgctttatatgcaaaaaaaagaacaaagcccgaagactttgtcctttgatcatcattacattttttccggagcggatacgccgatcagctgaagcgcattgttcagcgtaatttgcgtcgccttcattaaagcgagacgcgcgcggctcttctctttattttccggatcgatgactttctccgcattgtagaagctgtgcagagcggaagccagatcataaatatagtttgtgacacggtgaggaatgcgtttttctgccgcttctgccactgcttcagggaagccgccgattgttttcagcaggtcatattctttttctgattgaatatggctgaaatcaagatctgccgccggtttaagtccctgctcctccccttggcgaagcatgctgcaaatacgtgcatgtgcgtattgcgcataatacacagggttttcattagatgtggatacggcaagatccaagtcaaaatccatatgcgtatcagcgctgcgcatcgcgaagaaataacgcacggcatccaagccgacttcttcaatcaggtcgcgcatcgttacggctttccccgtacgtttgctcatcttcattttttcgccgtttttgtataaatgaacgagctgaatgatctcaacttccaatgtgcctttcttgtaaccgagcgcttcaatcgccgctttcatacgcggaatatacccgtggtgatccgcgccccatacattgatgagcttgtcgaatccgcggtcaagtttgtctttatggtatgcgatatccggcagcagataagtgtatgagccgtcttttttgatcagcacacggtctttatcgtcgccgaacgttgtggagcggaaccatgtcgcgccgtcctcttcgtatacatggcccttttcgcgaagcgcctcgagcgcctgatcaatttttccgttttcgtacagtgacgtttcagaataccatacgtcaaacggcacgcggaagttttccaggtcggagcgaagtttatcaagctcgtactttaagccgtattcacggaaaaacgcctgacgttcgctctcctcttcatgtacgaaacggtcgccgaaatcttcggcaagctttttcccgattgctataatatcctcgccgcggtaaccgtcttccggcatcggtttctcgaggccgagcgcttcaaaataacggacttcaacggaaagcgccaggttgttaatctggttgcccgcatcattaatatagtattcacggctcacatcatagcccgctttagaaagcacgctgcacagcgcgtcacctaccgccgcgccgcgcgcatggcctaagtgaagatctcccgtcgggttggccgatacgaattcgacctgaatcttttcgccttgtccgatgtttgtctctccgtaatgttcacccgcttcaagcacggacggaatcagttttgttaagtagctgttgttcatgtaaaagttgataaagccgggccccgcaatatccatcttttcaatggaagctttgcctttatcaaatgacgccacgatctcctcagcgatttggcgcggcgctttttttgcgattctcgccagctgcatcgccatgtttgtggaataatcaccgtgtgttttgtctttcggcgtttctaacagtacgcttggaatctggctttcttccgccaggcccgctttcagaacggccgctttgatctcttccttcagcacgtccttcatttgttccgcaatattcatgcctttgtttcctccttatattggatcgtcatgttatgtacatgttcttggttttcgcctacagtcatgttatatgtcagtttgacggagccttccgaaccgccgacatcagattgaatgtttttcgtttccgtacggagctccatttgtccgaacggcagtttatattgagtgagtgtcgatgcccccggaatgaaccgctgtttcatttggatggcgcccgatctcattacgagaatctctttttctgtaatcttgacgaccgttttaatcttgcccaaatcatgctcttcgtgataggaaagatacgttttgccgtttctcacgtaatagaatccactcgatgtaaattcaaccgactcttcttcggagccgttatgaatgaatgattgcacatgaatggctactggtgtctcctgtctcatgctgacacttccttttcatcatcccgcttaacctgaatagtataagttttcaagggaaaaagttcaaccgcttcctcctatcttaccatctttgctgattggttttgaagataaacatgatttttaaggaaaatgaaaaaaccggaaatcctaggctgcgggataaatgcggttccttcggcggacggctttgtcaaaggggaaaagtttgcggtatttttgcgctatccttccgaatgaaaatgataaaatatgtcatatacataacgtggaagggagggattcggaatagtggcgagtgttttatcgtcttcagcggttggagaaaaaatcaacgaatggtatatgtacattcgaaggttcagcatcccggacgccgagtacttgcggagagaaatcaaagaagagcttgcaggcctggaagaagatcaggatcttcatctgtactattctctcatggaattccgccacaatctgatgctcgaatacctcgaaccgctggaatcgcagcggatagaagaacagccgagactatcggatctgctcgcggatattgataaaaagcaggcccggctgaccggacggcttgattattattttaattttttccgggggatgtatgagctggatcagcgggaatatttgtcggctataaaattttttaaaaaggctgagacgaaactctcatttattaaggatactattgataaagccgagtactttttcaagatgtctgaagtctactactatttgaaacaaacgtatgtatctaccgattacgcaaggcaggcatatgaaatatataaagctcagtcgtcatacgatatcaggctcatacaatgccaatccttattcggagcaaatttcctggatttaaaactatatgatcgggcaattactcactttcaaaaggctttttctttggcagaaacagaaaaacagcctcaattaatgggcaggacgctgtataacatcgcactttgcaaacaaagcctgaacgactatgaagcagctataacttatgttgaaaaagccattgatgtttttgaaagtgctaaaatgaccccttctttgccccaagcatattttttaatgacacagattcattataaattagaaagatacgacaaagcgctcgagtatcataaaaaaggagttatctattccgaagagtcagcagattcagtttatttacatgaattcgaatttttaaaatctttgtatgtgaacggacctgatgaggatgcaatgaaaaggagttttgactttttggaaagtaagatgatgtatgcagatatagaagattttgctcttgatgcagctaaatattatcacaaacttgaagattataaaaaagcttcaacatactttttaaaagttgaagaagcaagacagcatattcaagggggggtaactttttatgaagctgaagtataaggtcttactcacttgcttagctgtaacctcagtttttataacagcagatatgacgaatacaccttcacaccaattcgaagtagcacaaagagctatgatttaaatgataattacttttaggcttgcaggttaaactgcaagccgttttttatataaacaactaatttacaaaaacaaaaaacataccttagaactcaaatgtgtaaaaagtatttgacacttatacatatattatttaaaataaatatatataaatttgaaaatttaaaataaaaaacaaaataagttaaggagggttttagtggataacaatataaaaaaacttagaacagcagctgatatttcacaaaatgatctggctaagctctgcaatgtgaccaggcaaaccatcaatgcaattgaaaataataaatatgacccgactttaagtctggctttttcgatagctcacgctttaaatacgggaatagataaagtattcaactataacgccaaaaaaaattaagggagcggttcttatgaagaaaatggatgagatgcaaaaacaccaatcgggtacagccgccagaatagcatttagtttttatactgtcgctttactgatatggtcattaatagattattttaaaaacggaaatacaggatggcaatttccgattcttttaataggctgcgcgctctatttatggattcaagtttatcaaaatcgaaaaacaaggtaacgattccaatacacttccggaggattatacagcaatgtacgaatacaagttcataaaagcagaagtaaaccgatggaaaggaaagcctaaagaagactataaataaattattgaaaagtattcgcagcaagggtgaaagctggttcaaatatttgctcctgctatttcaggctatggggcagctgattattttgatattatttttgaaaaaaaagtataatgtttcagtaccaaagaaagccggatcatacatatggtccggctttctttgtacgaaataagccagcagatacttttacggatttcacctcttaactattattttttcggaaatccgcaattcaaatagattccaatatattttattatttaacttgctggggatattgaaaaaattggaggaaaaaatgaatctacttttaaaaacacaaaatagtaaagcgatttttacattagtagcatcaggaatcattgttctcgctcttttcagtatgaaacataatcatttaagcatggatgttatcgatattttaaacagagctggaattatcgctcctagttggattgtcagtgctatcaccgcaacgggatcagttctggctatcattactgttttaggatctcttggtgcaggcttgccattggccgttttagaacaattggctgcagcaagtacagcagcagcataatataaaacattaaattcaatatccctggcagtccctttaacgaatggatgaaaatacattgtttaaaaagaatgttttagtcaaattgtacatactctgtctgatcttatttttaattgctttatttacagcatatatttatacagattccgcttcaaatgtaaataatctaaatcgaaatatccgtccggatttttttcagattttctttaataatattaaagtagcgagtctgcttgtttttttaggcccgttaacgctgtcgcttggcacggttgctgttttaattattaatggattaattttaggaaatgcgataggaaacattaaagacaatttaaaccttttactgcttgttataccccatggaataattgaagtgccggtattgcttcttgcagcctctgtaggaatgaaattaactttagatttattactcctcaaaataaatttgaaattcacttttaaatatattggtattatatttctcggtttaatgatagcagctatgttagaaacatttattacacctatctttataaaaggagcctcttaggattatgcaaattgaattatcttcatttaaggaacgaaacattaattttttgtcctcgtttttgttttatattatcgggttagctttttatttaagttcccttttaccttttatgaaaagtttaattcccaaaaacatccctatacaagttgttgagcaagtaaaacatttagattacatcattgcaatagccgcactgtttcttttaatgttcggggtcatttttgaaggattcgtattatttctcattataaattttcttggcgctcagattaagatcaaaactttttattccctatttatgttttctaacatcccggtcgcgattaagttttttcttatatcattcaaaaatattttcgcacaacatccaaacactagtttatttttcacaagtaatcatttgattttttctatctttgatttgttcaatattgcatacttatttcttttgtttattcttctgaaatggagaacaaatttgaactacctgacaatctcagtttttatttttacggcattcctgtatagaatgtttttttagcatatataaataaaccccctcaataggggtttttctttcatttcgttcactgtatacaattccttttatatgcttccgaaacaataccgactctagtacttacattccactttttacaaagaccggctatgatatattcgacattacgctgcgagtagtttaatgacttagcgatctctttattaggcttttcagcaattatcagtttaattactgaaatttcaatcttttttaattccaattcattttctactgctgttttcattctaacttcctttctaaagatgtatttactaaataataccctattatataatttttatcaataacatcaattattaatagtaaaataatatatttcttttactaacttctaagtagtttatatacaatataaaaatcccccgccatgtttcaagcgggggaaattctttctatttcacaaacccaagcagcatttcacggatcatcttgcttgccgtgtttgcggtttgttctgagtggtcatagaccggtgccacttctacgaggtcggcgccttttacgctgacctctgagcgcgcgatttcatggatggacgcgagcaattctttagacgtgatgcctcccgcgtcaaccgtgcccgttcccggcgcatgagcggggtcaagaacgtcgatatcgatcgtgacataaaccgggcgtcccgcaagctgcggcagcacttttttcagcggctcaagcacttcaaacttagaaatgtgcatgccgttttctttcgcccattcaaattcttccttcattccggagcggatgccgaatgaaaatacgttttgcggcccgatgagctcggccgctttgcggatcggagtagagtgggaaagcggttcgccttcataatccgtgcgcaggtcggtgtgcgcgtcaaaatgaatgatggcaagatccggaaacttcttatacatggcttttatgacaggccatgatacaaggtgctcccctcccatgccgagcgggaacttgcctttttctaggatgccgtccacgtattcttcaatcatatcaaggcttctttgcggattgccgaacggaagcggaatgtctccggcgtcaaagaaattcaaatcagccaagtcacggtcgaggtacgggctgtattcttcaagaccgatagacacctcgcggattctccccgggccgaatcgtgaaccgggacggtagctgaccgtccaatccatcggcatgccgtaaaggatggcgtccgcctctttccagtcggggcggctcgcgataaatacttttcctgaatatgcttcatcaaatctcatcaataattccctcgctttcctgtaaaaaagcgcaagattcgctcctgcgccgtacgtttttatttgattaagtcgctcacaaatttcggaagaacaaatgccgctttgtgaagctctttcgtgtaatacttcgtgtcgatgtcgaagaaacggctgtcctctacttcaagcggatcgtactttttagaaccgatcgtaaatgtccacaggccgctcgggtacgtcgggatattagccgtatacagacgggtgatcgggaagatttctttcacgtcacgctgtacgtttgtaatcagttccggtgtaaaccacgggttgtccgtctgcgcgacgaagatgccgtcttcttttaacgccttggaaattccggcatagaagccttttgagaacagattgacggccggtccgaccggttctgttgaatcaaccatgatgacgtcatactcattttctgatttcgcgatgtgcatgaaaccgtcatcgactctcacgtcgacgcgcggatcatcaagcttgcccgcaatggacggaaggaattttttagagtattcaataaccttgccgtcaatgtcgacaagcgtcgctttttttacgcttgggtgcttcagaatctctctgatgacaccgccgtctccgccgccgacaacgagaacgttttccggattcgggtgcgtaaataacgggacgtgcgcaaccatttcatgatagacgaattcgtctttttcagatgtcatgaccattccgtctaagaacagcatgttgccgaattcttctgtctccaccatttccagatgctgaaattccgtctgttccgtatgtaatgtttgtttcacctttaatgtaatgccgaaattcttcgtctgcttctccgtataccaaagctcgctcaattgtcatctccctttcaaggcttatttcatttattgtaagcgtctgtatcgcttttattccggttaaaatctcattttcacctaaggaaaaagtatagaggatggaggggaaaaagtaaagaagtgtccggtttgatatgtttaaaaaacccccttttttcacataataatagaatcatgaaaaagggggttcccaaaagtggataaagtatctggaaaacagctcagaatcacgttcaaaatcatccgcgcctgcatctttctgacactgatcggcggaatgctggccggcgtctgcttcacatccgttcttcttgcagcgaaatggcagggcgccccctccgtccgggttcctcagtctacgattctttatgcaaatgacggctcaaagctaggtgagaccgatttcggggaaaagcgctactgggttcggttaaaagatatcaatccgacagcggtgcaggccgcgattgcggtggaggatcaaaacttttacaatcaccacggttttgattaccggcggatggccgccgccgcgctggctgacataaaggcaatggccaaggttcagggcgccagcaccatcacccagcaatacgcgagaaatctctaccttgagcatgataaaacatggaaacgaaaatggaacgaagcattttacacgatccgccttgaacagaactattccaaaaacgagattttagaaggttatgtaaatacgatatattacggccacggcgcatacggaattgaagccgcctcccgcctgtatttcggcaaacacgccaaagatctgaacgatgcggaagccgtgcttctggcgggcataccgaaaggcccgtccggctattcgccatatgtcagtgaaaagaaggccaaacagcgccaggaaaccattctccgtctgatggccggacaaaaaatgatctcaaaagaaaaggcggaaaggattaagaaaacgccgcttgcctatcagccgctgaaaagcagaaccgcggcgaaaacggcgccttatttttacgatgatgcgatgaaagaactcgagaaaaagctcggcatgacgcgcgaacagctcgcaacgagcggattgcgtgtttatacaacgcttgataagcgcatgcagcggatcgcggaaaacactgtggcacatacgatccgtaccggctctgacattcaggtcggcttttccgcgattgatccggcaacagggcgcgtgcttgcgcttctcggcggacgtgactacgaaaaaagcccgtttgaccgggcgacacaggcgaaacggcagccggcttccacgatcaagccgcttttgtattacaaagcgattcaaagcggctttacaccggtcacgctgatgaaaagcgaagccacagagttccagattgacgacaacggagatacctattctccaagcaattacaacggctactacgccaataaaccgattacgctgcttcaggcgcttgcgttatcagacaacatttatgccgtgaagacccatctctttctcggcatgaataagctcgtgtcggcggcaaaggaattcggcatcagcgaacatttaaagccccttccgtctctggcgctcggaactgaacccgtgcgcccgattgagatggttaatgcctatgcgatgctcgcaaacgggggaaaacaaatcaccccttcctttatcacaaaagtgacggataccgccggcaaggtcttgtatgaacagccgcgcggacatcagcagacgcttgataaaaaagccgcttttgtgacggcgagcatgatgacgggcatgtttgatgaggatttaaacggctatacttccgtcacgggacgcaccatttcagaccggctgacccggacgtacggcgggaaatcaggcacgaccagcgcagacagctggatgatcggctttaatcgggctcttgccgccggtgtgtggacaggctatgacaaaagcagcacgattgattcagtagaagaaaaaagctatgcgaagacgatttgggcggactttatggagaaggcgctcgaaggagaaccggaaatagcgcttaaaccgccgaagggcgtcacgggcgtctatattgaccccgcttccggctacacttcgggacccggatgcgccgcaaagcattacacgtatttcatcgcaggcactgagcccgcggatgtgtgctacggaccggaaccgtctaaaaaagaaaaggaacacgtccccgcccgtaaagaagctccgcgcaaaaagtggtgggataagtggctcggcaaaaaagactgagcccggtgcattgcgcgccgggcttaatccgcgtcttcctcaagcacccatgggagcaagagtgaaaagtcgagatggataatagggtcaggaaaacccttcggtataaaaaatgttgtactaggcaaagaaaacgaaaagcggatatctcccgctctctcaatgtgaaacttcggccagccttccctaagcatgccgacaatcggatagctgcccgcataatgatgcaggccgttttcctttccatgctcccccaaatcgtgacagacagccggacgaatcccaaactgcgtaaacaatcttgttttctcggcgggaaggagattcaccgcctcggaaaagttccggcagctcccgcaatcgcagggatcagcccatgatttttcatattgttttctcgtttccgccgtatctgcttcaatgatccaaggcccgatgtcaaagacggtgaacatgatgaaacctccgcgtaaacatgaaaaaccccgagtcttggttcggctcgggactttccatgtcctgattctgtatcaacagtttactcagtacaattgcgaaatagtgcaaatatttataaagttcacaaaaagttcacaaattatttttcgcccggaagcagacctgttttcaattcatcggatgaacgttcccagagcccttggtcatgcttctgcagaaattcagcaagcacctgctttgagctggcgtccattttgtccacgataatgcggcgcttcattgatttatccattaaattcacatgctccggcaatgacttatagcctctgcggatacttctgtccacggtcatttcacaagccgtcacacccgcgtaataagggccttctttttttctgtcgatggtgacccacacgagccagtacggttttccgttcggcacttcatctttgttcggcaggaatttgatgcctttttcaacgacactgcgggcatgcattgcgccgatgtctacgaaagcttccttctcttccacatcgacaaataccggagaaatattgtcaaggctcagcgacccggcgccaaaaccgccatgtccgtcggtcggatcacttttaataatattaaatccgattgttttcttctttttttcttccatgaaaataccctcctacaaaagcggttgaaatataatggcaaataccttgagaatccagtctctcccctcgcttaacagcggccacacgacataggagccgaccggtgtcacaaacagcacgagaaacacgataatcccgtagctctcaaactgagtcattttggcgcgcacccgcggcggcacgagatcctcaataatccggtagccgtcaagcggaggaagcggcagcaggttgaataaacacagcgcgagattcagctgaatccaaatagagaaaaagcggtcaagccccatgctgaatgcagaaagcagctccattccgtaagcatgcatcaacactagcaaaaagaaaccgataaaggcaagaagcaggttgcttacgggcccggcgacggaaactagcactcccgccagccgcggtcttttaaaggcgcggcggttcaccggcaccggacgggcccagccgaaacccgcgaccaaaattagaatcgttccgaaaacatcaagatgtttaatcggattgagcgttaatctgccctgtctcgccgcggtatcgtctccgaaccgatacgcgacatacgcgtgcgccagttcatgcatcgtaaatgccacgatcagcgtaatcacgacatagggcataagctccagcggataatataaaaatctgtccaaatgtcaaaatcccctttttttaaaaatgcaagattgtccttcattcagtatactataagtgatctctcttccaaagagaggaaacgataaaggaggatcagcaccatgccgctcgtaaccgttaaaatgcttgaaggccgcacagatgaacaaaaacggaatctggttgaaaaagtgaccgaagccgtaaaagaaacgactggcgcagccgaagaaaagatcattgtcatgattgaagaaatgagaaaggatcattacgccgtcgccggcaaacggatcagcgatacggagtaatccttgataatggccggcgctgctatgtcaggccggcttatttcacaaccttttcaaccaggctgaaaaagattttcttttcttcctctgtcaatgcttcgaacagttcgtcaatgagcagctgccggttttcaatcatttgcatggccgccatttttcccgattcggaaagcgtcatccataccgtgcggcggtcttcattgtttctcgacctttccacgaatccttctttttctaaatgattgagagcggttgtcgtggcggaaggcgataatgtgacctcctgcaatatatctttaatcgtgcacgtgccgtgccggtaaataatcctcagaataaatcctctgatattgtttatactctttggaattgtcgcctcatcaagctttttcgtgctctttaaatatttcgtgagcgcgtaatccagtacatttgcttgcaagttatcgtgcttcatgcagaaactccccatttcaagatgcatccatcatcatttgtttgttttttattacattttactgataccttacggagaaagtcaaaattccggccggaatgcccgcaacttttatcctgccctgcacagacttttgtctccctcttttttaccatatccttttatgcaatgctggttttatagacacgattcaggtaaaatcattaagggtgactgcgtttgacggtaaggataatctgatcggatgcggcagacaatatgattggaaaagaaaagaaacggaacagacggggaaacagaacacaggattgtcgattacacagaagatgtgacacgggtaaaagccaaagagtccctcttggcttttgcttttggatggagggatgcgtgttgcggaatatcctacaaaaaaaagacatcacccagctgcttgaacaaagcagaaaaaggcagactgccaaaacgatgggtggatttgatttaacattactgggcatcggcgccgtcatcgggacgggcgtcatggttcttacaggcattacagccgcgaaaaacgccgggccttccgtaatcttttcttttatcattgcagccgttgtctgcagccttgcagcattatgttacgccgaaatcgcttctgttctcccggtttacggaagcgcctatatttactcttataccaccatgggagaaattgtcggccatttaatgggctggacgctcttatccgtttatatggtgacggcgtcagcggtggcaagcggctggtcaagttattttaataatctgttagccgaaatcggcatgcctttgccggacagtctgctgcacgtgccgagccaggggggatcgtcaaccttcctgccatcatcattactctattaattgccgtcgttctgtcacgcggctctaaagagagcaaaacctttaataatataatggttctcgtaaaaatcggaattgttttgctgtttatcatcacaggaagcttttttgtaaagccgggcaattggcatccttttatgccttttggaattaaaggcgtcattacgggggcttctgccgtcttttttgcgtttctcgggtttgacgcgatttcggcttcggctgaagaagtcaaaaaaccgcagcgcaacctgccgatcggtattatcggttcactggtgatctgtacattggtatacgtcatcgtctgtctcgtcatgacgggtatggttccgtattcacagcttaatgtgccggaagccatgtcttatgtgctgcagactgtcggacaaaacgcggtggcgggcattatcgctgccggtgcggtgatcggactgatggccgtcgttcttgctcatacctatgcggcgacccgtatatcttttgcgatggcaagagacggaatgctgccgaaagtctttaccattgtcggaaagaaatcgggagcgccgatctttaatacgtggctgatcggactgatcagcgcatgcatcgcgggttttgttgatctgaaagagctgtcggatctctcaaacatcggcgcgctattgacatttgccatggtcagtctgtccgtactgattctgcgccgcacccataaggatctgccacggggatttaaagtgccttttgtacccgtactgccgattttggccattatctgctgtttgtttttaatggtcaatctgccgctgaaaacgtggctttattttgccgtctggctgatcatcggcgtcatcgtttactttttatattcgtacaagcacagcaaattgagacaataaacaaaaccaggcccgcttcatcgcggcctggttttttcataaaaaaagacgaaagcatcgcctttaacaaatgtgtttcagctcttctatgtagtgaagcgcctcatcatattcttcatccgtatatttctgtttgctttttatcgtaaacactttctctttcttttcctcagcttcaaggccgtcaaaatacaaaatcgtagacaccagctccagaaaccgggatgagcggctgttgacgctgtcgatgtacttcttcatatccggcatcttaagctccgcatgatgtaaaaactcggctcccgtctccgtcagcgagtaccggtattgaaagtagccgccctttttttccttcacctcatccagaaacccaagattgcacagctcttcaattcgaagcgtcagttcttcggaatacgggccgtaaaaatgaaaatcatatttttcgtagaaaggatactgcattttcttcgcgatataaatgattttctgcagctttttccgcccgatgatttctccagaatccgagaacaccttcatcagttttgcatgttctttcaacaaattcccgacatctccttttccttctttaccaaaatccttctatgtcagtcccagcagctgccggatttttaattttgcttcagggttttctgaatcgtcgcaaatgaggtccatcggatagtagagcttatggtccgtccggcgtttgcccgaaatggattcgacaatggcggactgcctggacagctctttgatctggccgttctgcgttaacagatgaatcggcagacgctcctcctcttcacccggccggtaaaaatcatacggcagatccgatgaagaatcgaccactaaatagtaattgggatcaattcccgcctctttaaagagagcggtcagttcaaaataagccgacatttcctcattcggattaaattcggcatattgaaacagctggcggttaatgaagcggcggcacaagtcggacagaatcgggtcctcttcttcctcccaagcctggaaataatataaaatgatggcttcatcaagcttcagataatccgcaagcgtcagcttcccttcaaaaatggaataaaaatgaacgggagcatgagtgaatatatacccttcttcatggagctgcttcgcacggtggagaattttcgtcaaaatgacttcagcgcttctcgtcacgggatgaaaatacacctgccagtacatttgatagcggctcataatatagtcttcgacggcgtgcatgccgctttgcttaatgacgatctggtcctctcgcggacgcatgacccttaaaatccgttccatatcaaaatgtccgtagctgacgcccgtatagtatgcgtcccgctgaaggtaatccatcctgtcggcgtcaatctggctcgaaatcaggctgaccacctgtttgtttttgtatgttttggcaatgacttcggcaacatcctgcggaaatcccggtcccgcctttctgagaacctgattcacctcggtgtcgccgagaatgatttccctcgtatagtcttcatgatccagatgaaaaaccttttcaaaggaatgcgaaaacggcccatgtcccaaatcgtgcaaaagcgcggcgctgagacagagttcgcgttcattgtcatcccattcaggacgccctttaaaaacatcatcaaccattcgtctgacaatctcatagacgccgagagaatggttaaaacggctgtgttccgcgccgtgaaacgtcaaatacgtcgtaccgagctgtttgatccggcgcagccgctgaaattcacgggtgccgatcaaatcccagatcagcttgtcccgcacatgaacatagcggtgaacgggatctttaaacactttttcttctgataattttccgtttggatacgccatcgtcattccctcttttttttagccgtgattctattatatcggctctgtaatttgaaaacatccttgaatttgtccggcgttttgttccagttttcaatcattgattttttgaagcaaaaaagcctgacccatcgggcgaggctgtcgtaaaaatgcacatttactttttgatcttctttttcactttctcaatcagctcgtcctcagtcggcgccgacagcgggcggttgtttacgaaagcaaacgatttcttgcgtccgggcccgcaatatgactgacatccgacctccacttttgcatccgggtcagcttctttcaaacgcggcagcaatgtcttaatattggtggcctggcaatcatcacacactcggaattcattagccatgatgtacgcttcccttcattcaatgttcctctatgttaaatcttaaattttaaaaacgaaaaaaatcacatcacgttttattgtacaaggattcatcttatcctgcaaggctctgcgtatctctcattctttcagccaatttgtataaatattttccaatctggacattctaataccatcaaagattattgggggttgagaacattgacaaagcaaagacaggacgcctggtcggaggaaaatgacctgctgcttgcggaaaccgtgctccggcacgtccgggaaggaagcacgcagctgaacgcctttgaagaggtaggcgataaattaaacagaacgtcggcagcgtgcggattcagatggaatgccgtcgtgcgccatcaatatgaaaaagcgcttcagcttgcaaaaaaacagcggaaacagcggatgcgcgcgctcggaaacggccagccggccaagaagaaactattataccagccgcctgcaccggatgcggacatcattcaagaaaccgcagccgaagagacggttcaaacggaagcgccaaaagaggatcggcaagccgtcatgtccggcgaacatatgccttatgtcgatgaaagcttcaaggaagagttagctagtttatcacatttgctggcgcctcagcagccgagccaaaaggcggagctcacaatggcagacgtcattcaatttctgcagagctatgaaggcagcggaaagcaaacttccgccctgcagatggaaaatgaccgtttaaaacgggaaaaccaagaacttcagtctaaaaccgagcagctggaagcggccgtcgaaaaacttgaaaaagatcaaaaaaccattcaggaagactacgaaaccttggtgaaaattatgaacagagccagaaaactagttttatttgaagacgacgagcatgcgtctccgtcctttaaaatggaccggaacggcaatttagaaaaaatggccgaataacgcaaaaaaccccttttcttgtcatggaaaaaggggtttttgccatttgtcaatgacgcgcatcctgatctatattaatgtaaacattgttcaggaggccttcttcccgcaagggctgcgcatctcggtccccgcccgcacataagcataaagattcaattcctcatcccaaatggttcttgggaattattgatcgattagctactgtgcaatacactgtatagagaatacaattattagatatgatgggaatgatagtaaatgagtagccaattacgaaaaggagcattggaactttgtgtgttgtccctgcttctttatgaagatttatatggttatgaattaatcaaggtcataagtgaaacgttccctgtatcggagggcaccatctaccccatattacgaagacttacgaaaaataactatttaaaaacgtatacagcagcttcagatcaaggcccgtcacgcaaatattacaaagtaacagaagaaggcgccttttatcatcacacattaaaatcggaatggcttgacctgtccgaaaaagtgaacagcatcattaaggagggaaaatgaatgtgtaaagaccaatatttaaaacatctccggcgggaaataaaagatctgccggaatttgagcaaaaagagatactcgccgatatcggcgaaatattccaaatgggcgtcgctgaaggaaaaagcgatgaacaaatcgccggcaatttaggaaaccccaaaacacttgcgcgcgccttaaaagcggatattttcatcagtgatgccgaggagcagaaaacatggcgctcctttttcaaagcattcggcctgatgctgggtatgggcatgttcaacttcatgtttatgctgacaccgtttctttttgcctctgttgcggtgttaagtttgatggcaatcggcctgatgctgatgaccggatcattctttctcctcataaaagtgccgattgtaacagccatttttaacggatgtatggtcctcggagcgggtatggcggtgtttatggccggatttgatctttcgaaactgatattccgcatctttttgcgctatttcaaatggaatgtcagcattgtaaggagggaaaccattgaatcgaaaaatgtggtatagcattgctctcattttaatcgctgccggcctgatcggaagcatgttcttcggttttgacggcttttaccctaaatcataaggaaggtgtgcaagtagcatgagtgaaccagccctgatattaaaagatgtctctaaaaccatcaatcatacccctattgtacagtcaatttctttcgatgtgagaaaaggcgagatattcggccttttagggccgaacggctcaggtaaaaccactattttcagaatgatcgtacagcttattaaaaaaacagaaggagccatttcattcagaggcagaccggacagcgactttgaatattttatgagacatatcggggttatcattgaaggcccggatatgtatccgaatatgaccgctttgcaaaacctaaaatattttactaaactgcgcagcacctcgctgcgaacggatgaccttatgaatacccttgcaaaagtcggactggagcaggctgcccgcaaaaaagtgaaacatttctcattaggcatgaaacagcgcttggggctcgcttattctcttcttcacaatcccgggttattaattctggatgaaccgatgaacggtctcgatcctaaaggtatgaaagaattgcgcatcattctttccgatttagcgaagcaaggggtttccattttattatcaagccatttattgtcagaaatggaggagatttgcgacagggttgcctacattaaaaagggacggattttaggaattgaagacatgaagagcagaaatgaccttggtcagaaaaagctgtttaccgtcacggtcgatcatccggcaagggcgaaagaaatattagagcaggacggtattcttcaagtacagcaaaaagacagccgcatcattgaattggaagcggaggaagataccatcccgtatatcattaaaactttggcagagaaagagattctgatttcccgcgtttctgcaaggactttgtcattggaagagaaatacatgatgattacagatcaggaggacgcggtatgagcatatttcatctgacgcagaacgaattcataaaaataacccgaaaaaaaggcacacttttatctctttttttcctgtttctcatcgttttgctggccggccttattatgaatcatgagttagatgcttcctcggataacaattggaaagaacggcttctcgccgaaaaaaaacaggaagaaattaataaaccggctgaaacggcaggcgtttattattctgctgatgttaagaataaagactattatttggagcataacatcaacccttatgaatggaacggctggaggtttttcggcacggttacttcaaacgggcttgagattttcgtaagcttgactgcgattttaaccgtcagcggggttgtttctaaagagtttgcccttgggacgattaagtttatcgctacaagcccgaaccgaagatggcggattttaacatcgaaatttctggcctctcttctgtttaccggcatggtttacttattttactgtgtgagctgtttgctgatcggcggcgtgttattcggtttttccaatgcttcatatccgctcgtctatactcatttaaatgacagtctgtataccatcagttcaatcaaagcatccggaatcattctgcttttgcgtttcatatcaattataagtattgtcaccattgcgttcactttgtcagtattgtgcaaaagccaggcgctctccctttgcttatccattttactgctgtttgccggcagtatattgggcggaactgatttgcttgcccaatttacatggtataaatttacactctttccgcatttaaacctcgttgcttatgtaaataaaagtgcgggtgatgcgatttcaacgttaaacatcccctattccgtgacggttatagcgatctactttcttatttgtttattgatttctttttccgtctttcaaaagagagacattacagcatagacagagaggcggcggcataatgagcggacggcaggaaatattgacggtccagcaatttgccgctgaccgccccttggtccatcgctaatggatttaaataaccgaagcttccgctgcttcgctgctgaaagcgtagaaattcccgcccttcccgtataaaaagcgcctcatcgaatcggagaaatttcataatggctgtgtattttgcaacggcgtcaatgtgatactttctgcactcggctaacattaaacctgaaaaagcaaagtctgatgttttgtaccattccgtgagaaaaggctgcaattttttcatttgcaaataagagacggcataaagggcatctgcctgctcttcctggatgctgcccggtgccatgagcaaatcggcctcacgtttcattgcggtttctaagaaaacgatcagttcttccggggtcaccgccccaaaataagctgctaacaccatgaggatcatagaggaaggctctgatttcagttcctcttgtaaaccgcggaccatttgttcaagtccgttatgaaaaaagatgctttttgcggcattcatcctgcggtatatatgatacgcatacgcgaacaggaccggatggcattcgtgcgttttttctccaaaataacggtctaagaatagaatgacttcttctgtatcctttcttttttcaaagtgatgacatgccgctaaaccgcaaaacaggtgcatgagatcatctgcttccatttcttccggctgcagctgaatgttcttccaaaaacccagcagccattcttctgttttttttatattaaaatgttccttgactatccgcatgttccacactccagattcagaatctcaatcgccggcagaagagccggagcacaatgaatggatggattctcgttatttatatgatgaagagccgcttgacagccataaaaaaatggatcgatacacgattggataaataacatattgcacagctgtttcatttttcggctgccgagacaaaacacaagccatttttgaatggacgccttcaagccgggatgaagcagatgctctccctgatctaaatgaagaagacagtactcgacaaactccagctcgttttcagctgttcttttccatgcgtcatggagcaaaggctgaaatatcgaattcttgtaaaagcgcactttttcatggtcagttgacattcccagctcgttcagcaaaccggcgaattcggcgtatttaaaataaggccattctttttttataagatagccgttttgcaatccgtgacgtatgacttgatcatccgaatccattccctgcttctttttataagcttttgccgttaaatagatatgaatcaactcattgacaatggccgtgttacagtgaaacagatcttcccagcatgacttatcaacgaaagcggaggcaatcctttcagtatgttcttttacagcggaagaatggctcgtctttctgtagtatttgcagaagccggcaaacagctgaatgctcttttgatccggaagcgattgttcagcaaaagataataaaaattgatccgtctcttcagctaatctgttcaagttaatcgttcctttctgctctaaggcaggcatgcgcggcacccgcggcgacaagtgttgtatgatagcaatgtttaaacacatcttctcttcgctgttcacctttcaaaccgggtttatgttgataggtgatgctcgggacattcccctctttcatttggccccgatagattttattccaggctgcttcatagagcggtttatggttgtccttatccatgtcgatatgtaaaaaagagctgcacatcaataattcactggtaatatctaaattctcaagacagatatagatcccgagaaatttcaggaccttttcttttaaggacgacagatgatactctttatccgtaagagaagaacatcccatgtctgttatataaaaaatcgtatgagtgatactgtatgcatcatgatccgtcatatatgtatttgggatatcctgaccagctgctgtgtagtgatataagtcagaaaaatccgttatttccgaggttacgcctgctctttgcagactgtacttcagatccatttttcgaaagggaattttagcaaggctgcaatcaaaacgcgctgccgtgaatttttccagctcccatatcactgaagcttgtgacggatgatcagtcaaggtaagaaattcacccgcaatagccaatccggcgagaccgtccggatcaaaatgaataaattcttcaagctgatcattacggagcctttctgtaataaactccgttaaaacagcaacttccttatcatctgcctgatttctgatcaggtaattggtaagaaaaatgagttctataaatgttttaaggcgccatctgaaatcattcgctactttatgtttcatatcaaaataatggatattttcaacaatccatgacagtgctccccgcttaatttctcttatatactcttgtgtcacactctcaccgcctcgtctcgaatgcgtaggctccaaacagtcattatcttacttttgagcggctaaatcagagaaattcaaattcgggttttgattgtcttcttggctcggcactacaagcacccagccgctccaagcgaaagaattgcctgattgttccgcatctccggctaacaaatgtgtagggatcgtgattcttttttcttcttttatttttttaaagttcatatctccatctccttcagtttatagaattatttggaacctacataaatatattaatcaaataaggtatataatgtaaactagttttgatataacgattctttttcactataactgaatagtatataattaccaaaaataaaaaagcccggactcagtccaagctttcctgcgtgccgaacaccttctcattccgttccagcattcggatcagatttttttcaaataccatttcctcttccggcgataatccggctgcatacaggcgtccgctgagttccttcagttcagtcaaaagcgccagcattaagtcctgcacggtaatgtccgtttgcagcaattcgcttaatgaagccatcgtttcgggccggatatcgggatatacgccttttgtatcgttgcttttgtcttttaaagcggcttgatagaaacgtctgatcagatcggcgcgttcgcttccgcttttatcggcacagaggtaaatctgaaccgcggttccgccccgcaggcgtctttgtgagattcccgcgaattttcggccgccgatgctgagatcatagctgcccggacagtacgatcctttaatttcatatgcttcaatttcggcattgtacggacacagcatccgccgcaccagctctgtcatcgcctcgtagcctctgtcaatgtcgatgccttttttctcatcttcaaaaataagagaaatattcaatacgccttcatcgagaacgaccgcgaggcccccggaattgcggacaatgacacggtagccttcgccctccagcaatttcacgccgtcctctaaaaacggcaggcgtgtgtcctgaatgccgagcacgatcgtccggtggtgcacccaagtgcgtgccgtcgcaggcgattcccctttgcctacggaggcgcacagcgtatcatccattgcgaatgactgcttcgcatcaaaataagggccaaggctggattggtcaatgattctccagctcggctgcatcagtaaatcaatcggttgctttcccatctatattaaatccctttcgtcataagctttccatgcgtttattatatcactccgcttgagatgattgaaattggcttttcaaaagagcgatgaagatttctttgttttttgtgttctccataatggaagattggatgatagacagtttccgttttaaggagaatccttttatctcaagcacggaaatgctgccgtgaagcagatccttttgcagcacgctttttgacagaacggaaagacccattccgctgatcacggcttccttgacaccctggttgctgctgatcgtcatcatggatttcggccgcagtccgtttgattgaaggacgtggtctaaatattccctcgttcccgaacccttctcccttgtcacccacgcttgattttgcaattcggcagccgggatgttttttctgccggcgagcgggtgtccgttcggtgcggcaatgcacaattcatcctccataaacggctgaatgtcgagctcgtttttccccgtatgcccttcaattaatccgatatcggcttgaagcatccgaaccgcttcgctgacctcctccgtgtttccgatcatgacgtccaggttcagctcgggatactcgtcatgaagctttgcgagaagcggcggcagaatatattcgccgatggtaaagctcgcggcgattttgagcttccctttgacataatgatggtgggcgtaaatttcagatttcgcctgttcgtacaaaaagaccatctgcttggcgcgctgatagagaatgtccccgtcggcgtcgtcgtaaagtgcttcggagagcggttcagcaaagcggtttgaaattctttctccaggtttttaatgtgaaggctgacgcttggctgagaaatcatcagcttctgcgccgcctttgtaaagtttttttcttccacgacggcaatgaatgttttcagttccccgtaatacaaaaagcatcgcccctaatcattatttttcctaatcgtttagatcatataaatatattttactaatgattaagaccgcagtaaagtggagttatcaagataatgggaagtgactgagatgaagatgataaagggtatttcagttaccgcaggaattgcgtttgcggctttctatgtcagccgcctgccgtttttgcatatgctcggaatgcttgtccttgccatgctgatcggcatgctctggcgcgccgtattcggacagcgggcggcattagagccggggatcgcgttctcaagcaaatacttgctgaaagcaggcatcatcctgcttggcatgagactgaatctggcggatatctatcatgcgggctggcacgtatttgcaattgccgtctgctgtatgatgtttgcgggtgccgttgtatacggactgtcccggctgttccgtatagatcagacactcagcacgctgacagcctgcggcacagcgatctgcggggcggctgccattgccgcgatcgcgccgcagatcagatcaaatgaaaatgcagccgccatcagcgcggccgccgtttcgttattaggaaccgtttttactgttgtatattctcttgcttatcatggattggggttttctcctgcggcttacggggccttttgcggggcaacgcttcacgaagtggcgcatgcggcggcggccggcagcgccggaggaaaagcagccgtcgagatggcggtgatcgtcaaactgacccgggtcgcgctgctcgtcccggccgcattcatgctcggaatgcgggcgcgccgcagcggaaagtcaaagacggcttctgccgcttcgctccccatcccttggtttatcttcggatttctcggaatgagcgccatccatacatcaggcgttatttcagcttcgttttccgcgtttcttgttcaagtgtcttatgttttaatcggcatggcgatggcgggtctcggtttgaaagtccatatatcggcgtttcgtcatagcggctggcgggcgctcgcagcaggcttgatcggttctctctgtttgtccctgttcggctgggccgcagtgacattctttctataaaaaaagccggtcctcgtaaagaccggcttttgcggattacagcgcttgagcagccgtaattaacgcaagattgtagacgtcttccgcattacatcctctggaaagatcgtttacaggcatattcaatccttgcagaatcggtccgaccgcttcaaagccgcctaagcgctgagcgattttgtagccgatgtttcctgcttcaaggcttgggaatacaaatacattcgcgtctcctttaatgtcggagtccggcgcttttttctccgcgacagacggcacaaatgcagcgtcgaattggaattcgccgtcaagcgtaagctcaggcgctttttccttcgcaattttcacggcttcagccactttgtccgtctcgtctgatttcgccgatccttttgtagagaagctgagcatggcaacgcgcgggtcaatgtcaaacatttgagccgtattggcgctttcaatggcgatttcggcaaggtcctggctgtcaggagcaatgttgatcgcgcaatcagcgaacacatactgctcgtcaccgcgggccatgatgaagacgcctgatgtttttttcacgccttcttttgttttgatgatttgcagtgcagggcgcaccgtatcggctgtagaatgtgcggctccgctgacaagtccgtccgcgagacctttgtacacaagcatcgtgccgaaatagttttcgtccagcaaagctttgcgggcctgttcttccgtcgctttgcctttgcggcgttctacgaaagcctgaacgagttcttccatgccttcatatgtatgcgggtcaaaaatgtccacgccgtcaagcgtaagatttaattctttcgcttttgcttgaatgtcttctttattgccgactacgatcggctttaataccttgttgcccgccaagttgttgaccgcaaccaggatacgttcgtccaacccttcaggaaatacgattttcacatcttttcctgcgactttttcttgtacttttgtaaataaatctgccacgatattccctcctctatgttgacaaaaaacgcttacttttacagcatactcttcttccagctaaattcaaataaccaacttctattatagcgctttcaaaaagaaatcttatttttctaactaatttaattgacggtttgtttcacggcttagtttctgacacaaggcttcggattattcaaggtttctccacagccgaaacggttaaactgtgatatagtgaaggcatcaatgtaatgaaaagatataggagtgaagatacatgagtgagcagcaaaaaacgaacgaagccgcccaaacacttgacggctggtacgcgcttcacgatttccgcacaatggactggacgtcatggaagatgttatccagcgatgagcgcctgtcgattattcacgaatttacgggactgcttgaaaaatggggcgtcgcccaaaaagaaggcaaaggctcgcaaaccatctacagcatcgtcggacagaaagctgatttcatgctgatgattcttcgcccgacaatggaagagctgaacgaaatcgagcttgaatttaacaaatcaaagcttgctgaatttacgatcccggcttactcttacgtgtccgtggttgagctgagcaactacctcgcaagcggagaaggcgatccgtatgaaaacccgcatgtccgcgcacgcctgtatcctgagctgccggaagcgaaatacgtctgcttctatccgatggataaaagaagaagcggcaacgacaactggtacatgctttctatggatgaacgcagaaacctgatgagaagccacggcttgatcggacggagctatgccggcaaagtcaaacagattatcacggggtctgtcggttttgacgattacgaatggggcgtcacgctcttcagcgatgatgtgcttcagttcaaaaaacttgtttatgaaatgcgctttgatgaagtcagcgcgcgctacggagaattcggttcattttttgtcggaaaccgcttgtctcttgacacgcttccgaagtttttgcacgtgtaacacccacccgcctgtccggcgggttttttctttgtcagaatttaaataaaatttgctatttttatcatttttttttacgatgtaaaggagattccattttggtaaaggggtgcagacagttgtcaaaacgaaccgcatttattatgggagccagccaggggatcggcaaagcgatcgctctgaaactggcggacaatggctttcataccgtcattaattcacgagttcccgaaaatatcgaatcggtaaaagaagagatcctcgccaaacatccggatgcgggcgtcaccgttctggccggcgatatgtcggaccagaaggcgagagccggcatttttgaagagatcagatcacaatgcggacggcttgatgtattgatcaacaacattccgggcggctcgccggatacctttgaaagctgcgatatagaggatatgacaaatacctttacgaataaaacgatcgcctatatcgactctatgaaaacggccgcagcgatcatgaaacagcacgaattcggcagaatcattaatatcgtcggaaacctatggaaagaacccggcgccaatatgtttaccaacagcatgatgaacgccgctttaattaatgccagcaaaaacatcgccattcagcttgcgccttttcacattactgtcaactgtctgaatcccggatttatcgccacagaccgttatcaccaattcgtaaagaatgtcatgaagcaaaacggcatttctaaagcggaagcggaggaacggattgcctcaggcgtcccgatgaagcgtgtcggaactgcggaagaaaccgcggcgctggctgcctttcttgcctctgaagaagcctcctatattaccggacagcaagtgtcagccgacggcggcagcatgaaaagcatataataaaaacatcccgctctcagcgggatgtttcttgtaatgaaggaaaggacaaacctagcttttgaatccgcagcacgaattcccttaaatcgccctgttttgccaccattgatattctgacataacgctttccgccgctgccgaaaatctcgccgggcgtcacgacaacatgggcatgctccagcagatagtccgaaaactggtgtgaagactcgaattcattcggaatttcagcccagacataaaaagtccctttcggtttttcaatgctccagcctaattccttttcacataacgccgtgaaaaaatcaatccgttctttatatgtgcgcttcagacgctccgtatgctcaggatttcctgacagcgccgccgctgccgcctgctgaaggccgccgaacatgccgacgaagacgtgatcctgaaactcattgaccgcctgaatgattttctcattccccacggcaaatgccattctccagcctgccatattgaaggttttcgaaaatgaataaagctccgcgccgaccgttttcgcttctttcgcctgaagaaagctggccgggttctgatcaaattcgaacgcgccgtatgcaaaatcgtgaataagatggatgtcatatttttttgcaaacgcagccgctttttcataaaacgcctgatccgcagtcgcgcccgtcgggttattcgggtaattcaaaaacatcagcttggcttttttcaggacggcgggatcaatccgctcaaaatccggcagatagccgttttccggatgaagcggcatctcatgcagctccgctctggccattgtgattcccgataaatactcagggtagccggggttcgggactaaggcgatatcgccggggttcagcaggcattgcgtcaaaacgtacaaacctgctttccctccgccgaacagcgcgacttctgtctccggattgaccgataccccgtactctctctcataaaattccgcgatggcttctttcagaaacggatagcctctgaaagggccgtatccgtgatatgaaggattcagcgcagcttcccgcaatgcttcaacgatatgcggcggagtggggagatcgggattcccctggccgagattaataatctgggctcccgttttctccatctcttttaccttttgaaaaacgagcgaaaattcctgtttcggaagtgtcttgatgacatcggacggtatgatttccatctggaaggctccttataaatggatttgctctgattcgttattccgttctgaaaaggatttattgaccagttttgtatgcagaaacagcccgctgaccaaaaggacgataaacgccatgatgactgccgcgtctacaatgttgatcagcatggaaccggcggcgatgcacaatccgatggacgcctccgccaccgaaaagatccggccctgaatctggttcgcagcgttctcctgaactttgacctttgccagcacttcaccgtattccattgcgataaagaaaagaatggcggcaatgactgacacggcgaaaatcggggtaaacaaaaacagcgcaagcgagacgatcgataacactgtaaaatacatcagccctttattgttgttaaagccccatttgctgacaagagcggcgccgataaagccgccgaagccgatacagaacgtcaggatgaaattgccgatttccccgtcgcctaaaaagcggctgacaatcgggaaatagctgtagacgacaccccacaaaagcgccatcgtaatcatcgtgaacatggcgtttaacacaaaagcatttgttttgatttccttcaggccttctttaaacgactgaaaagcttctcttacgttttctgactgaatcggcacgtattgaagcttaatgcggctgatgaaaaacgcggagacaagataggtcaccccgttaaacgcgacggcaagctccacagaaccgcctaacagaaaaagtccgccggctgcagcgccgacaataatcgaaatcgtcgtggcttttgcaaacaaagtgttgatatttttaatatccgcttctaaagacgacatgaccgcgagacgtgccgggttaaaaaacacgccgcttccgtacgagacaaacagcagcgccagaaaaagcagcggatattcgcctttcgggagaaatgtcagccccaaaaagatgacacctctgatcacatccgtccacagcatgattttcaccctgtcgagcctgtccacgagcacgcctaaaaacggctgaaacaccatcggaatgctgcggaccgcgataacgccggacgtcacccagtagtcatgatagtatgtagacaaaatgagcagggccgggagaacgcaatagtctcccataaacgaaagcgcctgcccgaaaagcaaatacttcgagttcggtttcagctgtttcataccggtaacgcatactttgcagtcagcttcgcctgctgctgaatttgtttgattgattcggccacgtcacccgaattgcttcctttcagctcaaacgccgcaatgctgttgaacgcttcgaacagccgcagatccacggatgtacccgcctcggcagccgagaaagaaacgagttcggtgtctccctttaagacgccgtcgggaatgtcaatgctttcaatgacgaaatcgacagctgtctcaggcagctggccgttctctttgaaatgctgaggatacaagtggcagtcggcgacataacatggctcctgctccaataatcctttcggcagatcggcttcttttccgaaacagagaacatccaataacagctgcgccatgtcgacgccgaagacctttttaatattcggaatcatgttccagcccgcaaatcgcgccgctgattcaatcagtccggcttcccggtttttcattaatttaatttctgtatgtgtcgcgcagttttcgaggccgagtccttcattcgcctttttggcagcttcgacaattttccgctttgcgtcatcatccaggatggacggcgtaatatgcgatgtctccgtgaatccgatttgcggtgttttatcatgaatcgccacagggaagtattccccgtcggccatgatgccttctatgctgatatagtcggaataaccgcttgtttcgtaccagtcgtcatactcgccctgcaaaaattcttccgcgataaaaggcgcttcaaacgtgaccgctttcggtacgttaatcgacttcaggtattcattgactttgttaaattctgcttctgccgtttccctctctttgatgagcgtcacgccgatggagctcgccagatatgtaggcttcagaataagcggcgttccgatttcctgaagcgcggcgcggaaatcttccagcgtcgtcacccgtttatttttgatagacttgacgccggcccggttgaaggcggctctcattttgtttttatctctggcattttcagcggcctgtacgcccgctccccgcaggccgagacgttcacacgcttttgccatcggagcgataaacagttcattgttggtcgtaatggcgtcaaccgcgaacatgtcagccaccttgacgatttcttcgacgacttcttcctcaggtttgtcatgatcttcatgagcccagtaaatcgaatcgggatgctcaaaatcagccagactcttaaaatagtctttatctttaatgaccgcaatcgagtatttttcaattaatgccgcatgagaggctgtaattgcaaaaggtctcggaataaagctgacgaggttgtatttttcggctgcgcttttgtaaaacatatgcggcgggcatcccccaaggtcagcgataaccaatactgtttttctctccatatgtaaacactccttctctattgtgcggtgtatccaccgtctgcggtgatcgcgcttccggtcatatagcttgataaatccgaagcgagaaacagcatgacgttcgctatttcttcaggcttgccgagtctcagcagcggattgactttcgctttttcttttttgatttcttcaagcgtgccttcgttgttttcaaggaacgacttttcattcaaaggtgtgtcaatgattcccgggcacacgcaattgacgcggatgttgtgtttggcgtaatcgacggccatcgaacgcgtcagctgcagtacgccgcctttagaggcgttatatgcgggaatgtcgggccatgcgacgactcctccgacggagcacgtgttaatgatattgcccttgccgcttttgagcatatacttgagcgcgtgcttgctcataagaaacatgcccgtcagattgacgttgagcactttgtcccaatcgctcagctccatctcatgaatcggggcgacaatttcgatgccggcgttattgattaacacatccaatccgccgaacttgtcaaccgctgaccggatggcgttttgacatgccggttcatctgtaatatccgtctgcacaaaatgcagcctgtcattgttttctttccggatcatcgcttctccctgcgcctcatcaatatccgcgacgaccacattcgcctcttgattcagaaacgcctgaaccgcggcataaccgatgcctgatgcgccccctgtgatgaggaccgttttatccgtcaggttcatgactctttcgcctctaattttttcgcttttgctctgttatagcgcggagggaaaaagatattgactgattttgaatctttttcaaatctgttgatggcgccgtgatcttctctcggatcgcagaaataagctgtaccgaatgtcatatccactttgcagccttcaatggtcatatcatagccaccgccgatgcagatgccgatctgttcattgcggtgtttatggaacggcatttctcctccgttgcccggaatgttggcaagcatgatttccacccagtcttccacgaagaacgtgacttccatcccaggcaataagtctctcgttttaaaaatattcaaaaaataatcctcagggcttgtataggtttcaccggctttcaggcgtttaatatcaatggcgatcacttctagatccgtctcatttcttgcgccgtgaggcacgttaggaggcgcgatataggctgattccagcgctgtcatctttcttgtgacatctccgacagtcatggacagctcgccggaaacgacaaggccgatttggacttccttatgctgatgcggttccacgtttgtatgcggcggaacgtaagaaagcagaacttccgtatcgcctctgacggacgaatattgtcttactccgttatcccattctattaatttaggcgtcgggaaataaagttcctgcaaatcttgttcagttttcatcatgaatctctccttttccgaataatgaccagctcatgggaatgcttttaaatgttttgacaaagtgaaggccgtacttttgtctggccagctcatttgtcagcgcgatgtcggacaaaccgtccttcactcttttcgcggctgcgctcgttgagttcaccagatcaaacgtgacatctttacgggtaaaatacttaatcaaattgataggagacgggtgggatacgatgacagtcttatcaagcatgtcatccgtatattcaaaaccgggccggacagccaggccgtacatcggggtgtcgcacctgaaaatttgcagaagctgcagatccggtctcatgtagaagtgcttaatgccgtcatacgcgtgaggcacaattgtgtattccagcggactttgaagcgttttttcaatgcacgattcaaatgtatcatgcaatgataatttgctgttcaccccttggagaagggtgaaattggtgatgaagttttttgctgcgtactcactgcttgtcccttcaggaccgagcgtgttgatcgtaatcagtttagatattgaataagccttgctttttgtttgaatgctattatccaatataatcatgagcaccaaccaatctgttaaattttaagtaaatattatccatagacgttcaagctgtcaatattatttgaaaatattgataattattcctatatattagaaaacaccttataatataaggtgttaaaaatttacatttacaaaattatagaaactttattttaccgatacaatgattggtcggtcttatgctcatattttccataccttctgtatgcgaaaacgctgaggacaaagccgatgagggtgacggccgcacagataaatccgacagctgcatatccatatccgacatagaccggacccatgacagcagaacccaaggtgacggccaaattggacgccagactgtaaaatgccatgattttgccccggcggctctgtgagcaatcacttaaaatagtgctgagcaaggtcaccgtcaggctttgcatcaatccccagacgaataacccgatgaccaaaaacggcattgatgacggcgcataggcgagacaggaaagccatatgctgatcacggccaatgccgcgatcaaagagcgcattttccccgccttatctgcgatttttccggtgaacacgctcatggaaaaaccgattccgtacaccatgatcagcagccctgaagctgtattcccacccggcagcacgcggtgaagatatgtgccgagaaaggaatacatgccgtaaaaaccgatcatgttgcaaaaagtgatcgtgagatatacagggacacggggcaccttcagcgcatcccggaaagtgcctgcctgccgtccgttttcctcttctgttttattcccatccgccgtgctgcggcgcgcctcaatgaaaatgagcgaagcaacgaggacagacatgagggcgaaaatccaaaacgtccaccgccaattcaaaacgccgccgataaaagagccgatcggaacgccgaaaatcaaagcgagcgaccagcttgacacgatcagacccatcaccttgccgcggtacgcataaggcacacggtcgccgaccaccgcatatgctgtcggcacaaacgcacccgccgcaagcccggaaagcgccctgcccagaaagaagaaaaagagattgtgcgccagcgcgcagatcaccgtgccggccgtaaatataagcagtcccgccagcagactgagttcccgggaatatttatctcccagcggaacgagaagcggcgccccgataaaaatcatcactccgtaaatactgatggaaagcgccagcacactgacatccgagctgaaagcccgcgctaaatccggaagcagcggagaaatcaccagctcttcagaacccgcggcaaatacgcctaatgtcaaagcaagcgcgagacagaccggaaatcggcgtttcgtttcgatgtgatcggtttgtttgctgttcatgctctttgaacacctcttccgtaaaacttttctatcttttgttgttttatagtttagcatccttatatttcattttacatttcacatgaaaactaattctgattttttatttacattcagatttttaaataaaatatttagtttatattcaataaatgatataaaatacgccgtctggttatgctatagtgatagaatcatttgttaaggtgggggtcatgaaatgaataacgctgattcaaaggccgcccgcgcaggcctcggcatggtactgattctcgggacgctcgcttcattcgggccgctttcgctcgatatgtatctgcccgctttgcctgaagtggcggccgatcttcatacgacagcgtcacttgcgcagctgagcctgacgttttgtcttttgggtctggctgtcgggcagatcgttgtcgggccgctcagtgatatgatcgggcgccggaagccgctgattctgtcattgctgctttatacgctgtcttctttattatgcgccttcagcccttctgtttcgtttttaattgtcatgaggtttattcaaggtttcaccggggcggccggaatcgtcatcgcacgggcttccgcacgcgatatgtattccggaaaagaattgacggcttttttctcattactgatgctcgtcaatggggcggcgccgattttagcgccgattacagggggatttatccttcagttcgccggctggaaaatcgtatttatcgtgctggcggtaatcggctgtatcatttctgccgccgtgcttacggtgttgcctgaatcactcccgccggaaaagcggacaagcggcggactccgggagacgctgatgacgtttcgcggcctgcttggcgaccggatgtttatgggatttgcgctcagccaggcatttgtgatgaccggcatgttcgcatatattgccgggtcgccgtttatactgcaaaacatctacggcgtatcggcccaaatgttcagcctgctgttcgccgtaaacggtgcgggaatcatatgcgccacccaaatcaccggacggatggccaaaacacatgatgaacggaagctgtttgtctccggtctgatgattgccgtcatcgggagcatcgctttgcttttatcacttgcgtttggtttaggcctggcggcagtctgcatttctttattcatcattgtttcttctgtcgggatcgtcacgacgacgggattttctttggctatgcagaaacaggagaaaggcgcgggaagcgctgcggctcttctcggactcctgccctttatcggcggtgcggctgccgctccccttgtcggtattgccggagaagaaaatgcctggccgatggccgtcagcattttcggttttcagttctgtgccgttctatcctatgttctgtcggccaaacgaaacacaaagtaaagcccgccgctttaagcgaagggctttttttcttatccggcagcgcctttttccgaagaagccggctcacgcttcaggcgttttttgataccgaagtgataatacgcgtaacagatgatcatcagcgggacaccgcagtacagaccgatacgctggtcggggataaagatgagactgattaagataagaccgtaaaccgaaaatccgagaatcggcacgatcggataaagaggcgttttaaatgccaggtccttcagatttcctccttcagcgagaaagcgtctccggaaaacgaattgtgaagcgcagattgacatccacgcgacgacggtaatcataccggagatggaaatgagccacacatacaccgtttcagccgcgactacacttgtcagcagggataaaccggagatggcgatggtgatgaaaagagctttcagaggcacgccttttttcgtcagtttcgttaaggaagcggggcccatcttagtttttgacagggaccacatcattctggacgaagcgtacagcccggaattcgccaccgacagcatggcggtcagaatgacaaagttcatgatatcagccgcataaggaacgccgattttatccagcacagccacaaacgggctttcgatgacgcctgccgtttgatacggcaaaatggacacgagaacaaacatcgccagcacgaagaaaaaaagcgtccgccatatgacgtttcggatcgagcggggaagcgtcttttccggattttcgctttctcccgaggcgattccgaccagttcggtaccctggaatgaaaaattcaccataacaagggtaaacagcacggcttgggcgccgttcggaaaaagccctttgtccgtcgtaaagtttgacagatacggagccgtctgcccgccgttaaaaccgacaaagccgaataccgcagcgcagccgagaataataaacaatacaatggccatgaccttaatgctggaaaaccaaaattccatttccgcaaaactccgcgcagacagcgcgttaatggaaaaaatgacgacgccaaataccaggcaccacacccaaatcggaacggccggaaaccatcgctgcattaaaatccccgccgacgtcagctcaagccccactgtattggcccagctgaatgcgtacatccatccgatcgtaaatcccgtcgacggcccgagaaactttgcggcatacgcctgaaatgatcctgcgaccggcatggcaaccgcgagctcccccaaacaaagcatcaccaggtacattaaaaatccgccgatcacataagccaatatcgcgccgatcggtcccgcttcactgatcgtaaaaccggagcccagaaaaagccccgtcccgatcacgccgccgagggcgatcataaacaaatgccggcccttcatcgtgcgctgcaattcattttgattggtatctccctgcatatacatccccttattccgttatgtcagccatttgtgcgtatgtctaatcggcagctgtgcaaaaggtgcattgtcgtctgctgaatgagttccggcagcacatggaatgtgtacggtttgtacacgcgttccgtccatttatggccgtcctttccgtatacccctatattgaccgacggaatattcaattccctgatttcattaaaaggaatcgtcccgatgacatcccagcccggaaaattatcggtaaaggcggagacctcctcatctgtttcatgcagcgataaaaagcttccgtccgccaaataagggaaaaactttttaaagacgaatgtttctccggttgatgccgctgttttatcgaccgcttcttgaatgacatgctgcaaaagccggtcccgtgtgctttcttccttcagataattgtgcggaaggtaaggcggcgcatagaaaataatgaccttggctccctgctcaggatcgagtttttgcagttcttcgacggctttaaaacatctcatccgcagttcaagatgttcatatgttttaaatgcctgcccgatacactgtgcagggtctatcccgcggcttctcagccttttcaggtaatcttccagactgtacacttgaacgttccatgacatctcttttttcggcaggctcgttctctcacagtattcgtcgtaataatcagataatttttgttctgtctctttgcaggcttcgtcagccacggcggtcagctgatccatgacttctttggcggttttctcgtaaataaaataattaaaatagacatagctgctgacggcggtctgcacgttatacgcttccttattgtcacgctggtagaggcaggtcggcggaagcacaagctccccttcaatgttttccgccatatgaatattgttgtgaattcttctggtgatttctgacgcgatcaaattcggatcgatgccggacagcgtatctccgacatgcacctcccgcccgtaaatcgcaaagcaaggcaaaagcttccctgccgcgcccgtgtatatgtaccttgtcgtgtcaccctcatacagcggcgtgataaaatcgttattaatcgctgctaaataacgaagctgcttttcttgtttcagccgttttaattcagaaatgctggttaaaatgccggaatgctggctttcttcatccgggtttgccatgaacagaatatggcccggcagctgatcgcgccgttcagaaaagtgaagcagattggcgagatgaacggcaataccgctctgcatatcaaccgaaccccttccgaacatccactcgcctgagcgggcgtcccgctgcacatcccgatcaaattcatagtttgagaaatattccgcgagacggtcggaatcaaaagcgatatcttttaaagggccgaaatcctcgatgccgaccgtatcaagatgagcgtgataaatgaccgtattcaggctttcgccgtttccctcaataaatgcgaaaatatttttgcggccgtaagggtcctcaggaatcgcctgctcccacacatgtgacggattctcctgaaagtagggaaagctcttgatcatatctttgatatagtcggctttttttccttctcccaatgtgccgttgatgctgtttaacgccaccagtgatttcgtaatggcttctattttctcctccggaagcattttgctgagctgctgatacatgttccatcccccttaccctcatatagagaaaatagcgcgactctctttttcatcgcgctatttccgaaagattaataggcttcagacgttgtttttgcctgcatatgaagaatcagatagtcaggtcctccggcttttgaatcggttcctgacatattgaagccgccgaacggctggtatccgacaatcgctcccgtacagccgcggttgaagtatagatttcccacgtgaaaatcttcgcgggcgcgttcaatgtgcgcgcgggttttcgataacagagcgcccgtcagtccgtaatcggtattattggcaatctcaagcatatggtcgaaatcacgggcttttgagatcgcaacgaccggcccgaaaatttcctcctgcatcaggcgggcgttttcatcaacatccgcaaaaatggtcggctgaataaagtatccttttgaatcatcaccttcgcctcccgtcaggagttttccttctgttttgccgatttcgatataactcatgactttattataagatgcttcgtggatgactggccccatgtatgtatcaaaatcttccggacttccgacggtgagtgattttgttaaagcgacggctttttcaacaacttcatcatagacgtcctgatgaatgaccgcgcgcgaaccggctgaacatttttggcctgagaatccgaaggcggaatacacgattgaggaagcggcaagatcaagatcagcatctctgtctacaagcaccgtatctttccctcccatttcggcaatgacccgtttcagccacttttggcccggctgtacttttgcggcgcgttcatagatgcggcatccgaccgcgcgggagcctgtaaacgacacaaatctcgtcttcggatgctcaacgagatagtcgccgatttctcctccgtcgcccggtatgaattggagcacgccgtccggcaggcccgcttctttcatcacttctacgaatttcgccgccacgacaggcgccgcatccgccggtttcagcagtatcgtgttgcctgttacgatggcggctgccgccgttccggccataatcgcaagcgggaagttgaatggagaaatgacaattcccaccccaagcggctcatagtgatactgattatattctccgtcacggctctttacaggagaaccgtctttcagcttcagcatctgacgggcgtaatactctaaaaagtcgatcgcttccgccgtatccgcatccgcttccttccacggtttccccgcttctttcaccaggtacgcggagaattcgtgctttcttctgcggatgatcgccgccgccttaaacagcacattcgcgcggtgttccggccgtacttttttccatgtttgaaatgcctgcagcgcagcctgcatggccttttccgcaagttcttttccggctgccgatacagaaccgatcacttcttttttatctgccggattgacggaaatgatctttttatccgtttcaatcgcttcaccgttgatgataagcggataatgcttgccgagctgtgaattcacataagccagcgcttcctgaaacgattgtttatttgtctcttcctgaaaatttgtaaatggttcgtgtgcgtatgaaactgtcattagaattcctccccgtattttgtaatgtgtgctcacgcttaatgaagatgcaagaagcataccagcatagcaatttgtgataaaaataggaaaatctttgccgaaagcggacgaagcttgtccgaacctgtcagctgcaatctgaaaacgcaaagaaattttgcgatccgctatataactgatgcaaaatctctttgcggataacacttatacccagccgcggaaccgggccgcttcagccgactttctgatgcccgtcatataggcggccaaacgcatatcgactttgtgggtatgcgctgtctgataaatggattcaaacgaattcaccatgacgctgcgcagttttccggcgacttcttcctcagaccagtaaaagccttgattattttgcacccattcaaaataagacaccgtcacgccgccggcacttgccaaaatgtccggcacgagaagcacgcctctttcattcaggattttcgtggcgtctatcgttgtcgggccgttcgccgcctccacaatgattgaggctttaatgtgatgggcgttttcagccgttatctgattggagattgcggcaggcacgagaatatcacagtccttttccagcagctcccggttcgttatgacatcagagaagagattcgtcaccgtgccgaagctgtcccgcttatccagcaggtaatcaatgtcaaggccgtcagggtcatacaaagccccgtgggcgtctgagatgccgatcaccttggcgccggcgtcatgcataaatttagcgagaaagctccccgcgtttccgaacccctgaatgatgatccgcgcattttccaacggaatcccttttttcttaacggcttcctcaatacaaatcgtgacaccttgcgcggtcgccgtctcccgcccctgtgaaccgccgagaacaatcggtttgcccgtaatgaatcccggtgaatcaaattctctcaggcggctgtattcgtccatcatccatgccataatctgcgagttggtatatacgtcgggagccggaatatcctttgtcgggccgacgatctggctgatcgcgcgcacatatccgcggctcagccgttccagctctccgaatgacatcgtccgcggatcacagatgatgccgccttttccgcccccgtaaggaagatttgtgatgccgcattttaaagtcatccagatggaaagcgccttaacctcttcttcactgacttccgggtgaaaccgcacgcccccttttgtcgggccgactgcgtcattatgctgtgagcggtagcccgtgaaaacctgtactgagccattgtccattttgacggggatgcgtacggtcaaaagccgcatcggctctttcatcagttcatacatattgtcaggatagcccagtttgcgcagggcttcttttatgatcgattgtgtggacaagaacaaattaagaacttctttttcttcatctttctgagtgcttttagaaagcgggttggctgacatgttttatcacctcatcgtattttacgtgtaagcttcaattaccggcagaacgaaatgtaagcgcttttacaccaaaacccatcaatccctttcacattgtcgttacacccctttttatatgcaagattcatgccaggattttgcgcataaaaaaagaggctgttgtcagcctctttcatcccggattaacgcgggtcaataaccagctttgtttcggcgtagagactgccggcccccaaaccgtttacgtaatcgcctttaattgtatacgtgcccgcgcgcggaaggtttttacgcaccaggacgagattgtattcagacgcgcccaataagtcaagggtaagcggaagtctgaccgtttttccgtagttgagaatttgcgtttctttcagtgttcttccgtttacagagtccctcacagtggcgttgaacccgtcaggaaattgaaattcaacggcgccgacggcaagcagcgcattcggcttgtatgtgacttcaatatcagacgtcgcgtattctttcgtactattgacggttttcgcttcaataacggcagattgggcgttcgcatgaaaagatggcaagaacacagctgaaaataccgcagcactgatgagaaaggcagaaaatgattttctttttaacatcatgaattcctccagatcatataggattcagagcgtcctctgccggaaaagcgtgtctgatgattccattcgcgaattgggtttctcttttcctgagaataatctaccacctttatccatggaagtaaattattttttggaatattcaatcatttatttttcacgagatgaaccagcacaaaaaacgaagacatccgctgtcttcgtcttgtgcgctaccgatgagccgtctgccagtcaaatccgatgctctcatcattccacgggattcttttttcgtcaggctgatccggattgtaggacattgtcgtgaaataaataatggtcagcggggtttcgcccagcactctgtacccgtgtgcgacgcctttgggaatgagaaggagcatcggattgtcttctcccatgtagtagacatccgtttctcccttggttgccgactcttcgcgaaggtcatgcagcacgacctgggcgtggcccgtcgggaaaaaccacaggtcatcctgtttctcatgatagtgaaacgctttaatgacgccgggatagcttttggaccaggaagcctgcccgaaacgctctaagagatgttcatcgtcacggacgagttctgagaaaaaaccccggtcatcgctgtgtttgatcagctttttaatttttacgccttcgatcacttgcactgtccctccctttgtaaataatcctttagcgcttcccgccaatgcctcatgccgagcccctgccgttcaatcgactcaagactcaacaccgagtaagcggggcgcggcgtctcatttccgtattcctccgtcgtgacgggcagcacggcggcggttctgccgctttcttcaaaaatagccttggcaaattcataccagctgcacactccgctgtttgcggcgtggtacaagcccggcggcctgtcaaacagaccgatcaccgtttcggctaaatcctttgtgtacgtcggcgctccgacttgatcgttaacgacacgaacctgatcatgtgtatccgcaagtttcagcatcgtattgacaaagttgtgcccgccgctgccgtacacccacgacgttctgataatggtgtggttttttcccgttaaccggatcagttcttcgccgagttttttgctttttccgtaaatcgtgcccggatctgcgggatcatcggtctggtatggccgtgttcctttgccgctgaagacgtaatcggtgctgatgtgaatgaatttcgcgccggtgttttcagcctcaagcgcggcataataagcgccgattccgtttattaaatacgctttgtcgagctccgtttcacatttgtcaacggaggtgtatgccgccgtattgacgacgatatccggcttgtaatggctgaacgagtgccgcaccgaacgctggtcggatatgttcatcatcgcttttgtcaaggcgatcacttcatacccttcccgcttcagctggcggcataactcccgccccagctgaccggccgctccggttactaataccttcgtcaatcggatccccttctttccgattagtcttggctgtctgtataccagcgaatggttcttctcattccttcttcaaatgtgacgtcctgccgccatcccagctcatttttcagctttgaagcattgatggcgtaacggcggtcatgcccttttctgtcttcgacatgagcaaaccgttcctcgacaccgagctccttcatgataaatgacgcaagctctttattcgtccgttcatttcctccgccgatattgtaaatttcgcctagtgttcctttttccagcacgagcttaatggcgcggcaatgatcttcggcaaacagccagtctctgatctgcatcccgtcgccgtacagcggaaccggcgtgccgtttacggcatgcctgataatggtcggaatcattttctcgtggtgctggtacggcccgtaattgttgctgcatctcgtaatgatggcaggaagcttatgggttttcacataagacatgacaagcaggtctgagcttgccttgctggcggaatacggattgttcggagaaagcggcgtcgtctctgtaaaagcgggatcatccggcgccaaatctccgtacacctcatctgtggaaatgtgaatcagcctgccggcttttccctgtaacaccgcgtcggccagtcggtatgtgcccatcacatttgttgtgatgaacggctctgcctgatttatgcttctgtccacatgggattcagccgcaaaatgaatgacagcgtcatacatttgggaaaagactttgtcaatgtcctctttttcagaaatgtcacctttgataaaacggaaacggccgttcttttttaaggcttctatttcaagcggcctgcttgcatacgtgagattatccaggacggtaatctgcgcatctgtttctttcagcatcatctttgtgaaggtaaggccgataaatccggcgccccctgtaattaaatatgattttggcatgattaatgctcctgtcctttctgtaatgcctgatgcgccaggcttccggcgagatagagcgattcatgcgtgcccgcatccacccaccagcccgttaacacatcatacgtcagctcactgtgttcaatgtataaattattgacatccgtaatttccagttcgccgcgttttgaaggagaaatttgttcaatataagaaaacacttctgcgtcgtacatgtagatccccgtgacgcatagtctggtcggcggctgctccggcttttcaatgatcgacttgatccgtttgttttcctcatcaatctcggcgatgccgaagcgctccggatcgtcaacttctttcagcagcactttcgctccttttccctgctttgcgaaacgctccgtataaggttttaatgaatcttcaaaaatattatctcccaaaagcagaacgaacggatcgcgcccggtaaaccgctttgcgtatgataaaccgtcggaaatgccggatgcggctggctgaacctgatatgtgattgagacgccgagctcttctccggtttcgagaagtttatgaaattgcggaatatattctttttgcgtaatcagcaagatatccgtaatccccgcttcttccagcttcatgatcgaccagtaaatcatcggatatggaccgacagggagtaaatgcttattgaccgcttttgtcagcggcataaggcgtgagccggtgcctccggctaagataacacctttcacatgaacacttccttacgtgtggttttatcacaaatcataaagaatcgccgccgcccgtttaatgcccctgccgtcaaccagcggctttccgttctgatgaagcccgagccgtctcggataatcagcagccagctcagacatatgccgagcgagcacgtccgccgcggtgtgttctcccaggccgagatgaacggcggcctctcgtgcggcgaatttttccgccgtctcagtttgatgctccacttgagaaagaacgatgcagggcacacctgtacaaatggtctcatataaggtgatcccgccggacacgatggccatatcagccctcgtgagaagcgcggccatgtcatttgtctgccttaccatctcggcataaggcatttgtgtgagatgcgcgcgcacgtcatcagcatgaggcgccgcgccgcccatgacgatgatcactcgtttccgctgaatatcagggatgcggcggcatgcttccatcactttaaagacaagcttcttcgggtcgcttcctcctaaagagaccaatatggttcggcattcttttctcagctgatagagctgctttgctttttcaaaacccggatgaagaatcatataatccgggccttcatataccgcggcgctgcccatttgaaccgtccggcttttcagcccgccgtaaatgccgtttataacggcatcgcataaatgaatgacatgttccctcttttcttcaaataagacgatacgagccgatgaatgctttttgatttcctccagccagtcacacggcatatcgagcagatcgaatatgagaaggtcgggagcccgcgtgtttatttcccggacaataaattccttctgtcccttgtcaggcttgatgatcacttcccattgatcagatgatagataagaagaagcctctttatttgtgtagaacgttattgagcagttgttcttaatggcaccggcaagcagcttcatccgaaccgcgtgccccatgccgatgtcacggcccccgtccgcgaaaatcaaaacccgcacgctaatcagcctctttttgccggatcatttgattaatggccctgagctccggatcacgattcagcagatggatcaattcttttgccggaatatcaggacgcgagcccgcttttacgtacagctcgcgggccagcctgtagtcctcttctgtatcgacggtcatccgcaagtgaggagcccggagttcctgcgggggctcaggaaagagaagccggtacctctcaggggattctcttatcaaaagggtgacatgctcctgatatttgtccgccagcgttttgtccgcattgatctccgttaaaaggcgcgcgttcaccgcctcgccgccgatcccgagcggtgtaccgcagatatacgtgtagtctgcgtgctgatctaaatgcgattgaatcagaaaatcaagcagcgaagggtcgacaaacgggttatcccccgtcagtctgactgcgatgtccggttttacttgttcgatgacttgtgcaaaccggtcaagcacacgctgttcgctgccgcggtggacacggtagcggttgctgaggcagtgcgcagacagaatgtcgtcggtcttgctgtcagacgcggcgacgatcagattatcccgtgattgatcgtaaaacgcactttgacgaacccttttgacaatcatatcgaggatcgtatacccgccgatcggtttcagcactttgccgggaagacgcccgcttcccatccgcgcctgaatgataaacaaaatgtcagtcatcatatgggctgcctttcgtcaaaaggtcatcccaagtgatgcccgtgtcggcggggatatccctgaccgcacgcgcgccgtcagttaaaagctcaaaatatctcgggtgaagcccctgcggtttttggccgggacgaaggacggcaaggttttccgccgtaaaatattcgcctttttgaatcggcgctgttgaaaaaatgcctctgtaagcaaaccttctgatatccccttcaatcggtgtcgtcgttttatgggagcttcccgacagcacttccggcaccggagcgtgatgcccctgccgcagctccgcttcaactgagcggatcgccgcaaccatttcttttaattcatccggattgagggcgaaggagtgatcagcaccgggcaggtttttatcgatcgtaaaatgcttttcaatcagtttcgctccgagcctgacagccgcgcacggcacatcatacggatgggcgctgtgatcggagaaaccgatcacagcatccgggaatgcggcggcaagcatgggaatgacgctcagattgctgtattcaggcggcgcgggatatttcgccacacaatgcatgatcgcaatttctttgttcccctcgccggtaatggtttgataagcctcctgaatatctgaaatatcagcgcccgcggtggaaaagataatcggggtcttcagccccgcgacatatttcaataacggcagatggttcagctcgtaggaggcgattttaaaagctgaaggggaagtcgcatacagtaagtcggcagagccttcgtcacataccgtgcttaaaaacagcacgccttttttcttacaatattcaagcagcggttcgatccactcagcgggcatttccattgattgcaccaaagaaaaaatagagacgttttttcccgcagcggttttgtataagccggggtctttctgatacattttgtcagcctgaaacatttggaacttgaccgcatccgcgccggcctcactggccgcatctatcaattcaaacgcctggctcagttttccgtcatgattaattccggcttcggcgatgatgaatacgggcgaaccttcgccgattgacttcgttccgattttgcatgatgccatcagtccgcctccttcccgggccacacatgatagtagtaaaaggacgcatccgctttaaatcccattctttcatacaggcggatggctcttacattgtggagctgcgttcccgctgatacagtcttatgctgaaagcgcaatgattgttcaatcacgtgcgcagctaaatggaatcccgctccttttccttcaaatcccggctttaccgccatcagatcaaggacgaattcatcgcctttagacagcccctgaacaaagcccgcggtctctcccttatatttggcgaggaattgtaacgaagctctgccttccgcgttattccgcgcccactcttcaaacagacggtttgcacttttatagctgagatgggggtcctgataatacctgctttttgtaaaggcgtcgcgggccagccggctgatcgcttccgtgtcgccgggtccggcttctgtaatctcaaacggcggcgtgctgttatatacacgcaccggactgacgagcttgagaagactccctacaaaataagcgttcggaagcgactgcacgacctgcatcgcgccgatatcttcagctggtattttaataaatataaaatcagtgccgtccgcccgccttgccgcgtaaaattcctgaaacagccttttgagctgtccggtgctgtttgcggctgcaagcttcacattgatgatattttttcggaacaattgactttcccacgaagagttttcatataaaatcacgccttgaaggctgttttcttccaataaacagagcgacgattcataggcttcgggctgaatgcccttctgatgcaggaaggcatgaatcatgtcctgtgcaagattttctctcagtctgtacacctaatcagcccctttgacgatatccgtaacggctgcaatgacgtattcaacgtcatcatctgtcattgacggataaagagggagtgatacggtgcggtgataatacgcggccgcggccggaaaatcagtttccttatatccgtacgttttttgataatacggatggaacggaaccggaataaaatgaacacttgtgccgatattatattggtctttcaaagcggaaatcagatcgttccggctgatcccggcctcctgctcctctatttgaagaacatacagatgccatgcatgccgcccgtcatcactgacatatgggacggtgagccctttcatgtctctgaaagcgtcctggtagcggctagcaatttcagcccttctttgctgcatgctgtcaatccgtttcagctgatgaagcccaagcgctgcctgaagatcaaacatattcattttatagccgggcgtttcgacctcgtagtaccagcttccgtttgaagaatagcggttccacgcgcctttgctcatgccgtgaaggctgagcaccctgatctgatcggcaagcccgtcatcgtccgtcgtcagcatgccgccttcaccggttgccaggttttttgtcgcgtagaagctgaatgccgtcgcatcaccgattgatccgatcattttctgtttataagtggtatacacggcatgtgcggcatcctctaagacaaataactgatgcttttcggcaatggccaaaatttgatccatatcacacgactgcccggcgaaatgaacgggtacaatcgcttttgtccgcggggtgacggccgcctcaattttttcagggtctgcattcagcgtaagcggatcgatgtcagcaaacaccggaacggcgcctgtgtgcacgattgtattggctgttgaactgaacgtcacggcagacgtgatgacctcgtcgccgggaccgatccctttcgctttcagggccaaaaacaaagcggcggtacatgagttcagcgcgatcgcatgctttgcccccgtccaggcggcaaaggctttttcaaacgcctctactttcggtccctttgaaagccagcccgattcaagtgtatcaataacctcctgaatttcgtccttcccgatcatgggcaatgaatagggaagaaaagctgatcttttttgcaccattttttttgcgctcctatcttttttatgaagggtcaacccgtctgaagctgactccggttttttcctgaagcacttgacataaagcggcaagcgaatcctgaaccgggtagttcgcggcgacaaaagcacggcgcgcctgttccgctttttgatattctgcggggctttcgcatatccggattaattcctgagcgagtgcctgcgggtcctcaaaaacaaattctccaagtgaatgataataagggtatcggcgggttcccgctgattttccgatcagcacgggcttttgaaacagcatcgcttcaagaccgaccgttgatgtctgtgtcaccgcagcgtcaacaaacgggagaatatcatacagctccatctcttttttgatgattttgcctgctttatatttccgcagcacctgattgtaagcatccagcttgtttttgccgatttcccacggatgcggtttaataatgagctgcatgttcttttggccggcaagctcttcaagcactcccgtataaaattcatcagaaaacggctgcgtggcgatcagcaccgtccgctgtgacgggagaaaagaaagtttgcggtaaaacgtgtcccgatctatcggctctcttgagaaaatctcgtcgaaacggggatgccccgtgatgatgatttgttcctccctgcagccttttgctttataccactccgcttcataagccccgaatacagcctgatagtccgtaaatacgggcagaaacgcttcatctcccatgagcgccccgtgctgaagacagatgctgacggcgttttttttcgcggacatcagcgccagcacacggctgtaaatatcctccgtcgtgccgactacaacggcggaaatcttctcggccgtaaacaaaatatcaacggcgtcaatcgcttcaataaataacgggatgtctttatacagtcgttcctgaaattctctgtttccgaaagcgggatggctgtgaagctctttcaaaatggaatgggctttttcaatataagggacggggttccctttttgccccattcccgtcagctccaatttgcagataacgggcagcccatgatggtcaggcagactccatctggccagtaccgctgtttttgccggatcaaactgccggtaatttccctcggtgaaccgaagatgatcgaaatgcagaatgacttttccgtttaccggtttctcatctgttttcttaatgttttgccttttttgatcataataaggctgaataccggcttcaggaatatgctgatccgccggaccgaaaagctccgggttctgctccatgctctcccgaagcgccggactgatatattgataaaaattactgatcaatgcgagcgggatgtctttgtagcgaagtgactgaaaaaggtcaatatactgccggtacagcacccaatagttcgctaagtatgccgacaagccctcacccctttccaagcttttttaatgattccctcagctcccggcacgtggtctgctgcggaaggctgttcacaaactcgtttttctccgccgcgaaaagctgataatggatggattgatcggtaatataattgatatcaagttcctcagaaatcgggtaaaacggataaaaatgattcactctccagaaaaaacgggcgtcaccgatacggtaaaacgcggggctttcatcccaataggaaccgaatgccgatttgacctgttccagcacggaaaaccggtgcatgaccgaacaatggtcaatggcgcacggcgcgttccacacgatccgttcggcgggcctggccgtctccttcaccgtctctttccgctgattcagatgataggttttggaacttgaatacacgacggctttttccgggtcttcatcaagctctttcaccattttctcaagccgttccggcacatacgtgttgtcgtcggtcgcatacgtcacgtactcgccctccgccatttctattgcctgattaatcaaggcggcgtagcgtgttttttccgttctttctttgacgcccgatacatcgctttgataaaaccggacgcggtcatccgtgagaaaaggacgtatttccgccaatgtctcttcatttgagttgtcatccataatgaacagctcaaagtccgtaaacgtctgagacagaatacttttaatagagcgggccacatagtcacttttgttatagctcgtcatgatcactgacactttaggcaactcgtcacccccttttcgcacctgaaactaccgctatcatatgttccttatgcggaagatgcgctagggatacagactattatgtgaaaagtcagcattgcgcgcacaaaaaaagccggctctgatatccggaaacattggatcgtattttcttttttcgcataaatctttctttgggctcatatggtggaatagataaaaacagcagccgctctgtcggctgtctgatacttgtcaggaggtttcagcatcaagaggttttcatcaaaggaggaacaatatgaaaccgaaaaagaatcaatatcagcaaatgcaggggatggggatgggaatggatatgcagggattccagccgcagctcgggcctaatccttatccgcagcctcagggccaaggatcacaaatgatgccgatgcagcagcaaatgacaatgccgatgcagcaaggccagcagggcttcggcggggggttccccggccagccgcagcagcagggcggcggcagctttcaaatcccgtcaggtccatcatcgtcacaaaacgttcccggcatgctgccgattgaagagtcatacattgaaaatattctgcggttgaaccggggcaaaacggcgacgatttatatgacattcgaaaacagcaaagaatggaattcaaagattttccgcggtgtgattgaggcggcgggacgtgaccatatcatcatcagcgatccgaaaacgggcacccgctatctgcttctgaccatttaccttgattacatcacatttgatgaggaaatcgcttatacttatccgtactccatgtcttcttattctccgagataaatcaaaaagccaatcgctcacttgacagaggattggctttttttctttataaatatttgacggccgcgacgataatcataatccaagagatgataaacgccacgccgccgagcggtgtaatcgcgccgagaatggaaatctgcgtcacgctcaatacgtacaggcttcctgaaaacagaacgatgcccgcaaacatcagccagcccgcaacagaaacactgcctgcgccagagagcttttcagccaaaaacgcgacagccagaagaccgagcgcgtgatacatatgatattgcacgcctgtgtgccacacctgcaaatatttatcggggattttcccttcaagcccatgcgcgccgaaagcgcccagcgccacggccaataaagcgttaatcgcaccaagaataataaacactttcatctatttttctcccgccttttcgttaaagtttccaattcaatcataacccaacatcggcaaaattcaacgtccgtcatccgatgacacgagattgtcggattttttctttttgataagctggattcggtcaatcgctatcgccagcagcgttccgagcacaaggccgttgcttaagagcgaaatcaggatcggatgcatccctgataacgcgctctccggcacaaacattacgccgacccccgtgaggagcgccagaccgataatggaacggattcgtttttgctccgctttctcataagagtcaaactccgtaaaggcaagacccgccatcgtggagaaaacgacgaagtttaccgcaaagccgaccggtgagggcagactcgcaaacgcattcataaatagcgggatcatactgatgatcatgacaaatacacttcccaaaagaaacggctttttcgaaggaagcttcgtcgtctcaataaaaccggccgcccctgaaatcggcacaggcgcaatgccccctgacagcccgctcaaaaggtggctgatcgaagccgcaaaccctgccggacgctcacgccgtttcccaacggtgccgccgaattttttcaccgccgcttctacaacccggatgctcgcgagcatgttgacaatcaaaagcacggtaatgaagagtgacgtaatgatcaggccgctgtcaaacacgggttttccaaacggaaaaagaaccggcagctgaatcacgcgatccggtatttgaatcggtttggcagcgccgaagacggcgaataagatccatccgccggcaagcgaaaggagaatcgcatactgtcttaagaacgtaacattcgatcgggacatgatgaacatcgccgccgtcacaaccattgcgagcccgaatacaaggccgtcgacgctgttttttaaatagccgatgcccaaaaggcctttcacaatcggctgactcagctgcatgaccaacagcagcagatacacaccggtcacaaccggcgtaaacagcacggccagccgttcaatcactttaaaaaggctgaacaaaaagaaaaagacagcgcttaataacagcgccccctgcagcgcccgcagcgtctcgccgaatgtcgcaaacaccgtgcccgtcagtccgccgtaaatcgtgtatacgccccaccataagcctgccgggctttcattaatcggcagacgatgtccctggagacattggatgaccgcagcgacgccaagcacaaaaaatgtgctctgaatcaatgcggcagaatcggcatggttcaagtgaaatgattgtgcgatggcgacaggaactacaatcgcagccgcaatcataaatgccgtccattgcaaacccccgagtatcagtttcaagtcaatcaacctctcctgttaaaaatcgaaaatggaatccccgtttccgtcttcctcacgttcgtctttcgcttttttctgatattggttcagcccggcgctgcccatcattttttcaagcagcagcgggtctgtcgaaggagacgcggaaggtttcggcgccgctttcggaatcggattctgcacaggcgccggagcggtgtgcgtctgagtgccgagcacgacatcacacagagagcggatggcggccgcgtgcattttgacctcctcggtgcgggtcgccgttttcgcctgcctcagttcttcttccatcttctgaattaaagcagagatatgtatgttcatgagtaaatcctccagcagtaatttgtcttcttcctgcattttatcaaatttctgagcggatcgcagaattgagtttgttattttttctgacggcataccgcccggaacatcaaaaaagacgcttccgccgggcggaagcgcctcaaaaaaccgtttattgcggcaggtcggggatgcaccaatcgatcggctgctcccccattttttcaagggcggcgtttgtacgggaaaacggtctgctcccgaaaaaaccgttccttgccgaaaacgggctcggatgagtcgattcaataataatgtgtttcgatgtgtcaatgcgctcttttttcatctgcgcgtgacgcccccacaggataaagacaatcggcttctctctttcattcaccacatcaatgatgcggtcagtgagccgctcccaccccttgcctttgtgggaattggcctgaccgcggcgaaccgtaagcactgtgtttaacaaaagcactccctgcttcgcccagctgacgagcgatccgtggttcggtacggggcagccgatatcgtcctgaagctctatgaaaatatttttcaaagacggcggctgtctgaccccgggctgaacggaaaaactaagcccgtgcgcctgtcctggcccgtgatacgggtcctgtccgagaatgaccgcttttacatcctcatagggcgtataatgcaaggcgttaaaaatatcatggctgtcaggataaatcgtttggctgctgtattcttgtttcagcatctctctcagctcttgataatacggtttgtcaaattcatctttcagctgattccaccagctgtcttttaaaagctgtttcaaactgtccgtcccccttatgaactgtgcagtcttgaatggacgggctttccgtcccacacaatgtcagtcggcgcctcccgcctcttcatgtccggctcttctagaagaaccgcgaagtttttcgtcgggagctccccaagcccgtgcttttcgcttaaccggtctaagtaccgcttccgtttgccgccgagatccgcggactgattgccgcctccctcaaaaaacgcatatatgacgctcgcgcaaggaacacgcttcacacggtgctgtttcgcggcgcgcaaataaaagtcccagtcccaataattatggacatccggatcaaaataccctaacgtgtcatgcagagaacgtctgtacatgctgcctgacggaacgtacgtggaaaatacccgcatatccgcaaaatccgccgtataggcgaacggctttcgtgacaccgggtatctcgtgccgccccgttcttcaaatgacacaatttccgcgtcagaatggacaaaatccgcatcagcaagtgcagccgtcattctttccaaatggcccggcgtaatgaaatcatcatcatcgcacagcatgatataatcaccccacgcttttttcacacctgcgttccgcgcttccacatgtccggcattctgttctaaatcaataatctgaatcggcagatcgctgtacagctgcttcgcttgttcgaccgattccccggcatcatttacgatgatcacttcataaggctttatggtctgcctggaaatcgactccagcagctcacacaaagccggaatccgattatacgtgactatgacaattgatatattcatgacccgctccttctgctttttctcatgttctattaaaacataaagcggcggagagatcagggggatttttgatttcggcccattcagaaacaaatccacgtcatccccgccagcaaaaccagaatgatcagaaggtctccccaaacagtgcataccgccttggcattaagtctgcccgcctccatggcattccacagttttgattgataaacaggcaccaacaccatcgcatagcatgtgcacaagcagacaaaagccggcgggacaagcgcacatccatcctcatgccaatcatgaatcagttccggtatactcaccccgctgtcaatgtacaagtataatatacccgccagcggaatgagcgagctgacctgcagctcgaaaagtttcaccttccactcacgcgcaaacgaaacagcccaaatccatcccagcgcataaaacaatagaagaagcaaaatactgaaaacaacaaaagtagcgtcttgcatcccattcagaaccataataaaaagactcacaacgggcaaggcaagaaccaagccgcagacggtaaatacggtaacggctatttgggcgcacgcgccgtacatccacgaacctaatctcatataaacacccctatatagattccctatgtatatagtgaaaaagatcaggcaagtctctgcctgcctgcgtaaaaacctattttgccgcaaaacggaaaacataccgtcacaacggcgcatactgccgcaaaactcggtgtgaccgccgaaggaaacagcccagccggaaccagattgaacaaaaagacaaacataaaacatagattcggcaccattgaagcccataccgtccgctcagcaagctttttgccgccagccccgaactctttgccagcttgatagccgatttggaaccaatacagcacataaccgatcataatcagccatactgacacggaaatccctttccacagcgcgtcaactgcgggatgaatcctccacgcgtgcatcatcgtaatcatcgcccccatcacaaaaagaccgcagttgcagaacagataaaagagcataaaagtccgcgcgggcaccgtcgaagctttttgaaaagcagagataatctcagacggagtccccacttcccgcagaataagctccatcgcttcgctttcggttttgcctttttccagatgaacacaaatggcatgatgaatatggctttcgatttcctttaataattcacggcttccggccttgccttccagcccttttctgatttcgtgcacataaaggtctttatccattctgcccgccccgcttcagcatccggtccatcagagcggagaacagattccattccttcgtccgttcggctagaatgttttttccttcatcggtgatccggtaatattttcggtcgggccctttggtctgcttttcccagtaagaagaaatatagctttggcgttcaagcttatgaagcgatgggtacagcgtgccttccttcatttgcagttcattcccgcttcttttctccatttctttcacaagttcatacccgtacatgggccgttcattcagcagcgtcagcaccagaatgaccgtgcttccctttacaagctccctgttgagcatttattttctcacccttacctagtaatcttatgtaggtattgtacgcacatcccccgcggctgtcaaatcattcctccaagccttccgtattgtgatcgggagaaaatctaactataatgagatataaaacactgatggaggccattgatatgtcaatgcacaaagcacttactattgccggttctgattccagcggcggcgcgggaattcaggccgatttaaaaacatttcaagaaaaaaacgtatacggaatgacggctttgaccgtgatcgtagcgatggacccggagaacagctgggatcatcaagtatttccgattgatgccgatacgattcgcgcacagctggcgacgattgttgacggaatcggcgtagacgccatgaaaacgggaatgctccctaccgtggagatcatcgagcttgcggcgaaaacgattaaagaaaaacagctgaagaatgtcgttattgatcctgtcatggtctgcaaaggagcgaacgaagtgctgtatccggagcatgccgaagcgcttcgcacccaattggcgccgctggcaaccgtcatcacgccaaacctgtttgaagcaagccagctgagcggtatggatgaattaaaaacggtggaagacatgaaagaagcggccaagaaaattcacgaactcggcgcgaaatatgtattgattacaggcggcggcaaattgaaacatgaaaaagcgatcgacgtgctgtatgacggagaaaccgcggaagtattagaaagcgaaatgattgatacaccttacacgcacggagccggatgcacattctccgccgccgtgacggcagaactggccaaaggcgctgaagtgaaggaagccatctatgcggcaaaagaatttatcactgcggcaatcaaagaatccttcccgctgaaccaatacatcggaccgactaaacattcggcgatgcgtcttagcggaaaataaaataaatatcccctcatgatcgagggggattatttcatttttttcgcggatgaccgcaaaaacatctcaatcgattgcacaaacagcgcatattccttcatctgttcatatgtatgcctcagccgatcactccattcattgtgcggctcagccctcttgagcatgcgattcagctgaagcaatacttctttatattcttcccgtttatcttccacttgctctgcagctttgacaagtaaacatttcggcgtcatcttctgatttttcaaaactgagaaaacaactccttttattcctggaatcataggctttcgtttgaagaatagcacagatggcataggtttcacataagaaaaaagaacgattttctacaaaagtgtccaaattgaggcatttatttccgttttcccaaccgaagtgacggttacgtcatcatttcccgggaaaggaaaatatctggcgctgaatacctcttctccatcattcaaaaacaattcaatggaggatgcatccagaaagagctggacggaatgcagctcgctgatggcgcagcttctcttttctttttcttctccgctgaaagcggtgcgctccagcacagccagcccctcttcctgatgaaatataaaccgggccgcgccccgaattgagatttcaaaaccggattcgcaagtaatgtcttccagcagcacttcagcccgggacgcatctttcaccgggaggcttacagacgagcaattcaattgaagacggcgcttttgttcatccgtgcggcgcgatttcatttccgggagcgggcgctgtatgattctgccgttggacagtgacagctgtctcggcatcgttaagcagtgaatccagtgatacgcatgtgtcggatgcttgtcctcatgctgatccggaacgcccatccacgcgaacagaatcctccgtcccttatcatcttccagcgtctgcgccgcataaaaatcaaatcctctgtcaagctccgtaaattcaccgtgcttaaattctggcggctctgtatgcagcctgccgaggaaatagcccgcctggtggctgttatgatattttatcccgtcggcttcaagcccctgcggacatacgagcagcacgtcggttccgtcaagagaaaacaggtcgggacattcccacatatagccgaatgacccgagaccgcccgagtccgcccccgcaatcgaaccgagaaacgtccaatccgtcaggttctctgatgtgaacaatacagcgcttccggtgagcttttctgtctgcgcgccgagcaccatgtaatacgctccgtctttcttccaaaccttcggatcacggaaatgagcggtatagccttttgggagacgcacgacgattccttttttttcaaatacgatcccgtcttcggatacggcgaggcattgatacgtttcccgatttccttctccgtcacggacattgcctgtgtacatcaggcagagccgcccgtctttttcgatggcgcttccggaataacagccgtttttgtcataccactcacccggcgcaagcgcgatttcttcctctttccactcaacgaaatctttcgtcgtcacatgcgcccaaaatttcgcgccgtgccccgtatgaaatggctgccattgaaaaaacaagtgatatacgccgttccattggatgacgccgttcggatcatttaaaagcccgaccggcggcataacatgatagttctggcggtatggatctgacgcggctgtttcttgccgcttctttttcgcttcctcagcctgcaggcgcagctcttgatccggtgtcctcatttgacggcctccttttctttagctcccataatgtaagcggcaataaacgccgagacagaggcgatgcccattccgatcagatagtttataagatttcctaaaccgagcggagccgtgatggcaatcatcggaattccggtcagaccgtaagcattggcggcgacgccggtcaccacgacataggcccctcccagcgctccgccgatcattcccgcgataaacggcttccggtaccttaggttcacaccgaaaataactggttcggttacgccgagaaaagcggaaaatgcggcaggcagagcgatttctttcattttcgcttttttcgtcaggaaaaatacagccagtcccgccgcgccctgagcgacattcgccatcgaccagataggaaggatatagtttctgcccaaatcagcgatgaggccggcctcaatcgcatgaaagctgtgatgcacaccggtgagcacaataagcggataaagaccgccgaaaagaagtccggcaacaatgcccgcgtgatcatacacatatgtcagcgagacggtaatgcccgatccgatcgccctgccaagcggaccgattgcgataaaggtgataaatcctgtgacaatcaccgtgacaaacggggtgaccaataagtcgaatgcgtgaggcaccatttttctcgtgcccttttccactttgctcataatgtaaacggctaacagtacggggatgaccgtcccttgatagccgagcagcgcaatgtcgaagccgaagagttgcataaaatcaggcgatgcatccgcaagcccccacggattcaaaagcgccggatggatcataatccccccgagcacggcaccgagataggcattgccgccaaattccttcgccgcactgaacccgatgaatacgggcaggaagataaacgccgcgcttgaaaacatgtctaaaagcttaaacagcgatgattgttcagacacccagtggaaagccttcatcataccgagcagccccattaaaagtccgcttgccacgatagccggaatgatgggaacgaatatgttagacagtgttttcgcaaatcttgcggccggattcagcttttttttcgccgcgtcctgatgtgtctcacgatcctcccgccccaaatcggcttcttttgaaaaagcgtcatacactttattcacaaggccggtaccgaatataatctgatattgccccgagctgctgaaagccccttttactccttctgtctcttcaatatcggcctggctgatcttctgttcatcttgaatgacgagcctgagccgtgtggcgcaatgtgtcgcgctgatgatatttgatttccctccgatatgtttgataagctgttttgccgtttcttgataattcatgatgtatccccctttctaaaatcaaaaaagacctaaaattcgccaacgaaaaaggtcagcatgatccctttttcatgtacgcaaattttaggtcttgcctgcattaccagtcacaatcccgccgattcagttttttaatgcgctttcattttatttcatgatagcgctttcgtcaatatgttttcaaaaaaaaagtctgtttctcgaaacagacgcgttattccgggtttttttgcagacgctggacatgcagcgtaatatagccggcctcggattccggcagttccaaatcatattcattttttaaaaacgccgccagttcaagcgcacaccgataagcaaacggatactttttttggatgaaataaagcatctcctcgtccatggaatggagtgcttcatttgagtccaaccggctgaccgcataccgtaagtgcgtgacgaggcgctgataggaaatactgtcttcatccaccttctgttcgaaaaaggattcgatcttttcgatcatttctttgatcatggttgtatgcttcatcgccgaatacatgcttttggcatccgccttggcagtgtggatatgaagcgcgatataccccgcctcatcatcaggcaatgatataccgagggtttgtttcacgtgttcaaccgcccagcggccgatttcatattcttttttataaagcgccttaatttcatgaagcaatcggttgtgcacctgaaggccgttttgaatcctttcgatcgcaaaggataaatggtccgccagcgcaatgtggatgtgatcgttcaaaggcgccgcaagctctccctccgcatggctgatgatatcttcagccgcctctatatgctcttcgggaagcgtttctaacacttgtttgaacttttcattttcgtcgtgcacgacaaatattttttcaattttatgtttttgaatcacatcattttttctcttttgaaaagcgattccgggacccattacgatcttttcccgtccgtcttcttttattaacgccgcattgttatttaatactttgtctattctcaagaggttcgctcccgttcatatgtttagtgggattgtaccctctttttcatatgatgtaaaggtgccggacccgcgcgctcccgtttcggcaattctttgcggacaggcatccatcggtttttatccagcctgccgcgggccgatttcgtttcatcggtcaaatccgccgatcggactcggctcacaaacgaaaaagcaccagccgtccgcttcgctttcttatgataagccgcttggtttccgtacacggcggctaatggatatcttccgttacccggcgccatccagttcatcagaaagaccatccacacccgtaaagatactagcaaacgtttcattgcaaatcatccctccgcttctttttgacagacagcttgttcgcaggcctgtttttctctccgctttaacggaaaaggcggccgatccttctccgctaaaaactagcgggtctagcaaccctatgactctatgatagacgcggccgggcgaattgtttgtcacaatatgagtgaaaaaacaaactagttttcagaagttttgttgaaagctgatggaaatgacctgaaaaatggaaaagccgataaaaaaagttatacacaccttatcccttggttaagcacagcttaaacacagggtatatccacatatccacaaactcgatctatattttgtatgggaacactcgttcccaacaatatatatacacaattttattcagttatgcacaggattctgtgtataactccctccttattcacagaccaatttccataaatgagtcatatgtcacaaggattattttgaattttcaagaaatatatactagatttctaatttagataaagaaaaagggggaaacacgattgaaaaaaggaatcatccgttatctgcttccggcttttgtcttatcctttaccttatccacaagttcacaggctgcgccggcttcaaaaccgcaaactcctgatcttgagaaggctgaggtatttggtgacattgatatgaccaccggcaaacaaacgacagtcatcgtcgagctgaaggaaaagtcactggcggaagcaaaggaactcggcaaagcacagacaaaaagcaagctgaaaagcgaacgctcaaaagtgaaaaagaaagcgctcaaaaccattaaacacggaaaaatcaacagggaatatgagcaagtgttttccggcttctccatgaaactcccggcaaatgaaattccgaaactgctgagtgatcaggatgtcaaagcggtttatccgaacgtcacctatcataccgatcaactgaaagataaagacatcaccctatctaaggatgccgtgtctccgcagatggatgacagcgcgccttatataggggcaaatgacgcgtggaagctcggctatacggggaaaggcgtcaaggttgccattattgacaccggtgtcgaatataaacaccctgacttaaagaaaaatttcggacaatataaaggatacgattttgtggataacgattacgatcctgaagaaacgccgtccggtgatccgagaggcgcgtcgactgaccacggaacccatgtcgcgggcacggtagcggcaaacggaacgattaaaggcgtagcgccggatgctacactccttgcctaccgtgtgctcggtccgggcggaagcggaacaacggagaacgtcatcgccggtattgaacgcgccgtacaggacggagcggatgtcatgaacctttctctcggcaattctgtgaataacccagactgggcgacaagcacggcgcttgactgggcgatgtcagaaggcgtcacggccgttacatcaaacggaaacagcgggccgaacaattggaccgtcggctctccgggagcgtccagagaagctatctccgtcggagcgacacagctgccgctgaacgagtacgccgtctccttcggttcctattcctcagcgaaagtaatggggtacaacaaagaagatgacataaaagcactgaataaaaaagaaacagagctcatagaggcgggtatcggcgagcaaaaggattttgaaggcaaagatctgaaaggaaaagtcgcggtcgtcaaacggggcagcatcgcctttgtggataaagcagacaacgccaaaaaagcgggcgcgatcggtatggttgtgtataacaatgccccgggagaaattgaagccaacgtaccgggcatgtccgtgccgacggttaagctttcatcagaagacggcgaaaaactcgtcagccaattaaaagcgggcggcacaaaagcgacattccatttatccgtggctaaatcgctcactgaacaaatggcagacttttcgtcacgcggtccggttatggacacgtggatgattaaacctgacgtctccgctcccggcgtaaacatcgtcagcaccattccgacccatgatccggccgacccgtacggctacggatcgaagcagggaacgagcatggcttccccgcatgtagccggcgcagctgccgtcatcaagcaggccaaaccgaaatggagcccggaacaaataaaagccgctcttatgaacacggcggaaaccttaacggacgcggacggtgacgtatacccgcataatgcgcaaggcgccggaagcatcagaatcatgaaggcgatcaaagcagactcccttgtcgccccgggaagttattcttacggaacgtttatgaaagacaaaggcaatgaaacgaaaaaagaaacctttacgattgaaaaccaatcgtccatcagaaaatcatatcagctcgagtactctttcaacggcacgggcattaccgtttcgggcacagaccgggtcgtgatccccgctcatcaaaccggaaaggtcaatgcgaaagtaaaggtcaatgccaaaaaagtaaaggcaggcacctatgagggaaccgtcacagtgcgtgaaggcggaaaaacagtcgcaaaagtgccgacgctgctgattgtaaaagagccggactatccgcgcgtaacgtcaatcgacgtacaggacggcacaacgcagggaacctaccaaattgaaacctatcttccggctggagccgaagagcttgccttccttgtatatgacagtaatcttgactttgtcggccaagccggcatctacaaaaagcaggataaaggctatcaatatttcgactggaacggcaaagtcaatggtgacaccgcactgccggcaggagaatattatatgctggcctatgccgcgaacaaagggaaatcaagccaggtgctgactgaaaaaccttttatcattgaataaccgaacaaccctgctggagcatcagcagggtttctttctgattaatcggcaaaagcttctcgaagcagacggtatgactgaagtttatcttcaaaatgatgagtaatggttacagccatcacttcttctgttccgtatgctttactgagagccagaatctgttctttcacttgctgcttcgttccgatgatcatccgattccgattatcggcaattcgtctttgttcatacggtgtatacgtattgccgcggacggtttcgtaagacggtacgccgtgaagcggaatcccctgttcacccgcaagcagcgtataatccatgacagccgcgagttcctccgctttctcctccgtatccgcgcacagcacaaacaccgccacggccgtttttggttctttacctaatgcagaaggtttaaatctgcgcttatattgtgctgtcgtgctttctccgccttctccattaataaaatgggcaaacatatagcctgctcccatttctgcgctcagaaacgcgctttctcccgaagaaccgagaagccagacttccggcgccgtcttaataaggggtgatgcggtcagattcggaaaacggtgattgtcatcagctgcatcatgcaaatacatcgccagctcacgaagctgctgcggatattgatcagcattacgcttcccgccgtcattcagcgcccatgatgcgatcggcattccgcccggcgctctccctaatccgagatcgattctgcccggcgtcaacccttcgagcacgcggaaattctccgccactttatatgcgctgtaatgcggaagcatcacaccgcctgatcctacccgaatgtcattcgttttcgccgcaatatggctgatcagcacttcagggcttgagcccgccaaccgctctgaaaaatgatgctctgacacccaaaacctcttatatccgagcttttccgcctcctgcgccaatcttactgtattccgcagtgcactttccgcagaacacccttctgatacaggagattgatccaatatacttaatgaaatcatcactgtcacctcatcaacatcgtaccactgctaagccgttttttctttctgtatgcttatcagcatccctgatgataaacatttatataccttgttccattttgtcgaaatatgttacacgtgaaacataaaaaaacctctcccggtcaggagaggttttttcttaattcttttgaaaacctttatcttttacatattgatttaaataggttctcggtttttgtttcatgaactgcaggatttgatcagaccacgtttcaacccgcttgccgtttgtccgtttatcataataatcggaaatggtttcatcatattccttcatataactgcggaagttttcttcattcgtatcgtacgtgttttcatgatatacggcttgtttcggcaggcgcggcttttgaccggacggatgagcgggatgaccgactaccaagccgaacagcggcagcacatggtcaggtgtaccaagcacttctgtcacctgatcaagttcatttcgaatgcctccgatataacaaatgccgagtcccattgattccgcggcaacacttacgttttgtgcggcaagtgcggcatcaatgatgctgaccataaacatttccgtattctcaagaagctcggtaatgttttctcctttttcctcagcaagttttttatggcggtacaaatcagcgcaaaacacaaacaagtgcccgttattttcgacgtaaggctggtttccggccagtgccgccagcttccgctttttctccttatcggttacgccgatgatggagtaagcctgcacgtaactggacgttgacgccgcctgggcgcttttcactaatgtatctatctcttctgctgtcagaagctcgtcagtaaatgatcggatcgaccgatgattaagtatggtttcgatggtattgttcatatataaagcctccttctctatatatcatatccgaaagagtatcatgccaaaagcgaaatgctctaaacaaaaaaagacagcccgaaaaacgagccgtctcacattaagaattgaacaagtagcttttatatttcgtcagctgcacacttgcgttatatacgatcccgaagctgattaatgtagaaagcaccgagctccccccatagctgacaaacagcagcggaataccggtaaccggcataatgccgatattcatcccgatgttctggaaggtgtgaatcacgataagtgcagtaaatcctacgcaaaaaaacgcaccaaatcggttaaacgcatgcaagcggtcaatcagcaccacaagcctgtaaattaaaaagaaaaacatgacaaccgcaatggcgcagcctaaaaatccaaaactttcacccaaaatcgcaaagataaagtcggtctgtccctcaggtacgtacactttcagattatgaacgccgtttccggtaatgccgcccgatccgatcgccataacggcctgatccacctgccagcttttatcgctctcggcctgagtcgttgccgcactggagtcagacatccacgatgtaatccggttaatttgataatccgcaataccgatcgaattcgccacatggggaaattcaattacaagcactaagaataggccaagcacaagcgcggccgaaccgccgatgatggtgatcagcttccagtttacacctgacataaacaccatcaccataacgataaacagacagatcgcacccgttccggcatcctgcaaaacgatcatcccaattggaataaccgtccatgccgcaattttcaaaagcagattgacatcttcccgaagtgatctttgatctttcgggcccgccttcgatataatggacgcgaccatcatcataattcctattttcgtaaactcagagggctggagggtaaagttgccgatttgaaaccagctcttcgctccgtttttgatcggcgcgatggattccggcgccacacgcaaaaggagcagcgacagcacgccggcaatcaatacatacagactcagtttctcaagctgctctaaatcaaagtacagcaataatccgatgaatcccgcacctataacatagaagacaatctgtttcatccaggcactgcctccatactgcccgaactgtccggccgcataaatcgccgcaacactaattattaaaaacacaccaaatataaaaatcaaatccccctgataatagggattttgctgtttcttatatcgactcattctatcccgccttacattttcatcggaagtcactattgtttattatacatgaacaccgttcaagaaaacatgatgaggttgcttcctttttattttttacggtttggggactacacgacatatgacgtgtcagaaaaggaaatgtttcggtcatgatgaaacttttccgataaaaaaccccttctcgtcagaaaaggggtttcagtctatgtttaacgtcataaacaagctgttcgggtcctctttataatgtgcaaacggatcacaatattgaaaccctgctttttcatacaggcgtctggcggggagaaaagcctccatagaaccggtttctaagctgatccgctgatagccccgccgccttgcttcttcaagcatatggcggaggatccggttggctgcgccttttctgacatgatgcggagccgttttcattgatttgatctcaccgtgccggctgtttagctccattaaggcgccgcagccgagcaggacgccgttttccctcgcactccaaaacgtaacgtcaggctgacgcagccggtccgcattgagcgcgtgtatactttccgggggagaatgcatggtcatgctcttcagatgctcctgcaaaagcgcaatgacgtccggcgctgtgacatcgtcttttgttatgtccacttcaaaaccaccctcgctgtgcatgttttctttgaacatagcaaaggttcacagcctgcgccattcccttgtccggaaatgtgacagggtatttgacctttccggtttcttgtacctatccaaaaatgaggcaatagttgcaatacatttctcgataaagcggtatcaaaaattggaaaacatggtataataattgtaacaaaatgttcaaaaaacgaccacaaaacagacacattttattctctgtatttcattttggaaacgctcccataaaatgaaaggagacatgtaagatggacatgttttttgcttatttactggtcgcaagcgcaacacccctctttatctggctggataacaaaaaagtcgctctttcggccataccgccaattattctcatgtgggttttcttctacttttacgcaaccagcagcctgtcccctctcggccacacactcatgatcatcctgtttgccgtcaacgtcatcgttgcccatatcgccgcctttatcatttacggccttccgcgcctgcgccggagaagaagccaataaaggcacaaaaaaccctcttcgcctgaacgaagagggtttctttttattcctgatgttcggaatgttgcttcgcaccgccaggagggtttccatccatatggtcaccgtgatggtagtgcgccgcaaagatccagatggaaccaaggatgataacaatcgctccgaaaaatccgaagagcgtgtttccgacttgaatcccgccgttttcgctttctgtcatgtgcatgaacatgagaagctgaagaccggcttggataaatgcgaatccgaaaatgatccacagttttgctgatgagcttaaatccgtatataccgcaacccaaagggccagcagggtcagaataatagacaacgcaaaacctacgatatgcttccacggaaagtggctgtgttcagcagatttgtttgccatattatagtccccccaatccgatgagatagacgcctgtaaagatgaagatccaaacaacgtctaagaagtgccagtataaacttgagataaagatttttgaagacgtctgcggcgttaatccgcgtttcttcaattgcagtaagatgccggcaatccagaagataccgatcgttacgtgcgttccgtgcgttcccagaaggacgaagaatccagaccagaaagcacttgtaccgagagatgctccttcatgtacatagtggatgaactcgttaagctcacatccgacgaagcccgcaccgagaagaagcgtaatgatcgtccaaatgacgacgccttttaaacttccgcgacgcatttcatgaacagcgatcccgcaggtgaaactgctgatcagaagcaggaatgtcatgatcatgacaagcttcacttcaaataattcagccggtaagactcctcctgctgttcttctttgaagaacgaagaaggttgcaaatagtgttgagaacaacacaatctctgcccctaaaaagatccaaaacccgagaatattgagtctgccggtttcagattgatattccataggcgcgttagaattgccgtgttctgcatgttccataaatcacgcctcctttattcggaaatctttctttccgtctcttttatttcttcaacaggtatatagtagccattgtcatattcaaatgaacgaagcaccatgcaaagcagaatgccgatcaagccgacaatgcccatccagaaccattcaaatacaagtccgaagccagcaataccgaacgccactgacataataagcggtcttccggagttgtgcggcatatggattttcttgaacttgctttccggatgaatatccgttttgtcttctttcaattgcaggtacgcatcttgagatttcacttctggaagcaccgcaaagttgtaatgcggcggaatcgcagatgaagtcgcccactcaagcgtacgtcccacgccccatgaatctccgctgatctcgcgagtagagtagcggaagctgtagtagatgttgtagcaaaggattaagaatccgacacccatcatgaaggctccgacagttgaaataaagttcaatgcagtccatccgtcattcggtccgtaagtgtaaatacggcgaggcataccttgcagccccaagaagtattgagggaagaaacatacattaaatccgatcataaagatccagaagaaccattttccgattctttcgttcagcttgtggccgaacattttcggataccagaaaataaatcctgcgaaacatgcaaataccgtacccgcgatcagcacatagtggaagtgagatacgaggaagtacgtattatggtattgataatccgctgcagccatcgcaagcataacccctgttaccccgccgacaacgaagttcgggatgaacgcaagcgcccacagcatcggtgttgtaaaactgatccggcctttatacatcgtaaagagccagttaaagattttaaccccggtcggaaccgaaatcgccatcgttgtaatcgagaagaaagagttaacggacgcactgttccccattgtgaagaagtggtgagtccatacaaggaaactcaggacggaaatggcgataattgagccgaccatcgctttgtaaccgaataactgctttcttgcaaacgctgaaataatttcagagaaaataccgaatgccggtaagataacgatatatacttcagggtgtccccaaatccagaacaagttagcccaaagcatcggcataccgccggcttccagcgtgaaaaagtgagcgccgaacaaacggtcaaatgataacagcgccaatgccactgtcaaaacagggaaggcgaatacgataataaccattgtaatcagcgtcgtccatgtgaacatcggcatacgcatcagcgtcatgccttttgtacgcattttcaggatcgtcaccataaagttgatacccgtcatcagcgtaccgataccggcaatctgaagaccgagcaggtagaagttctcaccaggcccgggactcatgtcgttgcttgccagcggcatgtaactcgtccatcctgcgttcggagaacctccgataacgaaagaaatattgaaaagcatcgcacctacgaagaacgtccagaaactcaggttgttcaagtaagggaatgctacgtcgcgcgcaccgatctgcaaaggtacgacaacgttgatcagaccgattaaaaacggcatcgccatgaagataatcatgatcgtaccgtgagtcgtaaagatctcattatagtggtttgagtctaaaaaactgttattaggaagcgctaactgggcgcgcatcatcaagccgtcgaccccgccgcggaacagcatgataacagcagagataatgtacatgattccaagtttcttatggtctacagacgtcagccattcagaccagagccatttccactttttgaagtatgtgagtacaacgatgatagcgatagtggaaagcgcaatggaaacttgtgcgcccagaattaatgggtcacctgttacaaaaaattcatcccatctcaatttcattcgggcttcctcctttcttgttcaatttcaatcttgtttatcgtcggatactttaaattcgtttttctttacatcttcccacgggtctgttttagagtgcggtgatacggctttgtagccaaggcgtttgcgcgcctccatcgcatattcggcatcttggccgtggtcaacgtattttaagtgtgtagaagagaacgttaattttccgacattctccggaagcatcagttcgtcatacttctctttcgtcagctttggagaatcgctttgggcttttttcacccagctgttaaagtctttttgcgtaacagcttttacgttgaatttctggtcggcaaagtgttcgccggtgaagttcgcgttgcggccttcatatgttcccactttgtcagcctgtaagtattgatccatcagcattcccgccatcgcgtatttttgtcccccaagctgaggaatccatagcgatgccattgaatctgctgaagaaattttaaataaaaccggacggtctacaggaatgttcaggtagttaaccgtctcaatatcctgctcagggtagctgaatacccatttccagtctaccgaagtagcataaacaacaagaggctctttatcctttgtcgcttcaggcgctttttctaacgaatatatcgtctgtacggtaggcacagaaagtgcaataacaattaaaattgggatcactgtccagactacttctaagaacgtgttgccgtgcatctcgggcttgtaatttccgctgtctttgcctttgcggtcgcggtatttcactaaaatgattgtaaatagtacgaatacgacgccgacaatgaacagcataaatccgattgacaagagaatcagatctttctgctggtctgctacaggtcctttcggatctaaaacggaaatgtcgctgcatccgcccagtacgaaaacaacagccaacatcgctaataaaagtaacggtttaaatgctctgaacaagaagatcaccatccttcctattgatgtagtgaatctgaaatgtactttctcaaaatcttttctctatctaccttgttatgctatcaaaatctgcccttattagctttatttttttctaaagttcatctttttttcgacctaatgtcacaaaatcgtcaaaaaatgcatgagctttttccacttgcgtaaatcaaacataaaaagttttagatcatttagcatatatagagaaaaaagatagcgagaacgaataataccaaataaaggtttaccataataaaaatcgctggtcaacaaaaagtttcattttgttaaacattctacaaaagaaatattttttcctttgctcacaccttttcacacggtttccattttaacgcaacgcattgtgaaaaaaaagaccggaacgcgccttgatatgttcattataaaaaacgcattcatatgtttaatatggacaaaacgaaggaaacatataggcataaataataaaaaataggaagtgatatttatgggttttatcgtatctctgattgtcgctattattatcggctggatcggaagtttatttgtaaaaggcagtatgcccgggggaatcatcgggtcaatgatcgccggtctgatcggcgcatggatcgggcacggactgctcggcacatgggggcctcaccttgccggctttgccatcattccggcaatcatcggagctgcgatcgtggtattcttattcagcctgatcgccagaagcagaggataaaaaaaagcctcgtcccttatgggatggggcttttttccggtagagcgcccaaatggcggataaaccgccggaaagccgctctgccttcttctgtctgtttaaagacgccggcatgctccagtatccgcgcaaaggcatggccgatttcctctttcagaatctgttccgcgttttctttcgttaccttccgcttatgcagcacactgagcgcccaatctttatgctttgccgcagaagggtctgccgttaagaccgcctccgggtccggtgagcacagcgcttcagccgtgtatttcatttcttgttcaaggcggcccggcagaatcgcaagccccattacctcaatcagtccgatattttcttttttcaggtgatgaacttcctgatggggatgaaaaattcccagcggatgctcatcagaggtgcggttatttctgaggacgagatctaattcgaataaaccgtttctccgccgggcaatcggcgtaattgtattgtgcggtgtttctcctgaacaggcgaggagatcagccgcctcatcggaataaccgcgccatgcccgcaggatggcatccgccgcgccggaaagctcagacgcgcactcactctgcaggcggatgaccgacatcggccacttcacaattcccagcaccgttttcggatagtcaggcagcctgtaccagctttctgtctccgccagcgccatcgggaattcataatggcccccctgaaaatggtcgtggcttaaaatactgccgccgacgatcggcagatcagcattggaaccgagaaaataatgaggatactggctgacgaacgacagcagccggtcaaacgtttttttgctgatcttcatcggttcgtgccggtctttcaaaacgatgcaatgctcccggtaatacacatacggagaaaattgcagaaaccactgctcatcgccgagaatgaccggaatgacacgaaggttttgacgcgccgggtgatccggtctcccctcgtacccgacattttctttacaaagaacacatcccggataatcggattgaggctgctctttggcagcggcaattgctttcggatctttttccggttttgaaaggttgatcgtgatgtccagctttccgtaagccgtctcagccgtccatccgacattccgctgtattctgtccgaacggatataatacacatcctctgaaaatcggtaaaacgcctttgtcgcctgctccggcccgtgcaccgcctttgtttcttcaaaacgacgcacaatctcggacggctgcggggcaaagcagcccatgatcttcgcgctcagcaggtcgcgataggtgtctgtatcggctgcaatccggcccgtttctgccgcccattcataaatcggggccaatatgtccggcaatgatgccgccgattcattttctttctgttctgaagcctccggatgggtaatatgcaaagtttcatataaacggtttcttgtatattcaatatcaagaaatgaaatcagctctttttgcaatccgtactggattaaacgttccacgtgccgctcaattgccatcgtcatccccctttagttctctcgctccggcgccgatatccgccgtgtaaaagtcagcttttctctctgtcttctcctcatagcggcccccgttagctctccgatgagattcactctgccgggcgcaaagaaaaagcgcaggtctcggattccccgaatacatcagcaaacgctttctttattttgcgcttcaaacgcatccccttccaccattacactttccccccgggacgcggaaagaaacggttatgacacgccctcttctttcgcttttctgaagacaatccacttgctggccgcatagttgacgactacaataatgacgttatcggcgattttcgccaatgtttcgttcatatgaaattgactgaccagaagaatcatcatggcgagatcgatggcgagagacagtacccgcacgctgaaaaaggccgttaattctttcatcagactccgcatccccgcggtcttttgctgaaagacataccgtttattcgtaacataagcaaatagaacggacagaatccaagcggcgacagtcgccgccttgtaatccatctcaaatgccgacgtcagaatgtaaaaactgacgatattcacgatggtcgtgaatatccccataatgatatacatcataatttctctgtagcgcatggcagttcctcgctttctgaaagacttttctaaaccttttgtcaaatcaagaagaacgttaccctgattttctggtgctgacaaaaacatagagcgcgtcaaacatgctgcggaaagtaaccggccttcccagcacattggattgcttaatcaccccgtcgatgagcgcgcacatcatgttagcggtatgctcggtatctatatggtcttctattaaatttctcgatttgagccaatttatgtacatggtgctttcttctatccataacttatacaggcggatataagcttcatattcactgacgactttgtaagtaggcatatgaacggcaaaagacacaacattccaggcaggcttgctgtttacaaaccgcatcaacaggctggccgcgctggccgcggcttcacaaagcgtcaacggccgctctgtttgcttttctaattcgtcgagatagccagtgatgatcctttttttaatctgacgcctctctaacaaatgcttcagaaaatcttccttgctttcaaaatgaacgtaaaacgcccctttgctgaaacccgccgctttactgatgtcatcgattgagactgaatcgtaagctctttcaatcaggagatgaaggcctgcgtcaataaaactttcaaatgtttcttctctcttaatttgaaatttgttttttttcattttttaccccagctgtttgatcattcactttatcttacaccgaatcattcttttgcggtattttttatgcaaaaagaatatgctaatcgacgttttgagggtaaatgttaataggtcatatggtttatttttatttgcatactatccagtcagtatttatttgtttattattatatgtaagaattcttgaaggattttggttatttcagtcattttcttagggaataggtaggtgaattcatcttcaatttgggattaccggccaactatgtgtgatatttgttatacattggctgctgtagctgggcaaatcaatttttcaattggaggttcttatgaaaactcatgtaatgaaagatatagatcaagattggcaattgttaattcaagaggctagaatcatgggtttgcacattgacgatgtgaggcgcttcttaaatactgaaaaagcggtgaagaaaaaaacaccaatgaaaaacaccatccgccagcggtaagattacaggcggatccttttactatatgacctgccacagtccgcccgcacccgagttttcaaaggaacacccgcaataagaggggaatcagagaacaaaccgtataccggacaaccattcccgtccgcattccgcaattgaacagccaaacatggtgatatgagatcccccgctgcatatcttgtgtattatgcccatttatgaggtgatacacagatggatacgaatccctattatgatgaaaaacaacagaactactacgaaggcctgaatccttatttattgaacaaaatagacgaaaactggcggacagtgcttgatgtcggctgcggcacgggcaatttaggagcggcgatcgaagaccgcggaataacggtttacggcattgaagcgtatcccgaagccgcaaaaaaggcggaaagcaaattgagccacgtgctttgcggcgacattgaatccgccattcttccgtacgaatcagagcaattcgactgcatgctgttcggagacgttcttgagcatcttgtcgacccgtggacagtgctgaaaaagcttcgtccttatgtaaaaaaagacggcactgtgcttgcatgcataccgaatgtcggccacatctcagtcgtgttggagcttttagccggcaaatggacttacagtgacgccggattaatggatcagacccacctgcgtttttttacccgggaagagactctttcattatttaaagccgccagctatgaggtcaaacgcattgaggcgatccgcgttgatcacccttcttaccacaaagccatcgcatcattgcacgaagtatgcgtacagcttggcataaggcatgactttatgacagaagcatcggcctatcaatatgtgattgaggccgagaggagcatgtaatggattcacattcatttctgtttgtcgtctgtgtgaatgatgagtcgctgtactcccggtgcaagagccatatcatgcagcttaccgtccccccttcatactccgttgatatcatgccgatatacgattcagcaagcatggcctcgtcctacaacaaagcgctgaaacacccctccaaatataaaatttatctgcatcaggatacttttatcattcatcagcatttccttcatgacatgcttcatatctttcaatctcatcaggagctcggccttctcggtgtcgccggctgcaaaaccctgccgccgaacggcatttggtgggaaagcggacagcggatgggaaaagtgattgaataccgggggaatgcttatcacccgctggattttgagcacggtgatgaagacggcctgtttacgcccgctgacgccattgacggcttgttaatggcggctcaatatgacgtggagtggcgggaggatttgtttcgcggctttcatttttacgacacatcacagtcgctcgaatttcaaaaacacggctatcaagtcggcgtcgcctgccagaaagacccttggtgccttcatttttgcggcgactcctttgacgccgcggcatatgaagcggacagacaaacatttgtcaaacactatatggcaaagccctctcgctgatcgagagggcttttttcgggttaacgtttattcagttcccgctcaatgatttgttcaaaggtttcctttcccgccgcgccagggattctctcatcgccgatgataaacgtcggcactgccgtaatgccggcttcctcataagcatggcggagcgcttcccgctgtacgtccttgtacgctcttgtctcaagcgcctctttgaaggcagcgccgtcaagtccggcttcttccgcaagctttgtcagcacgccaacgtcaccgatattttgttcttcctgaaagaacgcctgaaaaacgcgtgtatggtattcgcttcctttcccgtgttcctttgcgaaatgaaagccttcaaatgccaaatccgtgtatggatgcggtgacacgcgggggaacgtgatttcaacgcctaacgactgcgccatcggctcaatggagtttttccacatctgccgcttggcgggatcattcaccggatcaagtttcggcgaggggctcggacgcaattcaaacggcatccattccacctgtacgtccttgtccttgattgcttcttcaaacgccgctttgccgacatagcaaaacggacatacataatcagaatatactttaatctgcagtgtcattgtaagtctcctttccttatcattttaagttgtaacttttatagttacaagtgttttttttaaaaaaaacaccctccatatggaaggtgtcacgattccagcagcctttgggcgatatattctccttttttacagccgccgggacaggcgaataaggaagagccgatcgtttgtgtgtattcattcagcgcatcctttgccgccaaagccttcagcatcgggacaaattggcggtccgggtctttttgaaagcagataaacaacaggcctgcgtcaacatagcccgtcttcggatcaattccgtccgtataggaaaatgcccggcgcagaatctgtctgccggttgattttgccacgctgacatgcgagtcggcgggaatttgattcagcttcacgggatcggtttcctttttttgtccgaaaggcgcgcccgagcttttcacccgcccgaacgtgtcctcttgttccttcaaggatgaacggtcccatatatctaaaaacatcttaattttcctaaacgccatgtacgtgccgcccgtcatccagtccggctctcctgattgaacccaaacgatcgaattcatcaggttttcatccttcgtgctttggttgccggtgccgtctttgaatccgaagaggttgcgcggtgtttctccgttttttccgccgcttaagaaacctttattgagaaagcggacttcacacacacccgatgcctgtttcatcaggttgcgcaccgcgtgaaacgccgtttgttcattatccgcgcagacctgtatgacgatatcaccgccgccttgtttcttatcgagcttgtcgttaggcatcggcggaatatcggcgaggtgcttcggttttttatctttcagtccgaagcggtccttcccgtctttctcgaaaaacccggggccgaagccgaaggtaacggtcaaattcgccggtgccagatcctgcgactccccggtatcctgcggaggcatatatttatttttctgttcgcctgacgggacggcgcctgaagtcagcagctgcgtcaagcttgtccattgtttgaaaagggagatgacatcggctttgtcgcttgacatgacatcaagcgccgcaaaatacacatacgtctgatgcgccgttgtgattcctgcttggtgctttccgtaaaaaggaacgatttgatcacgatcacgtttttcatcattcttctttgaagcggtggccgccggtttgaagagcggcgcgagtcctccgaggccgctcgctccgacagcgacggctgcgcccgcgacggcgccccacttcaggacatcccgtctgtggatctgtttttccttgttatgttcatcgctcatgctgtgtcttaactccttttaaagcacatcggcaatcttcgacatggtttcagaaagggccgtcagcttcgtgcttatctctctgatttgatctgtacttaatgtatcacaagacgtatacattgatcgcacgttttgtatttcgacatcaaaacttcaaattcgctgaattccgcattaagtttttccgtgacctcgaaatggtctctcacttcgcgctattcactgttttatagagggcttttgagcctgcgctgattggttcaggcgtcactttgagagaagcgatagagccgtcaaacgcttcggtcgatattgcaagcttgattgctctgttcttgacatacggcttctattctcccagtccgtcacgcctttttgcgcacacagaaaaagggccgccctatcgggacagccctgctttggagcgccgaatttcctctgaaaacttccgcgccgccgcttttggatcttcggcttggctgatggcactgatcatgctgacgccgtctgcacccgcttcaatgacgggcgccgcgttgtcagccgtaatgccgccgattcctacaatcggaatggtgatgccctgacgccgtacctcttcaatcaatgtaactccctgcacggcttcagcatctttttttgtttcggtcggatagaccgggcccattccgacgtaatcggctccggcttcttccgcccgcttcacctcggagacgttatgtgctgacacaccgagaatcatatcgccgattgccgctctcgtttcttcggcgtctgcgtcatcctgtccgatatgcactccgtccgcctcaaggcgcaaggccaattcggcatcatcattaatgatgaaaggaatcccggcctgcctgcagacatcctgcacccgcttcgcgaacaggacacgttcatcccctgttaaagaaccgctccccttttcccgaaattgaaaaagcgtagcgccgccctcaattgcttttttcaccacggaaaccgggtctgcgcttgtattgtttgatcccataataaaataaaccgataacatattcttcatcatttcccgagaaatacgcgtcatttttctatcaccctttcaattgcggcaagctcagccgcttcttgttctgagatgcttgccagcttgtttaaaagctcaatctggaagctgcccggccccttatgggaggtgtccaaagcggcaagctgagcggcgcttccgtatacagaaacggctgaaacggccgcttgcagaacgtcctgccccgctgcgcagaaggctccgattacagacgtcagcaggcatcccgcccccgtcaccttcgtcagcagtttatcaccgttttgtacggcgtatgtgtcggtgccgtcggagatgacgtcggtttttccggtaatcgcaatgaccgtcttcagcccgcttgcagccgtcttagcgagctgaaccacatctcctccggcttcccccgcatccacgccttttatcttccaatcaggggcgccggcaatattggcaatttccgcggcatttccgcgaataacggacaagcggacctcctgtatgatcttgcgggctgatgccgtccgaaacggcgtggcgccggcgcctaccggatcaaaaatgaccggaacaccgttttcattggccgattttccggctgcgatcatagcttcaaccgatgccgagctgagggtgcctatgttcaggacgagcgctccggcgattttcgccatgtcggcggcctcctcaattgcataagccataacgggcgatgcgccgagcgcgagcagtccgttagcggtgaagttcgtgacgacattattggtgatactgtgaacgagcgggttttgatcccgcactttactcaagtgttgagctgcggtttgtgcgtccatgcttaatcatccttttttctctttttcggattccataaatacgatttcgtatgctccagccaggctctggcggcaaaggacatatagcggtccttccgccaaatgatggctaaatgccacggaatgaccggatgaacgagcggaatggttctgactttgtcaggatcaagaccgcgacagattctttccggcagcaggccgataccgagattggcggataccatttcgctgataaagtcccactgtgatgtttcataaatgacatgcggcctgaatccggctttcacgcattccgtcataattcgattatgaaggacaaaatcctccctgaaaaatatgaacggctcttctttcaattcatgaagactgcattctttctcgtcagcgagccgatgtgacggatggacgacaagcataagggtttccttgacgattgtgaaggtatgaaaaatctcttcattcgcgggaagcacgacgaccccgatatcaagcgagccgtcctccaccccttgctgcactttaatagagccgtcctcaacaagctgaaacgtcacatcggggtatgtgacgcggaagtcaccgagcactctcgggaaaaagccggacccgatcatcggcggaagaccgatgcggacgtgccctttcttcacttccataatatcgttcagctctgacgtcaggttttggaatgactttgtgatttcctgcgcctgcacatacatgctctgtccggcgtcagtcagttcaacttgccggccattgcggtaaaacagtttaatgccgagctccgtctccaggtttttaatcatttttgagattgtcggctgtgaaacatacagagactgtgaagccttcgtaaagcttttcaaacgggccacttccaagaaatacgttaagtgccggatatccattacatttcatcctttctatagacaaaaggaatacacattattctttatatgtattttacctatagcaaaaccttctgtacaatataaatataagggaggcatcattatgaaaaaattgctgcttaccgttattcaaatcgctctgctgtttatatttgcgcgtctgatcaattggatcacggcggctcttcatataaatattcccggcagtataatcgggattgtgattcttttcacattattgcatttcaagattatcaaacttgaatggattgagcttggcgcagcatggctcctcggtgagctgctgctgtttttcatcccgtctgccgtcggagtgattgaatacggagatattatgtctaaattcggcgtaagcattttacttgtcgtcgtcatcagcacatttgtcgtgatggtttcaacaggtacgcttacacagctgatagcaaaaagaaaggagaaaaaacaaacgtgttcatcggaatcataagtttattcttaactgtcttagtatatttgggcgcgaaaaaactctacattcgttttccgcgggtgtatacgtcgccgcttctgattacgcccgctgttttggtcgtactgctgcttcttgtcaatgtcccgtatcagacatacaatctcggcggcggactgctgaccgatatgcttcagccggcaacagtggcgttcgccatcccgctttataaatatttcccgattttaaagaaatacgccgtggaaattattttgaacgtagcggtcggttcatgtatcgccattctgtcaacagcctttatcgcaaaatggttcaatctcggcagcagcttagtcgacagtctcgtgccgcgatccgtgacgacgccgattgccatgaacgtttcagaaatgatcggcgggatgccggccgttacagcggttttcgtcattttaacggctttattgggaacgatcatcgggccgatggtcatccgctatttccgcattgataacgaaattgcccggggcgtgctgctcggaactagcgcgcacggagcgggaacatctaaagcatttgagctcagctccgtatcaggaacgatctcaagcgtgtccatgattctcgccgcgattatgacactgtgcgcggccccgattttgctttcgtttatgtcataaaagactgctccttacagagcggtctttttttagttgccatgaagaattgatttgtctgtccttcataaaaagacgaaaacacgatatgataagacatgaagtgaaaagactgaagaacggatgtgtcatatgaacggccagcagcgaagcagcatcagaaaaggacttgaagtcgatatcgtcctgaaagccgatcagcgttcaggaaagctgacaagaggaatcgtgaaggatattttgacgaactcaagcttccacccgcgcggcattaaggtccgccttgaagacgggcgaatcggccgggtgcagcacattattgaatagaaaaaagccggagcttcacgcccggcttttttttctttaatttcagcaatgaaatcctcatatgttctccctttatatacaaaaaatttttaaccaactattgactcttacgttgcgtaatactttagagtagccattaaggaggcggcaaacgtaatgggtatgaaagtaaaagaagtagctgacctgattggagtaagcatacgcactctccatcattacgatcaaattggattattgactcctcaggaaacgaccgattccggttatcggctttattctgaagagaatcttgaacagctgcagcagatactatttttcaaggagctcgatttctccttaaaagagattaaagaaatcattactaatccttcatttaaccgaagggaagcattcattttacaaaagaaaatgttgattgagaaacggaatagagtcaataagatgattgaaaccatcgataaatcaatcaaacatatgatgggagagatttgcatgacgaacaaagagcggtttgagggaattaactttaatgataatctttatgagcaagaagcccgcaaacggtggggtgatcaacctgtcgataaggtaaatattagattgaaaaacatgactgatggtgagcaaaaagatttatctgataagtggactgcaatgttcaataaatttgcactccttattaaccaatctcccgagtccccagacgtacaaacagctatcaaagagtggtttgattttctcaatgaaaattttggtgaatattcttttgatgccttttacggattaggtcaactctatattgaagatgaacgcttcactaagaacatcgaccggtatggtgaagggttggcgaagctcatgagtgatgccattacaatttatatagatactcaaaaaagggtggtgcccattaaaatcattatcgaggatacaattgggcggagggattagtgaggccactttacttggcacagatgagatactaaataatagcgggttttttctttaaacagtaagatatgaagattatttatcccgtattaaagcgatggaagagggttttcttttccccctctttccacgctataaatgatcatcctattttttccgcaagaaaacaaccttcaaatagttcccttctttaaacgccggaatcgttttgaaatcttccggaagcgtgtattcttccaaaatgtcgtaacgctcatttgtttctttaaaggcggtctctataaaacctttaaatttcttcatattgaaggcgctgctgtttgtcgaagcgacgatgatgccgttttttgcggtgatggcgatcgtttccttcagcaggtttttataatctttcgccgcgctgaacgtccgtttttttgtgcgggcgaaagaaggcggatcaaggatgatgaggtcaaacgccagcccttttttctccgcatagccgaagtatttgaaaacatccatgaccttaatgtcatgcgcctcataatcaattccgttggcgctgaactgttcaatcgtttttgcgagactgcggttggcgacatcgacgcttgtcgttttctcagctccgccaagcgccgccgcaacggaaaatgcccccgtataagagaacgtattcagcacccgtctgccgtttgcatacttgtcccgaatcgctttgcgtacatgacgctggtctaagaaaatgcccgtcatcgccccatcgtttaaatccgccgcgtaccgtatgccgttttcttgaacaatgaccggaaaatctcctctttcgcctttgacaaaatcgtcgtcttccacgtattgcccggcagtatcgaatcgtttcttttcatagatcgctttataagaaagctccagtccgtcaatcgcctcaatcatgctgtccttataagcgtaaatgcctttactgtaccattgaatcagcagataaccgtcataaaagtcaatcgtgacgccgccgatgccgtcgccctcaccgttgaaaagccggaacgccgtcgtatcgggcgcgttaaacagatgggctcttgcttcagccgcttttttcagcttgtccagaaagaaacgtccgtcgatccgttcatctctcgcgcgggacagcacccagccgactcctttattctgcaaaccgtaatagccttttccgataaactcacccttctcggatgtcacatcaaaaagatcgccctctgttaaatgagccgagcttccggacagagcgtctttttcaatcagggggaatccttttttcagctttccggcaaatgtatctttcactgtaagtagcttcattgtgcattcctctttcgttttgctttctcttatcgtaccataaaacatgatcaacaccgcattgtcccgaaaaattcaaaacagggggaaaaccatgacagccaaaagaatcgaccatacaggcattatggtcaaagatattgaaacatccatcgccttttaccaagacgttctcggtatgcagttaaaggatcgtatcactcatacgaacggcattattgaacttgcctttctcggctttcaagaagggccggagacagaaattgagctgatccagggctacagcagcgagcttcccgcagaaggaaaagtgcaccatgtcgctttattgactgaagatatcgcagcggagttcacgcatgcgaagcgtcagggcgccgtattcattgatgaagaaatcacgacacttccgaacgggtaccgctacttttacattgaaggacctgacggcgaatggatcgaatttttccagcgttaaaaaaacgggcgaaagcgcccgtttttttttatgtttcttctgtgacgttttgttccgccgcccgttcctctctccatttttgaagatcccaaattcggaaaaacggataataaatgataaatgtaatcaggagattgatcagctgcatgaccgaaccggagatttttccgcccgtcgccaaataaccggaaatcagcggcggcatcgtccacggcacggcgattcccgccggttttgccaccatccccgtgctcatcccgatgtacgtcgccgtaatggtcaagagcggcgcaacaataaaaggcacgattaacagcggattcatgacgagcggcatcccgaaaataatcggttcgttaatgttaaaaatcgcgggcccgatgccgagacggccgagctgtttcatctgtttgcttctggagcgcacaagcatggtcagcacaagggcaagcgtcgctccgcttccgccgacattaatccatatttgaaagaactgtgtcgtaaaaatgctcggcagcgcttctcccgcctgaaaagccaaacggttggcgtccatcgccccgtaccagatcggcgacatgacgccgccgattatggacgcgccgtgtatgccgcacgaccaaagcagcatttgcacgaattcggcgataagacttccgccgagactcccgcccaaaatagacagcggggtgcccagcagatcgcctacgacattgtggagacttttaaaaggagttatttcaataaacagacgggccagccatacaagcgtaataataatgaaaccggggatgagcgcaacgaacgatttgctgaccgcaggcggcactccgtcaggcatcttaatgacgatatttctttgtataataaaccggtacacttccgtagacagcattgcaatgatcatcgcgacaaacagacctttgcttccgagcagcgaaatcggtatgccgcctcccaccataatctctgttgacgagccgtcagggataaacggaatctgatacggcgtcgccaataaaaaggcggcaagggcaatggctcccgacgacagggcatccacctcatagctttccgcaagccggtaagcaatcccaaaggcggcgacaagcgccataatgtcaaaggacgcattcacgggatacccgagcttttcaacccaattttcaccgaaaagaccagccataaaatcggcataaccgggaatcggaagactcgtcagaatcagaaaaaccgatccgatgatgataagcggcatagtcaaaataatgccgtcccgcaaagctcttaagtgcctttggccggcgacttttccggcgacaggcatgattttttcttccatgacccgattgaacgtactcatttatcaaaaaccccctttttgagttcattgcgcagatgtcttaaagcattttctccatcatattttggaaacgcttacatttgcatacagaaattttccttacccctcaggaaaaaaagaattccgcactgccgatatataaagaaaaagggggaatcgcaatgtatcacaccctgaaaccgataatggccgcggccttgtgcatcagcctgttctccgccgcggcgcccgcgcacgccgagacgcatgaccgggacgttatcgtggtgtacaaaaatcaaaacggcaaggaatccgccatagacagcggagcggatgtggaacagacctatcagcatctcccggcagtcgccgtgtcagccgattcgcaaacagtgaaagacctgaaacaggaccctgacatcttatatgtagaagagaatgtatcctttcaggcagcaggcggttctgatatccgcccgttatcagctgcccaaagcagcagttacgtgctgccgcaatgggatatcgaaccgactcaggttaagcaggcgtggaaagaaggcttgacgggaaaaaaggtgaaagtggctgtcattgacagcggcatttaccctcatgatgatctctccattgccggaggctattccgcagtcagctatactccctcatacaaagatgacaacggacacgggacgcatgtcgccggaatcattgcggccaaacatgacggatacggcatcgacggcatcgcgccggatgtccggttatatgcggttaaagcattagacagaaaaggagcgggagatctcaaaagccttcttaaagcgatcgactggtcgatcgccaataaaatggacatcatcaatatgagcctcgggacaaacgcagacagcaaaagtcttcacgacgccgttgacaaagcttacaaaaaaggaatcgtgatcgttgccgccgcaggaaacgacggcaataaaaaacccgtcaattatccgggcgcctacagcagcgtaacggcagtctcagcgtcaactgaaaaaaacgggctcgcagctttttccacgaccggaaaacaaattgagtttgccgcacccggcactaatattacgagcacgtatctgaatcaaatgtacgccacagctgacggcacatctcaagccgcgccgcacgtcaccggcatgttcgcgctgctcaggcagaaatatccggaggaaacaaatacacagctccggcagcagatgcagcagaacgtcaaagatctgggcgctcccggacgtgacagccgattcggctacggactggcgcaatatcacacaaaacaaaagagctttgccgaacgggccgtaataaaagcggaaaagacgaaaaagcaggcagatatcgatgaagcaaaaacggcagtcagcaaactgtccaagtcaaaaggaaaaaccgctctcgaggcgcggatcaataaagttcagacggcaagaaatgtgacggacgcaagagacaaagtccggactgccgaaaaacaaaagaaaaaaaccgccgtcaatgccgcacaaagcgccatccgcaaattaccggccggttcagagaaaaaagggctgcaaaagcggctgaacgctgtcaactcaagccttttgagaactgctgaggccagcgtcaagcaggcggaaaaaaagacttctgaggccaacaccgcaaaagcccaaaaagcagtcagcgaaatccagccgggaaaagaaaaaaccgttctggaaaaacggcttggctggataaaagataaactcaaccggcagcaggcaagggacaaagtaaaaacggcggaaaaaaccaagacgaaaaaagcaaaatcagcggcgcaaacggcagtcagccgattgaagccgtctgccgaaaagaccagcctgcaaaaacgcgtgcgtgcgattcgggtgaaataataaaaaaaacgcttgtgagccggtcaacggcttcacaagcgttttcatcacacctgcctattggttcatggccgggcggtcaatcgtgttccatttcgtaaaggacatatatcggaaataatgatcacgatacgggtgcgaggtgcctgtattccaaggcttgtccccgccgcagaaatggacgatggccggttcggcacgtgtttctctgtaacgtatacggtcgatcagttcaggaggcgttttctcattcatgataatatgcgtctgcgcgttccagcgcggatgcagttcatgccattgatcatataagatcgcgttaagcgcgtcctgatcatgaaacacgagaaaatcctccgagctgttatcattgataaaatcaatcacttttttggaaatattctgttttctccaaggttcgaaatctataatcataataccggaattaaaatacttggcagtgtcgctgatattcatttttttcagtctttcatgctgtccggcatcttctaccgccgcaactattgccggggaaatatccaagtcccataaaaccgaaatatcttccatcacaattgcatcgcaatcgatgtaaatcatccgctttacggactcatccttaattaaatcagggatagaaatgcggtaataagccgcttttgtaatatggctgctttcgactgcatgcttgtattgatcagcgtctacttctaaaaattcaagcggcgtcccgaatgacatcgcagtctgttcaagcttgtccttgttttcggcagtaattccgccgtcgatcacatataatttggcattccttgttttatccatattcatcaataaagaagcgaacatcccacccaaatgacgagcataattatcatcggcacatgatacgatatgcattgtttcattctttcccactgatattcatctccctttttgttgtacaaatgtctttccctttttttaaaaagtaaacctcaatcttacacattttttctgcgggaatgtgctgtttgcgatttgatatctttcgcattctctgttaaaattcatttcatagctaatgattctgacaataataaggagcatgacgccattgacgattcgcaacgatgccggatcagacaataagaagccgaacaggcctttttccgatctatccggccgaaacaaagaggcggcctatattgcagctgcactctatcggtccgcccagcagctccgtgtaaaaatggagaaagaggtgctgtcggcacacaaattatcatggacggcgttttccatcctgtatgacctttgtgaatgggaaacgcttgatacaagaaggatagccgctctatccggaattacctcggcgacggcgagcaatgtcctgaacactttggaaaagaagggcttatgcagcagacaaacgaacaaaagagaccgcaggcttgtattcgtcagtattaccgatgagggcagaaaggttattgaagatctgtaccccgactttcatcagggggaaattgaactgacggcctgtctggataaacaggaacaaaaaacgctgtccgccctgctgcaaaaaatcgctgacaatttcataacatagcagctatgacgggaatcagtaacggattgtctccctgtttcagagagccggcggatggtgcaagccggcacaaagacaaacgtgaattacctccctgagctttctttgtgaacttcagtagcaaagaacgggaaaccgttattcgaatgagcggaagacgtcgtttcgtcttcaatcagggtggtaccgcgtgcatacagccacgtccctttttgggatgcggcttttttgtttggctaaaaaaaggaggatgtaaaagatggaatcaatcactttaacgaatgatcaggaaaaagaagtgcaaaggcagctggatttgtacatgaccggcgccgcggacgtcataccgcctgaagaattgagaaataaaatcgccaaatcagtggcatccggcaagccgctgaacattaaactcggccttgatccgtccgcacccgacgtccacttgggccataccgtcgtgttaaacaaactgcgccaatttcaagaaaacggccatatcatacagcttgttatcggggactttaccggaaaaatcggtgatccgacggggaagtcgcaagccagaaaacagctgactgatgaagaagtccaacacaatgccaaaacctattttgaacagtttggcaaggtgctggatcaagacaaagttgaacttcactgcaactcaaaatggctgaagacattgaatctggaagatgtgattgaattagcggggaaaattactgtcgcccgcctgatggagcgcgacgactttgaggagcgcatcgccatgcaaaaaccgatctcacttcacgaattcttttacccgctgatgcagggttacgattctgtcgttctcgaaagcgatatcgaactcggcggtacggaccagcattttaacgtgctgatgggccgccatttccaagaacgctacaaaaaagaaaagcaggtcgtcatcctcatgccgcttttggaaggtcttgacggcgttgaaaaaatgtctaaatcaaaaaacaactatatcggcattgacgagcatccgaacgacatgtacggcaaaacgatgtcattgccggacagcctgatgaaaacatatatccatttagcgacagacttagagcctgcggagaaaaaacagatggagaaggatttggaatcaggaaagcttcatccgagagatgccaaaatgatcttagcgggtacaatcgtcagaatgtaccacggcacgaaagcggcggatgcggcagagcggcatttcaaacgtgtcttccagcaaaacagcctgcctgaagatatgaaaaccgtcatatgggacggagaaaagaccgtgccccttattgagctgcttgtcacgcttggactcttttcttcaaaaagcgaagcacgccgtatgattcaaaacggcggaatcaaagtgaacggggagaaaacggatgcccttcataccgtcattaccgcagaagacggcatgacgattcaggtgggcaggcgaaaatttgtacagctgcgcataaacggataaacaaccagccggactgcgtataatagcggtccggctggttgtgacgggtcaatcgtttaatcgacttctttcttaatcccaagcatcttttcgtctaaataatgggcgatgtccgccgcttccttcagctcgtcggtcagatgctttgggacttcgttatttaatttgtaataaattttgtgttcaaggctcgcccaaaaatccatggcgatggtgcggatttgaatttccgccttcacatattccacacgattcgtcaaataaacgggaatttcaataatcaaatgcaggctgcggtagccgttcggcttcggatgtttgatataatccttcacctttacgatcttcaggtccttatgctgcttcagaacctcagcgacattataaatatcggaaataaaggaacagataatcctgacacccgcgatatcatgaatatgctctttcatttcctgcgtcgtcacatcgcagcctttgcgcatcagtttattgacgatgctttcaaaacttttcacgcgtgattttgtatgctcgatcgggttatgcccgtgaatcagattatattcctggctgatgatagaaaacttcgtatccagctcatctaaagcgaatttataaactaataattcatttttccaatcttccatgaccgtttttaaatcatccatatgggctgttgacaagtccatttttttcatctccttgctttgctgtccatatatgagacgggtcagtccgcggtcaggttctttacaatatcgtgaagattatgtcataaaaaaaagcaaatgccggttatagcatttgccctttcatttgatcagcggaaataactgatcaggagtccgattgaaagcaggaatccgaagaatgtattggtttgcgccgttgatttcatcgcaataatcatgttcatcggcatttcgtttttcacaaagcctttcacggcctgaacgggtttcggcacgctcaaaaagaccaggaacagccacgggcttgtgtaacccatgatgacaagaccgacgatccagatgtaagcgatggcaaaagatgccgccagtatcataacggcccctctatgccccatcaaaatggccagcgttttacgtccgccttttttatcttcctcaatatcacgaatattgttggacaggttaatcgctccgaccaggatggcgatcgggatggaaatcaaaatgctctgttcattaattctgcctgtctgaatgaaaaaagaaataaggacaaatacagagcccatgcaaatgccggagaacagttccccgaacggtgtatacgcaatcggcagcgggccgcccgtatacagatagccgatcagcatgccggcaaggccgatagccgcaagccaccagctgctgctcatgcagatataaacaccgagcacgagagcaatcgcataagagccgagcgccagctgcagaattgttttcggcttcatgccgtggcggacgatcgctccgccgataccgacggaatcctccgtatctaaaccgcgtttaaaatcgtaatattcattgaataagttcgtggcgatctggatccaaaggcaggaaaacagcatggccaaaaacagcaggaaatcaacctttacgtaaaacatcgccaatacggtgccgagaagtacgggcacaaacgatgccgtcaatgtatgagggcgggttagctgccacaaaatgcggcccatgctttctttctcgggcgtcttttggctgccccccatattgttttgattcattttcctcttcctttctattaaaaggctttcacagtcagccgataacagtagtgttgaattggggttttcacgttttctgctaccttatctatcataataatttcttcctcatttcacaagatgcggcgctttatcagctatcctgccggaaacggcttttcgcccttctcccttggggttcggcacaagcctgcttaagaaaaagccgccaaaatttttttacctcgtttatatttacgataagttaaaaatcccgcctgaacagcgcctttttagtatgatcatttgccaatttatacatgcgtgttttccatccttttgtttctcattcatttttaaggaaattttaagcttaggatattagacatattttgaaactttttgttaatctaatcgtcatatactggtgtaattattgaatacgcggggaaggaattttgaatatgatgcaaaaattaaaacgtgcttatgaaaatacattgatcaaatggacgtttcatacgggcttttattttctgatattagtattgctcttttggatgtatggatttcatacagcgaataccggcacttatatttacaacgatttctaatcggggaggataactatgaaactacttgatgctataaaaacatacgcagacgccaagccgcaggccgaagcgtttcgttccttagatcattccctcacttacggggaattatgggatttgtcggagcgggttgcgtccggcattcaaaaacatacagctgacggttcgaaagcgcctgtcctggtttacggacatatggagccgaatatgattgtttctttcttgggaagcgtcaaagcgggccgcccttacatccctgtcgatgtttccattccggcggagcggatcgtcaaaatcattgaaagctcaggcgcagagctgcttatcagcgtatcgggcgatgcagtcgatacgggaagcaatctgattaaaaccgttacgcccgaagagcttgcagctgacggagatgcagacctcagccgtgagaactgggtaaaagagctggatacgttttacattatttacacgtccggcagcacgggaaatccgaagggcgtgcagatatcggctgataacctgcaaagcttcactgactggatctgcagggattttcctgtgggcggggtaagacattcttaaaccaagctccgttttcttttgatttatctgtcatggacattttcccgtcgcttcaaacgggaggtacgctgcactgcgtaacgaaagacaaaatcaataaaccgaaagtactatttgaagagctggagaaatccaaactgaacgtctggacatcgacgccgtctttcgtccaaatgtgtctgatggaccccggctttacgcaggagctcctgcctgaggcagaagtatttatgttttgcggagaagcgcttccggctgccgtggcacaggaactgttaaaccgttttccgaaggcccgcgtattcaatacatacggcccgactgaaacaacggttgccgtcacctccgttgaaattacgcagcagattatcgatgaaaatgaatctctgcccgtcggttttgcaaaacccgatatgaatatcttcatcatggatgaaaacgggaataagcttccggacggagaaaaaggggaaatcatcatcgccgggccgagcgtgagcaaaggctatctcggtgaaccgtctctgacggaaaaagcgtttttctcaattgacggccagtgggcatatcacacgggtgatgccggttatgttcaggatggtcagattttctgccaaggacgccttgatttccagattaagcttcacggctaccgcatggagctggaggaaatcgaagtacatgtaaggcagtctcaatatgtgcagacggcggttgtcatcccgtatcagcctaacggaccagtcgaatatttaattgccgccatcgtgcctgaaaaacatgattttgaaaaagaattccagctgacaagcgccattaaaaaagaactggccgcttcgcttccggcctacatgattccgagaaaattcatttatcaggatcacattcaaatgactgcgaacggaaaaatcgaccgtaaacgcattggcgaagaggttcttgtatgacgccttacagctcgtttttcttctttatcttacttggaatccttcttttgccgacgattattttagggctgaacggcaagagattccaaggatacaacatgtttatatccatcatcgtattggctttgattttcgcgcatgatctgcacggcgtgatcgcactatgtatctttacgctgtggcaggtgcttttaatcaggggttatctcgcttacagactgaaagccaacagcggctttgtcttcagtatggccgtgatcgcgtccattttacccctgtttttatctaaattatggccgtttttcttcccgccggcgcctcatcatccggttcataacctgatcagtttcttaggaatttcttatttgacatttaaaggcgtccagctgatcatggaaacgagagacggactgattaaagaaaaaatgccgcttcaccgccttttgtactttattatgtttttcccgaccatttcttccggtccgatcgacagataccgcagatttgccaaggacgaacagaaagtatggacaaagggagaatacgctgatttactgtataccggcattcataaaatttttatcggtttcttgtacaaattcattatcggatatgcgattaacacgtatttcattatgaatctgcctcatatcacccacagtaaactgtggggtaatgtgctgtacatgtacggatacagcttgtacctgttttttgattttgcgggttacacgatgtttgccgtcggtgtaagctatatcatgggtatcaaatctccggaaaactttaataagccgtttatcagcaaaaacattaaagacttctggaaccgctggcacatgtccttatccttctggttcagagactacgtatttatgcgctttgtattctggatgacaaagaaaaaatggataaagaaccggatggccgtctcgaacatcgggtatttcctgctgttcatgctgatgggcgtctggcacggactcgccctgcaatatattatatacggcctttaccacgccgtattaatgaccgggtataacttttttgagaaatggaataagaaatacaagtggctgcccgccaatcgttttacggcctttttagccatcgtcatcacattccatttcgtatgtttcggattttatattttctcaggaaaaccatttcatcactaaaggagattgaaaacacatggaatttaaacaggaagtattagacgtattagctgaagtttgtcaggaggacgctgtgaaagaaaatcctgatattgaaatctttgaagaaggactgcttgattctttcggaactgtagaactgcttgtcgccatcgaaaaccgcttcggcattacagtgccgatcactgaatttgaccgtgacgagtggaatacgccaaacaacattgtaaacaaactgactgagttgaagtaaatgaaaaagcgtttctttggaccaattattttagcgtttgtcctgtttgtcggagctatcgcagttccggcttcatggcttacgcgcttcattcctgaaaaacgtgtcgaagagtcggcagcggccttaaatccgaatatgttccagggcctctatctgcaaaacaaaatgttcgaagactcgaagtatatgccgattttcggttcttccgagctttcaagactggatgagtttcacccgtccaactatttccaagtgaacaaccaaggctttacgccttatcttgtcggaaaaggcggggaccaatccttgatacacgccgtgaactttgcggcgcattatcagcagctgaagggcaaaaagctggtattcattgtttctccgcaatggtttatcaaaaaaggttctgatgaacagcactttgcgccgaatttttcatcacttcaggcattggatttagcatttaataaccagattgatcccgcggtcaaaaagaacatgatgaagcgcatgctccgttttaaagttgttcagcatgatgccgtcctttctgaattatacaagggaatggtcaacggacaatcatggaaagtgaaagcggtcatgccggctgccaaagcttattattctctgcttgagaaaaaagatctttattattcaatgggagaaaccaagggccctgaacggacgatctctgaaaacctgaaagggaaatcgtggtcagagttaaaaacagccgccgctcaattaggagaacggagctccaagtccaatcctttctatatcgatgacgcttcttataaaaagattaagaagaaagtaaagagagtgaaaggaatcaacaaaggaagaacgtacgccaaatcagtcgaatatcacgactttgaggatatgctggacattctgaaagatgccggcgctgaaccgatgttcgtagttattccggtcaacggaaaatggtatgactacaccggcttcccgaaaaaaggccggactgattactacaaaaaagtcactaagcaaattaaagcgaagggctttcaggttgccgacttatccgggcacgaatatgatccgtactttatgaaagacaccatccatatcgcctggaagggctgggtgtacgtcgataaagcaatggagcagttttacaaaaccggcaaggtgacggttcactgagcacgatgattacagaatatgtaaaaacgaacacgcagggggcattctctcccctgctttttatgtgatttgattttttcacaaatttgaggaaaactattgcgaatatttgttgaaggtatacaatagaatataaattattttcaaataagtttgacaataacaccaatagggagacagaacattatgaaacaagacattcgtgttgaattgacttcagccaaaaaaccgaaaccggacccccataaccttgcgttcggcagaattttcaccgaccatatgtttgttatggattacgacgccgatcaaggatggtatgatccgagaattatcccttatcagtccatctcaatggatcctgcggccatggtttatcattacggccaaaccgtttttgaagggcttaaagcgtatgtaacgaaggatcaggaagtgcttctgttcagaccggagaaaaatatggagcgcctgaaccagtcaaatgaccgcctttgcatcccgctcattgatgaagagcttgttcttgaaggcctgaaacagctcgtagccatcgaccaagactggattccgaaagcggaaggcacttccctttatatccgtccgtttattattgcgaccgagcctttcctcggtgtagcggcatcccatacgtacaagctgtttatcatcctttccccggtcggctcttattacaaagaaggcattaaaccggtaaaaatcgccgtggaaaacgaattcgtgcgcgccgtcaaaggcggcaccggaaacgcgaaaaccgccggcaactacgcatcaagcctgaaagcgcagcaggttgcggaagagaagggattttcccaggttttatggcttgacggcattgagaagaaatacatcgaagaagtcggcagcatgaacatcttcttcaaaatcagcggcgaaatcgtgacgccggagctgaacggaagcattcttgaagggattacgagaaattccgtcatcacccttctcaaacattggggactgactgtgtctgagcggaagatttcgatcgatgaaatcatccaggcgcatcgtgacggccgattggaagaaacattcggaaccggtacggcggcggtcatttctccggtcggcgaactgatctggaatgatgaaagtcttgtcatcggcagcggtgaaaccggagagatctcgaagaaattgtatgataccattacaggcattcaaaaaggcgcggaagccgacgtgttcggctggacggcgaaagtcgcctcactaagcgaatcaaaataagcaaaaaacccggaagcgaatccgggtttttttactgctcttatgcttcaatcgacttaaagaaatggggcagatgttctttgtgggcctcaagcatttcatccagaatggcctttgccacggagtctgacgggacaagagggttgatcgtcatcgcaagaagcgccgtttgataatctcccgtgacggctgcttcagcggcgacgcgctcaaatgatttgatttgctggacgagtccgcggacagacaccggcagatcaccgacggcgatcggtttcggaccgtctttcgtcatgacgcagttcacttcgaccgctgagtcattcggaatgctggcgatcgcgccgttgtttatcgtattgacgggctggatatcatgtttgtcgttatagatggagctgatcaggttgcaggccgcgtcactgtagtacgctccgccccgtttttccagctgcggcggtttgatggcgagattcggatctttgtacagttcgaacagttctttctcaaccttctgcacgacctcggcgcgtgtgccctccgtctgtgaagcttctatttcatgctcgagcatttctttcgttttgaaataatagcggtggtagccgcaaggaatcagatcgagcgccttcaggaattcaggctcccattccgctccggaaatgtttttcatcgtcatggcgttttccgggtctcccatcgcttcgatgacttgatccttcacgctgacgccgtctaagaaaacatctaacccgaagaccatgtgattcagtccggcaaattgcacttcgatccggctgacatccacatccaatgcttttgcgacgcccattttaatgccgatcggcacattgcagaggccgacgacttttgtgagattcgagtagcggagcaaggcctcggtaaccatgccggcagggtttgtgaaattcacaagccacgcattcggacaaagctcttcgatgtctttcgcgatttccagaataaccgggatggtgcgcagccctttgaataaaccgcccggaccgtttgtctcctggccgattacgccgtattttaacggaatccgttcgtctttggcgcgggcctcaaggagaccgacgcggaattgagtcgttacgaaatccgcatccttcaaggcttctctccggtcaagcgtcaggtgaatctctatcggaacacccgctttttcgaccatgcgttttgcaagcgtgccgacgatattgagttttttctcgccttcgggaatgtcgacgagccataattctctgacaggcagttcctcatagcgcttaatgatgccttccacaagctccggtgtatagcttgaacctccgccgatcgttacaattttaattctttttgtcatatttttgctcccccttgcagactcactttttcgtaaatctcgactaactcagcggccaagtctttcacggtcatggcattcattaaatgatcctgcgcatgcaccattaaaagcgtcatgtctgttttttctccgccggcttcattttggatcaattctgtctggtaatgatgggcttcggtcagttcccttgcggcttcctgaagcttttcctcggccatggctctgtccccctgctttgcggcggcaatggcttccattgatgcgcttctgccgttgccgccatgcaggatgatctgaaaaatggtctgttccattttttcattcatgtgtttcactccctttctctacagcacggctttttcgtctccctgtacggctggcgcctgcgattgttcaagttcgttttcttctttcagcttttgcgaatcccacattctgaagaacggatagtacacgataaaggctgtgatgatattaatcgcctgcatgacagcccctgatatttttccgcccgtggcaagatagccggagaaaatcggcggcatcgtccatgggacggcaatgccggcaggtttggcgacgaggcctgtgctcatgccgatataggtaaagaccagtgtgacaagcggtgtgatgatgaacggaatgagaagcatcgggttcatgacgatcggcattccgaaaataatcggctcattaatattaaagacagccggcccgatggcgagtttcccaagctgcttcatctgcttgcttcgcgaacggagaaacatggtgaccacgagcgccagtgtcgcgccgcttccgccgatgttgatccagatttcaaagaactgctgggtgaaaatattcggcagcgcatcgcctgcctgaaacgcaacacggttggcatccatcgctccgaaccagatcggcgccatgacgccgccgacaatgttcgccccatgtaatccgcacgcccacaaaagcatttgaaccgcttcggctaccaggcttccgccgagacttcccccaagaatcgagagcggcgtccccagtacaacgcttacaatgttatgaaggctttcaaacggcgtcgcttcgacaattaaacgcgcaccccagatcagaaagatgacggcaaagccgggaattaaagcgacaaatgatttgctgaccgccggaggcacgccgtccggcattttgaagacgaaattccgctggatgatcaggcggtaaatttccgtcgacagcatggcgatgatcatcgcgacaaacagccctttgcttcccatgagagacagcgggatgccgccgcccaccatgatttcctcttttgcgccggaaggcagaaacggaactttgtacggcgttgccaagagaaacgccgccaaagatatcgcaccggccgataatgcgtccaccccgtatttttcagccaggcggtaggcgattccgaaagcggcgacaaggcccatgatttcaaaggtcgcatcaaccggatattgcagtttttgagaccaggcgcttccgaacgtcttcgccatgaaatccgcatatcccggaatcggcaggttgccgatgatcagaaaaaatgaaccgatgatgataagcggcatggtgaggatgattccgtcacgcagtgcttgcagatgccgctgggaggcaatttttccggcaatgggcatgactttctcttctaaaaactggttcaccttattcacacggcccgcccctttctacgatgcgtttccgagctgttccgctgatttcagaacctccgctccgttgcaagtgccgtaatggacggtattgatgacttcaaccggcactccttttgattcacccaattttttcagctgcggaagcaaataacggacttgaggcccaagcagcaatacgtccgctttatcaatatgctggttgactgaatcgcctgacaccgcccagattttatattcttttccttgttcctgcgcgcttttttccatcttggtgacgagtaagcttgttgacatccctgctgcacaaacgagtaatatattcatgtaaaagacctcctgaaagtttgatattttgtatgtctcgatgttagtaacatcatattatgaaatcgctttcataactactcaggctttttccgctgctaacggaaaaaaggtgtatcccggtctttctctgatcgtttgtctctgaatactcgtaaaacctcctgataggttgtgcattttaagagacggcttaccgcggccggatcatccaacatgccgccgagccatttgtacatatgctggaggtcggctttgctttctttctcgacgcagagcaggcagacaaattggacacgcttatccgcccagtcaatcggcttcttcagcgtgcataccgcccaaaacgtcgtgtctgtctgcggaacgagcgggtgcggaatcgccgtaagattgccgaaactcgtaggagaaatcgcttccctttcaaaaatagaatcggtcagagaatcagaagcgaggccggcttctgcaacctgctgtccgagaaaacggatgacgtcctccttcgtctccagatcctgctgcaaaaataccagctccggtttcagaaagttcaattgttcccgattttcttccagcatggcgtcgatttttgtaaaatccccgccgcccagcagcgtatgaaccttcaatacgggaacgggcaggtcttttttgatcggcactgtgctgaccacaaaatcaatcgactcaaaggaaagctggtcaaggctgcagtaatcagccgttccgacgatttcaagacgttttgcgaaccgggaacggagcttttctcttaaaagctgcgcgctgccggcgccggacgcacagacaatcagacagcgtttaggcggccgttccgtctttctcctttcaatagcggctccgaaatgaagcgccaaatacccgatctcattttcatgaatatcaatgccggtttgctccttgatcacgattcccgcaatcactcccgcttcaaatgcgagcggataattctcctttatggcggagagcatcgggtttctcaggttcattccgtaccggtttcggttaatcgccggcttgatatggagcgcaagacccgctttcagctcattgtcgtccgtgattccgagcttcagctcccgctcaatggcttcaatcatggcctccgtcaaacggctggtttccccgtctatcagccttgtaagctcttttccttccatttgtgactgggtcatgcgctttgtcccgagcaggtgaatggcgatataggcggtttcctgttcgggaaaggtgaccgaaagcgcagattcaagctcttttacgatggcttccgctgactgatattctgtttcgagcttaatatcatgaagatcttccggaatgagagatacatagttttctgtccggattcgtttgcaggcaatggcgatatggatgatgagattgttcaggccgaagaaagaaagcgggatcttatggtttcgaacctgcttcataatggctgtgcggatcacatgaatgtcgtctttcggcagaataccggccttttcactcaggagatcaggctcgggctcgcggtcgtccactaagtattccgccatacaataacggaggcggagctcttcgccgcgcagcttaaagccgtagttcggccttgtttccaaaatgatgtcataggggcggagccgttttttgacttcttttaaatcagattgaagtgtggatttactgatgaacagttcttccgccaagtcatccagcttgaggtagccgtcggccagaagcattcttttcatcaggtaatctatccgttcatcgggaaaaatcggtacggtgctgttctgctggaaattgtcctgaagccagtttttaaacggctgctcattccggatcagcagcttatagccgctccctctgacagattgaatggatgcgccgtgtttttctacaatggtttgcagttcctttatgtcattgcggaccgtccgcgtcgttacctttacatttgcagcgatgactgagcttgtaaccggtgtttcagcagctaaaagcaagcgcagaagttcacgaagccgcccatgaagcatgagaaaaacctcctatcagatcagatgcagatgtgaaaaatgggcaaaaagaatgaggaaggggtaaatgtatgtaaattctatactggggaggatttcaagtcaatgcggcaatccgatgccaagaccgtaaaaaaacagccggatcagccggctgttcgggatgcggacatgcggttccgcttagatgccttccgttcttttatgatttttctgataatcggatagatgacgggcgcccatttgataatcgttttgaaaaattttttcaatgtctgaatcccctttcttttaccttgtctttcccctgttatcagcgtttataaacatggtcagcgtgagacataccggttccccgtcacccaatagcgccacggataatcccgggcttctccgctgttgtcaatcccgattctcgggcctgttgatatatgttcaggcgtaaagccctccgtaatatacagcggcggttccgtgatcatgccgccgtagtcgttcattgaaatgcccatcgccttcgtcagttttcccgggccgtttgtccactctctcggggtctgcccggtctcctgctctccatcaggaactgtccttcatgaggctccgccgccctgattaacacggcctgcggaatgccgatgtccgaggcgacgacgttcattaatgtatgagtgtgcatgacgtatgtataaatgcggcccgcctcatggaacataatttccgtccgtttcgtgcgccggttgccgaaactgtgcgccgcccggtcatccgctcccatataagcttccgtttccacgatataacctgaagccgttccctcatccgtctccttcacaaggagacagccgagcaataaaggggcaagctccactgacggtctctggtaaaattcaatcggcaaaggctttccttctcccgccatttgcctccctcctttctgaatatagcgatttcctctttcacgtttttcacttcttttttacaatataaacatgaaagaaaaaagggcatcattgttgaacactctattgcgttttgaaaatcggcccggtataatatgatggttcaaatgaaaatgattctcatattcaataaatgccggacaatgatcataaaagtaggtgaattgatttttgagcgattctgtcacgtccgcaagccgtctgatcagcatcttaaaaaacggggttttcttcctgatcgcggtgatcgggctgcttgtttctatttttttcgccgtctcattcggcgcgaaagacattactttacatacggtttggtcggctgttgctgattacaatccgaacataacgggccagcagatcattcatgaattgcgtcttccgagagtgctcggcgcggccgttacaggagccgcttttgccgcagccggcgccctcatgcagggtgtcacgagaaatccgcttgccgattcgggtgtcttaggcgtaaacgcgggcgccatgtttgttgttgcgctcagctttgcttttttccctcatttgtcatacgccctgctgatgatgatgtcatttttgggagcactggcaagcaccggcttgattttctttatcagtgcggcgggaaaaggcagcatgacacctttaaaggtgacgcttgccggggcggtcgtggccgcgcttttacattcactcagtaccggtgtagcgatttattacgatttaagccaggatttggccttctggtacgccggcggggtgtcggggatcaagtgggctcatttacaagtccttgttcccgtgattgcggtcttcatcattctcgcgacattcatgggccggtccgtcacccttctctcaatgggaaatgacgtggcggcgaatttaggggtgaacacggctctgacgcgtgccgcgggattaatgatcgccgtcgttcttgccggtgtgtctgtttccgctgccggcgcgatcggctttgtcgggctggtcattcctcatatcgcccgcaagatcgtcggcgttacgtacaggctgattattccgatgtccgcgttgctcggcgcgattcttttgattttggccgacttggcctcacgcacggtcagtcccccgagagaattggcgataggcatcatggtggcacttgtcggtgtccctttctttctttatattgcccgcaaggaagggagagacttataaatgaaagtgcagaaagaaacaaaaaaagcggcggcggcaggtctcgttctgctggtcatcgccgtttgcattattctgatcgggctgcacacgggctcattccggctttctcccctcaccgtgggaaaaacgctgttcggttacggcacgtttcaaagcacaaccgttttattcgattaccggctcccccggatactggtgacgatgctggccggtatcggcttaggcgtgtcaggcgctattttgcagggtgtatcccgaaatccgcttgccgatccgggcattctcggactgcatgccggcgcttccttcggtttgatgatgtatatcacattctttcattccctggaggcgcaggcgtcgatgttcatcccgctgtttacgtttgcgggcggaacactcgccgccctgctgatcgtagtgcttacgtacgacaggctgaacggttttttaacgatccgcatgctgttggtcgggatcgccgtttccgcgggcttcagcgccgttacattgtttatgtcgctgcgcctgaatgaagaaacttataccttcgcttcccgctggctggtgggaaacgtctggggcagagattggattcacgtgtggtcgcttttgccctggatcggcattctcgcaccgcttgcatggcttaacgcccggtctttgaatattttaatgctcggtgaccaggcagcggcggggctcggcgcacacgtgcagagaaaaaggatcatgctgatcgccatagcggtcggcttgtcctgcgcgagcgtcgcgatggccggcggaatcggctttatcggctttgccgcccctcacttggcaagacggctcgtcggcaccatgcatcagcatattattccgattgctggattaatcggccttgtcattcttgtcgcggcagacaccatcggccggtctttgtttcagccgaacgccattccggccggcgtggttgcggcagccatcggcgcgccgtattttctctatctcgtcatgaaaatcaaatcataaaacaaggagtattcccatgaaaaaaataattgcgctcatcagtttcatgtgtattttcttactggctgcctgccaatccgattcatcacagccggagtcaaaaaagaaatccggcgatcataaaatcgcttcgatgtccattcacctgacaaatgatctgctggctctcggcgttacacctgccggttccgtcgtgggcggagaattaaaagattttctccctcatgtgaaaaatcagctgaaagacacgaaaaaactcggacctgcctcagacccggatatggaagctttacttgagctgaatccagacaacatttatcttgataaagaatttgcgggaaaagatgtgtctaaatacaagaaaatcggaaacacacacgttttcgaccttgataaaggcacatggcgtgatcatttaaaagacatcggaaaaatcgtcaaccgtgaaaaagaagcgaaaacatttattcaagattacgaagatgaaacaaaacaagtcagatccatgatgaataaggaattagggaaaaacgccaaagtcatggcgatccgcgtgaacgcaaaagagcttcgcgtcttcagcacacgccgcccgatgggaccgattctgtttgacgatctgaagctgaaaccggctgacggcattaaagaaatgaatacctcccgcccttatgaagtcatttctcaagaagtgctgcctgattacaacgcagatgcgattttcgtggtcgttaacagagacgacaagtcacagcaagcctataaagaattgcaaaaaagcgctgtctggaaagggcttaaggccgtgaaagcaaaccatgtctataaaattgccgatcagccttggcttgattattcggcactgggaaataaattagcaatggatgaagcgaaaaaactgttccaaaaataaacatgagccggttttgcaaaaagtgcaagaccggctttttttatattgccgtttacttatataaatgtctgcttatataatagtgtaaaaaaggagtgagcgcatggaacggcggcataatgctttaagttccgaagggatcagccagtgcctcaaacttctaagcgacccgacgaggcttttgatgctgaagcttctggaggataaggaatattgtgtctgcgagctgacggctatttttcatataagtcagcccggcatcagccagcacttacggaaattaaagaacgccggccttgtgcgcgaaagacgcgagggccagtggcggtactatgccattcatccgtccggaccggaatacgcgctggtttgctcgattctgcagcagatagatgaaaaggacgaagttttacagacattgcggcaaaaagaagtcactgttacatgccggtaagggggatatattcttgggagttgcggttttatcagcgctgatttttgtgctgacacttgtgtttgtcatatggcagccgaaacatatatcaatcggctggtctgcctgcggcggagcggtcctcgctttgatcgccggagcagtcagcctgcacgatatcgcggaagtgacggggatcgtctggaatgcgacactcgcctttatcgccattattatcatttcattaattcttgacagtatcggtttttttgagtgggccgcgctgcatatggccatggcggccaaaggcagcgggctgcggatgtttctctatgtgtcggtcttaggggctgttgtctccgccctgtttgccaatgacggagcggcgctcattttgacgccgatcgtactggcgatggtgcgggctttgaatttacctgaaaagctggtttttccgtttattatcgccgggggattcatcgccgacaccacctcgcttccgctcgttgtaagcaatttggtcaatattgtatccgctgattactttcatatcgggtacattgaatatgcaacacgcatgctggtgcccaaccttttttctctggcggcaagcattttggtgctgtatctctatttcagaaaaaacattccgaaacggtatgacaccggtcttgtgaaacatccggcatccgcgattaaggatgaacgccttttccggttatcgtgggctgtgctggccgttttattgatcggatatttcgtcagcgaactgctgtcgatacccgtttccttcgttgccggctccatcgcggtcatttttctcattctggcgcagcgaagccccgccgtccctgcgaaacaagtcatcaaggacgccccgtgggccatcgtgtttttttctgtcggcatgtatgttgtcgtgtacggcttgcggaatgccggactgacggatcttctttctcagcttattcagaaagcggcggatcacggattgtttgcgggcacactcggaatgggttttatcgctgcgatcctctcctccgttatgaataacctgccgacggtgatgattgacgccatagccatcaacggaacggacactcacgggctgctgagagaagcattgatttacgcgaatgttatcggttctgacctcgggccgaaaatcacgccgatcgggtcgctggcgacattgttatggctccacgtgctgagccggaaaaacgtgaaaatttcctggggaatgtatttcaaaacaggtctgatattaaccattccgacgttattcatcaccctgatcggactttatttatggctgttatggctcgcttgagatgaaaaaccttttaagttgaatcttaaaaggtttttttgtgtcaaaaatccgaaaagtaaaacttttatattttaaaagtatagacatttaatttcaaaagattataatattcatgaaaacgttttaactttatgaaagaagggattcctcatgaaaagaattttattagcctgcagctcaggcatgtccaccagccttcttgtgacgaaaatgcagaattacgccagctccatcggtgaggaggccgagatttgggcagtcggacaggataaagcaaaagaagcgatgaaagacgcagacgtcgtactgatcggcccgcagatgagttttttaaaaggcgagcttcagaaagaggcggacccgcttcacatcaccgttgatgtgattgatatgatggcatacggcatgggagacggcaaaaaagcatacgaacaggccgtttccttgatagagaacaaataaaggaggcgataagcatggaaacgtacacggatgaacagatcagttttcagctgattcttcacagcggcaatgcccgcagctgtattattcaatcgatacgcgcttataaagacggccggccagatgagtcagacacctttctgacaaaggctgaagaagaactgggaaaagcgcacgacatccattttcagatgattcaaaaagaagccggcggcgccaagacggatgtctccctgctttttatgcatgctgaagaccacttaatgtcagcgctctcaatgaaagagatcgtcaaagaaatgctcgacttatttcaatcaaagaatttataaaaagccgggggtgaagacgtgtttgagaaaatcagccaattccttgttccgatcgcgggcaaattaaacaataaccgctacctgcaagtcttacgggatgcttttatgctggcgtttccgctgaccattttcggttcggtgttcgtcgtgctgacgaacctgccgtttttaaacaaaatcatgagcagctccgccctgtctgtctttcaatccggatttggcggcgcttcgacggcgacgatggggattatgtccatttttgtcgtcttcgggatcggctattacctttcaaaaagctacgaagtggaggccgtattcggcggagcgattgcattggtttcttttctgctgctcaccccgttcgtcttagagccggaaacgggcaaagcggtcgcaggcgtcattccggttgaccggcttggagcaaaagggatgtttctcggcatgataaccgcttttttgtcgggtgaaatctacagaagaatcgtccagagaaacttaacgattaagatgcctgccggtgttcctccggctgttgctaaatcgttcgccgcattgattccggcttttatcacgcttaccgtcttcctcttgatcaatgcggctgtcacccagatctttcacaccaatctgcatgatgtcatttatcatacggttcaagccccgcttgtcggacttggaagcggcatcattcctacattaatcgctgttttctttattcagattttatggtttttcggacttcacggacagatcattatcaattccgtgatggacccgatctggaatacattacaggtcgaaaatttggctgcgtatacagcgggaaaagagattccccatattatttctaagccgtttatggagatttacaccgtcggaatgggcggaaccggaatgacattggccatagtgatcaccatcttgctttttatgaaaagcaaacagatgaaacagatatccaaactcggtctcgcgccgggcattttcaacgtcaatgagccggttattttcggtttgccgatcgtgatgaacccgatcattatcattccgtgggtgatcgcaccgatggttgtcacgctcgtcacctacctggccatgtcggcggggatcgtgccccctcctactggcgtgaccgtgccctggaccgtcccccttttcattaacgggattatggcgaccaattccgtcatgggcggcattatgcagctggtcaacctctgtattgtgtttattatctggttcccgtttcttaaagcgctggacaaattaaacatggcaaaggaaaaagaagccgaggccgagcagcaagcacgggatgacagcatgagtatgtaatcaaaatcgcagtaagggagagaaatcaattgactgaatcaaatattcaatatcgttttccggaaggattctggtgggggtcttccgcctccgccacccaaacagaaggcgccgccgacaaagacggaaaaagccaaaacatatgggattactggtatgaaaaagagccgagccgtttttttaacggcgtcggccccggcgacacgtcacgtttttatgatcaatacaaggaggatatccggctgatgaaagaaatcggccacaactccttccggctgtctatttcctggtcaagattgattccggacggaactggcgaggtcaatcagaaagcggtcgcgttttatcaggacgtcatcgatgaaatgcttgcccatcgcattgagccgtttgtcaatttgtttcactttgacatgccgctcgcccttcagcgtaaggggggctgggtcagccgggacaccgttgacgcgtttgaacattacgccaaaacatgcttttcgctattcggtgacaaagtgaaaaaatggttcactcacaacgagccgattgtgccgattgaaggcggctacttatacgactttcactatccgaatcacgttaattttcaagaagcggtgcaggccggcttccataccctgctgtcgaatgcaagggctgtcaaagcctacagagaattgaaacaggacggacaaatcggaatcattctgaatctgacgccttcttatccgagaagctcacaccctgaagatctgaaagcatcccggattgccgacgcctttttcaaccgctcatttttagatcccgccgtaaagggcgaatttcctgaggagcttgtcgagattctcaaggcggaaggctttctgccgcgttacgagaaagaagatctccgcctcattcaggagcatacggttgacctcttaggcgtgaactactaccagccgagacgcgtcaaggcaaaagaacatgttccgaatccgcacgcccctttcctgcctgagcgtttcttcgatccgtatgttatgcccggacggaaaatgaacccacaccgcgggtgggaaatatacgaaaaaggaatctatgacattctcaccaatctcagagaacattacggaaatatcgaatgttttatttccgagaacggcatgggagttgaaggcgaggaacgcttccgcgatgaaaacggcatcattcaggatgattacaggattgaatttatccgggaacatctcaaatgggtgcatcgggccatcggagaaggttcaaatgtaaaaggctatcacctgtggacttttatggacaactggtcttggacaaatgcttataaaaaccgctacggctttgtatctgtcaatctggaaaacgggggcgaacggaccgtcaaaaaaagcggccgctggttcaaagccgtttccgatcaaaacggattttaacagatgaggaggtacagccatgcttggaggtattgaagccggcggcacgaaatttgtctgtgccgccggacaaaaagacggcaccattctggacagggcggagtttccgacgggagaaccggatgacacactcagacaagtcatccgttactttaaagatttcccgatagaagccatcggcatcgggtcgttcggaccgattgacatccgccccgacagtcaaacatacgggtgcatcaccgcgacgccgaagacagcctggcggaactgccctattcttcaaacgatcaaaagcgcactgcatattcccgcaggcttcaccaccgacgttaatgcggcggcgctcggagaagcttctttcggcgcggccaaaaacgcggacagctgcctctatttgacggtcggcactggcatcggagcgggcgccatcatgaacggcagatttgttcaagggctgtctcatcctgaaatgggccacatttatgtcagaagacacccggacgacggctacaaaggcaattgcccttaccatacagattgcctggaaggcctcgcggcaggtcccgccattgagaaacgctgggggaaaaaagcatatctgctggcggatcagcaggaagtgtgggagcttgaaggctattatattgccgaagcgcttgtgcagtatattctcatactttcgccggaaaagatcattctcggcgggggcgtcatgaagcagcatcagctgttctcttatatccgtcagcacgtgaaaaagcggctgaatcaatatattgatctgcccgacattgaacacttcatcggtccccctcaattagggattcactccggcgcggccggttcgctcgtattggcggagcgcgcattagagacggcaaaccgggaggcgggaaaatgacgaaactcttatttttggaaccggtttttaaagaaagattatggggcgggacgaagctgcgcgatacattcgggtatgagattccttctgagcggacgggagagtgctgggcgatttcagctcatccgcacggtacatccatcgtgcggaacgggccattttccggaacatcattacaccgtctctggaatgaacaccctgacctgttcggacatccgaaagaagaagcttttcccctgctcacaaaaattcttgacgcaaatatggacttatccgtgcaggttcatccggatgacgcatatgcacatcggcatgaaaacggagaactcggaaaaacggaatgctggtacgtgttggactgcaaaaaagacgcggagctcattttagggcaccgcgcccaaacaaaagaagatttcgttcggctcattgaacgaaacgagtgggatcacctgctccgccgcatccccattaagcccggcgactttttctatgtcccgagcggcacactgcacgctttatgtgaaggtacgctcgtccttgaaatccagcaaagctctgatgccacctaccggctttacgactatgaccggacggatgggaacgggaataaacgcgagcttcatcttgagaaagcaattgacgtaacagacattccccataccgatgaaaatgtaaaaagcactaagcatcggatcggagatgctcttattacgatactcgccgaaacacctttcttttcagtttatcaatgggatgtgagcgggaaagcatcattccccgcacccggccggtatttactcgcaagcgtcattaaagggcgcggagaactggatggatgccccgttcagaaaggcgatcactttatcgtgccggcggattccggagattttgttatagaaggagattgtgaggttatcgtttcacatccttcatcatcttaaaaatcaggaggtcttttatatgcttaaaaagttagcagtctgcctgtctatcgttttattactcttaggagccgccagtccgatatcggctcacaccgtttatcccgtcaacccaaatgcccagcagacgacaaaagatatcatgaactggctggcccacctgcccaaccgttcagaaaacagggtcatgtccggagcgttcggcgggtacagtgatgtcactttttcaatgacagaggaaaaccgcttgaaaaacgcgacgggacagtctcccgccatctacggctgtgactatgggagagggtggctggaaacagcggatatcaccgatactatcgattacagctgcaacagcagcttaatctcatactggaaaagcggcggcctccctcaggtcagcctgcatctcgcaaatccggcctttccatccggaaactataaaacggccatctcaaacagccagtacaaaaacatccttgacccttcaactgtggaaggaaaacggcttgaggcgctgctcagcaaaattgccgacggccttactcagctgaaaaatcaaggcgtcaccgttctgttcagaccgctgcatgaaatgaacggcgagtggttctggtgggggctgacaggctacaaccaaaaagacaatgagagaatctcgctgtacaaagagctttacaagaagatataccgctatatgacagagacaagaggattggataaccttttgtgggtgtattcgccggatgccaacagagactttaaaacagacttctacccaggctcatcttatgtggatattaccggtctggacgcttacttcactgatccgtatgcgatatcaggctatgatgaaatgctgtctctgaaaaaaccgtttgcctttgccgaaaccggtccgtccggcaatatcggaagctttgattatgctgcttttattaatgcgatcaggcaaaaataccctcagaccgcgtactttttgacatgggatgaacaattaagtccggcggccaatcaaggcgcgcaaagcctttatcaaaacagctggacgctgaacaagggcgaaatatggaacggcgggtccttgacgccgatcgcggaataaccgcttcttttgaaaatcggttttaaaaaacggctctgctgggcatattgttaccgttcaaaaaggagggttcaacaatggaaaataacaaaaacagcgaagaaacgctttccagtaagacgaccggtaaaggcgagtcagaagacacgctgacaaaccggcagggccatccggtcactgacaaccagaatgtcaggacagtcggcaatagaggaccgacgacattggagaattatgattttttggagaaaatcagccactttgaccgcgaacggattcccgagcgcgtcgttcacgcgcgcggcgccggcgcacacggatactttgaggcgtacggaagttttggagacgaggagatttctaaatatacaagagcgaaagtgtttcaaaagaaaggaacgaaaactccggcgtttgtgcggttctctaccgtcaaccacgggaagcattccccggaaacattgcgtgatccccggggttttgccgttaagctttataccgaagacggcaactgggatctggtcggcaacaacctgaaaatcttttttatccgtgatccgctgaagttcccggatcttgtgcacgcatttcagcctgatcccgttacgaacattcaggacggcgagcgtattttcgacttcatttcccaatcaccggaagcgactcatatgatcactttcttgttttcgccgtggggcatcccggccaactaccggcagatgcagggctcaggcgtccatgcctacaaatgggtcaatgaagaaggaaaagccgtgctcgtcaaatatcactttgaaccgaaacagggcatacgcaacctgacacagaaggaagcggaagagattcaggggaaaaactttaaccatgcgacacaggatttgtatgaggcgattgaaaaaggcgattaccctgaatgggaagtgtatgcgcaaatcatgactgatgacgagcatcccgagctggattttgatccgcttgatccgaccaagctgtggtataaagacgatttcccttggaagccgatcggcaaattggttctgaacaaaaacccggaaaactaccatgccgaggtggaacaagcatcattcggaacgggcgtgcttgtggacggccttgatttttcagatgacaaattacttcagggacggacattcgcctattcagatacccagcggtaccgcgtcggcgcaaattacctgcagctcccgatcaactcgccgaaaaagcatgtcgccaccaaccaggaaggcgggcaaatgcagtatcgggtcgatcgggcagaaggacaaaacccgcacgtcaactatgagccgtccattatgggaggactcaccgaagcaaagcaggatgggaaagaccatacacctcatgtcgaaggcgatgtgaagcgggaagcgatcgaccggccgaataacttcggccaggccggtgaaacataccgcagattttcggaatttgaacggaccgaattgatcacaaacctggtcaatacgctttcttcctgccggaaagacattcaggatcaaatgattgagaatttcacaaaagcagatccggactacggaaaacgtgttgcggaagggctgaaaaaagcctccgaaagcagcagcggcgggccgatcggcactactgatacagcacaagccgcaaaacaggctgaacaggaaagccatccgtctgatccgtattaaataaaaaaacaggacaatcgcgtcctgttttttttttgagctaattcagctcctgtatattctgctccgccgcggccgcaaatactttcggctccggacggtcaagatcttcatggaataaacttactttgtgaatctgccggttgtcgtacagatgaaagtagtagttcccggtgtcacagcacatgaccgacgtatattgcgtataatcaatttcattctcctctgtgatcaccgcgccttttggaatattcacattggacagcacgtgaaaagcggccgtaacgccatccgtttcatgagcggcaggctctaaatgctctttcagataagcggctctgatgaaccgggatggcggcgtgtaatcaccgggaagcccgatcgttccagatccttggccgaaagcggttaatgtcattccgcccaatgttttgctttctgactgctgcggcctgattccgatataatggcgcagattggtcacatgccaaggaaattccggactgttggtcatcactccgggtttgttgtcatatactttcattccctccggtgtcggctcgatgacaatgcagccgcccgtgcggtctgataaaatccaatgaagaggcagcaccgtatccaataacattaacttcttctctacaatcgtcagcattgagagcttttcctttatgtcttcaagagattcacagtttgataaggcccaggtgacaaactcatgaggagcgatgtgacaggtgccctcccgttccgctttctcgtatcccgcaaagcccggaaaatacagcgtcgcacacgacagccctttttcatttacgccgtcggcaaacagaacattgccgagatttctccccatgccgataaatgcgtatttcgtcttatgcatcctgccgtcagcttcgcttttccagctgtactgacgagggtaaagcacgacgtccgtaccgagctgaaatgcaaaatccatcgttcgcgccaataggtgattgccgtctgtcgttttcaatgtaagacttgtacacatatcatcaatccccttttcattaatgaaatttacacaaagtaaactattctttcagcttaacgaataatggctccattcgtcaaaagattgacacatttctccttcatacatattagtcagtaagcatatccataccttttaatccctggtaaatcgtttaggcggcagtgtttgttccgtttttcaaaaaactttgaacggctgtcagcgaggctttacaatgtttttcctgcatgctggaatttgtaaacggcaggtcaatctgttaagctatgtctttatgttaaagaagaacatacggaggagattatctattgaaagtagaaaggcgaacgattgaacatattccgcatgacgaaagacacggaaaggctaaagatttattccccgtctggttcggggctaatatgcatattacgacgttagtcacaggcacactgcccgttacaatgggactcgatctcttttggagtatcgccgccattgtgatcggaacctttatcggcgcaatctttatggcgtctcattccgcacaaggacctcagctcggaattccgcaaatgattcaaagccgcgcgcaattcggcgtgatcggagcgattctgcccctctttttggtcatgtttatctacctgggcttctttgcgagcagtacgattctcgcagccggtacactgagcagctttgtcccgattccggcttcatggtgtattatcggcttaagcgccatctgttttttactcacgatctacggtcatgatctgattcacaaaatgcagaaaatcctctcttggacctcctttgccgttttttttgctgcaacgattcttatttttcaactgccgattccttcaggaagctgggtgcccggctcattagatctgcctgtttttctagtggcggtcagcgcggtggccacatggcagctggcatacgcgccatatgtcgcagattattcccgttatctgccggtcaaaacaccggcatcgcatactttttggtacagctatgcaggtacgtcagtcagttccatctggatgatgcttctcggcgccattttgacgacggcgctcccggaatttaccgctaatgcgggaaatgagattgtccgattgttcggtccgttttcctttattatgctgatcatcgtcctgttcgggcaaatggcgatcaacgtctttaatttatacggagcctttatgtcaaccacgactaccttggagccgtttttaaaactgaaggtgacgccgaaaacgagagtggtaatgatcctttgtgtgacggcagcgggtactgtattaagtctcttgggccaaagcaatttcatggaactgtttttaaatttcatctttttcatcagttatttcttaattccatggacggcgatcaacctcgtggattactattttatccgccgcggaaaataccacgtcaaatcgatgtttgacgtcaacggacaatacggcagggtcaattggattacagcggccgccttcgttttgtcgattatattagaaatcccgttcatcaatacatccttttacatcgggccgctcgctgaaatattcggcggaggcgacattgcctgggtcatcggcctggccgttccgtcgctgctgtattatgtcctgatgaaatcaaggttaaaacaaaaagaggcgccttccctatgaagacgccttttctttattcatattccttccatacacccggcagcagttcagaaagttcgtgcgccaataaggtatgggcggagcgctctttcgtccataattccgcacattcgccgtgaaggcggacggcgttcaatacggcgtgcttcgggtcttgatgacagcacagcatgccgagaatcattcccgacagcgtgtcgccggtcccgccttttgcaagcgcgccgtttccggttgtattcctgcggcattccccgtcgggaaaagcgataatggtttcgtttcctttcaggacaatcgtgacatgaagccgctccgcccattccgcggcatattccgctctgttctgctgaatctcttgaatcggaaggcctgtcattctggaaaattcgccgggatgaggcgtcaagatcacgggagctttcctcttcggataggttcttttcgtaatggcgcccgcatccagtatgacgggataatcgccagaaagcagctgatcagccgcctgctgcacctcgtctgtttggggaaggcccggcccgatggcagcggcccggatggtttccccgggctggcccgccgcggcttttatccacccgtcccgccagtacgtggcttccggcagcaccgggacgataagcggaatgacgcctgccgatgtaccgatgacgagcttgccgacaccgcttctcatcgcacccaatccggctagaagggcggctcccggcatgtcatcgctcccggccagcaataacgccgtcccgaacgtgcctttatggctgtccgcctcccgtttcggcagcgtatctttcacatcctgttccgtccaatccattatattcatctctgtacctcctcttctgtctcctatttatattccaaacaagaagagattttaaaccgcacaaaaaaacagccgctcgtttgcggctgtttatgttctgatcggaacatcaagacggtaaagcttccggtaccgttcgttttctgcaagcagctcttgatgggttccttccatttctgcttttccattttctaaaaagacgattttatcagctgtttccacacccgctaaatggtgtgtaatccagaggatcgttttctctttaaagacatcaaaaatcgtatcaagcaattctcgttcagtgaccgcatcaaggccgatcgtcggttcatcaaggataatgaccggcgtgtcttggagcagaatacgggcaagcgcgatccgctgccgttccccgcctgagaaacgaatccccgtctcctgcacggacgtttcatatccgtcaggcagtgattcaatataatcatgcagcttcacttgccgagccgcacgcttaacatcttcatcactcgccttgccgtttccgagccggatattgttcataatgctcgtgttaaagagatgaggtttctgattcaaaacggccaccgctgaggaaatctgctcctgcacggccgcagtttccagcccgttcagcatcaccttgcccgaatcgggaactaaggcgccttcaattaaagcgagagaggtcgacttaccggagccgctcctgccgagcagcgccattttttccccctggcggagagtgaaggaaaaacggtcaagcacatgactgtgctgatcataagaaaacgtcacgttatcaaatgtaagtgtcacatcggatacatccagtatctcatctgtctgcttcacctcacgacttcgcagctccggagccgccttactcattcttttgatggaatcctgataagaaggcacttccgtcagcgcatccgaaaggggcagaaacgcctccgtcaatggaaatacgacaagcacaaaggctgcgatcatcgtgttggcgatgctgccgtccgcatactgacccgccgtccagaacagcatgatcaatatgaagccgccgacaaggcattgcgcggcgagatcacgccatctcgtaaaccgctgacgtttgctttcaaggtcaaaccatgccttctctttctcttcataagaggaaataaaggccgcctgtcgtcccgagaacatccagtcgctcacgccgagcacggcatctgtcagccggctgtagagcgtattccggccgcttttcagcctcatgtttttcgctctcgtcacaagaagcgacacaaccggaaacaatacaaccaatataaacaggtaaatcgccgcaaaagcggcaaacggccaggaaaaaaagccgagtccgataacggatgccgcatacagcagcaaagcggaaaccgccgggaaaatcgtttttaaaaacgcatcctgcaaatgctcaatatcctcagccaaaatgccgagcatgtcgcccgtccgaaaacgggatgaaagcatgagcgaggccggctccagcatattgtaaagccgcaccctcatatcggacacgattttcaaaatgatatggtgccccgtcaggcgctcggcgtaccgtgagactgaacgggcaatcccgaaggtgcgcacggccacaatcggaacgtacaccagcaggatattctcaggccttgtcgccgacttagagatcaaaaaaccggaagtgaacatgagaaaggccgccgaaaaaatcgtcaccgcgcctaaaaaaatcacaagaacaaacaaacgggcattttgctttatatacggcagaatccattcttcttttctcatgttctttcccccagttgcgcctttacaagtttggcatatacgccttgtttcgccatcaattcgtcgtgggtgccgatttccgccaccgcgccgtcatcaagcacgataatttcgtccatctcaagcatccagtgaagacggtgagtggccagaaagacaagtttgttttcaaacaggtctttcatcgtttcttttatttcatattctgtttcaatatcaaggtgagcggtcggctcatccaaaaggagaatcggccggtttcctaaaaaggctctggccagcgcgacacgctgagcctgccctccgctgagcgcccgtccgccctcgccgatccggccgtcaaggccgccgggcagatcgcggatcagtccggaaagacccgctgaatcagcagcgcgcgccgtttcctcacgggaagcatcaggatgataaaaccggatattattcataagcgtgtcatcaaaaatgtacggatgctgcgggatataaagcagctgcttctgccagccgtctgactgcagatgcgagcgggattcaccgtttaccttgatctcaccggacgcaggctctaaaaagccgcccagcacatcaatgagtgtcgattttcccgcaccgctttccccgataattccgattttcttcttccctttaaaggacagatgaaattcagacatcgattctcggacggacaaacgcgtaagctgtaattcatccccgtcagtccacgtatcaagttcgagcggcttttcttctttaaaaccgggctgcgccaaaatcgcttgaatggttttccccgcctcctgcccgtttaacgtcgcgtggtaatcatttcccacttcgcggaccgggagaaaatattcaggcgcgagaatcagcgctgtcaatgccggaccgagcagaatttgtccgtctatcagccgcaggccgagaaacacagccactgtcgccaccgacagcatcgtaaagaaatccagggcgaatgatgataaaaacgcgacccggagcgtgctcatcgtcgccttgcggtatctctcactgacatgaaagatgtttttactgtgtgatttgcttaaccctaaaaaccgcaatgtctccagtccgcggagcgaatccacgaaatgattggaaagcgtctgataggacttccattggcgatcggcttttttctgtgcgacaagtccgagcaggatcataaatacaatcaaaatcggaagcgcaagaatcagaatcaaagccgatgttttatcctgaaaaaacacgtaaataacaacggccgccggcacaatcgccatgctgaccattttcggcagaaacagctctaaataacggcggaactggctgatgccttccatcgccagcgtcaccatccggcccgtcccctcttttttcgcaaagcgggggccgagacggaacaattgctcaagaaatctttttcttaagtctgcgccggtttgcgcggcatattggtacacgattttctgccggaccgcggttaccgcatgccggaccaaaaacgcaagcaggaaaaagccgataaccggataaagagaagcaatccgcttcccgttaaataatccggttaccgcctggctcagccattccgcctgcaagatgatggcggccgtttgtataatcgttaatcccgtaatgatcgcaagaatccgcttcattcctttataaagaaacaggtcttttcccattaataagtcataggctccttatggctgacgcgtttccggaagacataatagctccagatctgactgccgatgacaaacggcagcagagtcagtgcaacaattgtcatgaccttaagtgaataatcaccggaagacgcgttagctactgttaagtcatacgcgcttttcagcgagctgaccatgacgcgagggaacagagagataaaaatcatcgcaactgtcaaagcaagacccgcgccggtcataccgaatgcccagccgtcttttttcttgctcatgaacacaacagcaagaacgttgcagatgacaatcagcacgaataccggaatcgtgatgtttgcccggcgtgtaaacatatccgtatcgtatgcagacatcgcaaagaaagcaagtacaacaagaaagataacaccgattacgcgttttgccatttttctcgcacgctcttgtaaatcaccgatcgtgcgcagtgtgacaaacattaaaccgtgcaggaatgaaagaagggtgacggctgctccgccaaggacggaatacacgttcacaatatctgagaaacccgcatgcatattcatatggccgtcaatcggcatgccgcggaacaagcttgtgaagataaggccgaatacaaacggcgggataaggctgccgaagaaaatcacccagtcccatgttttgacccattttaaatgattcacttttccgcggaattcaaacgccaccccgcggcccattaaagcaagaaggatgatgataaacggaatataatatccgctcagcatcgtcgcataccagttcgggaatgccgcgaagatcgctcccgtacctgtcagcagccatacctcattcgcatcccagaacgggccgatggtgttaatcagcactctgcgttctaattcattatggccaagaaatcgggtcgaaatgccgacaccgaaatcaaaaccttctaaaaagaaaaatccgacaaacaaaactgaaacgagtacaaaccaaagatcatgaagtgaccccatggtagacctcctgactgaacggatccgttgatacaggaacatccttgtgatcatcatggtccgcaccttttttaatttcacgaacgaataggaagacaagcagcgcgcctaaaatcaagtacatgacgccgaaaccgataattgaaaacagcagagatcccgtcgttacgttaggcgaaacggattgtgcggttgtcatttgccccataaccgtccacggctggcggccgatttcagtcataatccatccggcagagttcgcaatgaacgggaatgcgatcagtgcgatcatgccccgtaaataccacttgctcgtatgaagctttttgcggcggttcagaataaagcctgcaatcgcggcaaaaatcataagcgcacccgctcccgccataatgcggaaactccagaacgtcgttttaacaggcgggatatagtcgccttttccgtacgttttttcatattctttttgaagtgttttcatccctttcacactgccgctgaacttctggtaagccaagtagctcagtgcgtaaggaattgaaatttctgatgtgtttttttctttattcgtatcaatattcgcaaaagccgtccacgcggcaggatcaccgctgtcatcccaaagcgcttcactggcggccattttcatcggctgcgattccattaaatgctcagcctgcatgtgtccgctgaacgcaacgccgataccggcgatcagaccgacaatcatcgaaagcttgaaagatttatggaagaaaggcacttcttttttcttcaataatttaaatgcgctgacaccggcgataaagaaagcacccgtcgcaagcgctccgaaaatgacgtgagggaattcaacccaaagctgagggtttgtcaaaagcgctccgaagtcattcatttccgcgcggccgtttttaatcgtaaagccgaccggctcctgcatgaatgagtttgccgtcaaaatccagaaagatgacataatcgttccgaaggatacaagccaaatgcaaagcaaatgcacttttttagataaacggtcccagccgaaaatccataatccgataaaaatagactccataaaaaacgccaaaagcgcttcaatcgcaagcggagccccaaatacgtccccgacaaaacgggaataatcagaccagttcaatccgaactggaattcctgaagaatccctgtgacgacgccgacagcaaagttaattaaaaagagatgcccccaaaatttagccattttgagataggtctcttgttttttgacaacataaagcgtctccatcaaagcaaccataaacacaagcccgatagacataggcacaaacaagaagtgaaacaatgttgtagatgcaaattgaatgcgggctaataccaactcactcatgatgtttttcctccaatctggtaaattgctcaacatttcacaaacatagtgaaatcattgctcggtatttcacaaaaaatgatatatttgctcaatgtttcacaaattcgtcaaaactattgaaatatcagcctgtacaccctgggggacagcggctgtcatagaaatgattcaatatcattactttacaacgattcagcccaaaaaaaaagatcaatatacctaaaatcaggctgaaattgtgactgattattgtcggatttgtagagattttatgtcagcacctaggatatttgtccctttgatatcgtacctcttttttattcgtgtggcgaacaaaatgcttttctcggtgaaaaagcccgccaaatcgccattttgagaaagaaaatgtgaagaaagcatgtcctctagtaaattcataatatatgaacaatttaaattttttagtatactttaaatggggatattttttcactacataacgactgggggaacaagcatgggagaacttcaaccaaaattgcaaacggattcaatccaaaaacaggaacggactgataactggtttgccagagcaatgaatataagaatcggcattattcctcttcctatctatatcctgcttttcttgcttattacggtgtttgtcatgagccgtgatgtaaaaagcgacattctgacatcaattgccgtcatgagttttttcggatttaccttcggccagatcggaaaatccattccgatcgtgcggtccatcggcggccctgcgattctcgcaacctttattccatccgctgtcgtctactaccacctgcttccgaaagacattattacttcaacaacagaattcacggaaagctccaactttctctatctatttattgccggtatcgtcgtcggcagtattctcgggatgaaaagagagacgctcgtcaaagctttcgttaagatttttattccgctgatcgccgggtctatcgcggccgccatcgtcggcttatgcgtcgggacgctgctcgggctcggctttcagcacacgctgctttatatcgtcgttccgattatggcggggggtgtcggtgaaggcgcgattcctttatccatcggctactccgatattatgccgatgtcccagggagacgcctttgcgcttgtgctgccgtccatcatgctcggcagcctgtgcgccattatgttatcgggtttgctgaatgtcatcgggaaacgcaaaccggaatggacgggcaacgggaaggttgataagtctgatcattccgctcccgcattggaacagccggccgatgataaaacgtttgatttgtcctttttcgcttcgggcggtattttagcggtttccctttatttggtcggcatgctggcgcatgatttctttcagcttccggctccagtcgtgatgctcgtccttgccgttctcattaagctgttcaggctggcgccggcttcgattgaaaacggagccttcggcgtctcgcgctttttctcgacagccgtgacctatccgctcttatttgcgatcggcgtttcaatgacaccgtgggacaagctgattgcggcgtttacaatcagcaacatcattaccattttatcaatcgtcgtcacgatgatggccgtcggttttctgaccggaaaatggctgaatctgtacccgattgaaacggcggttattaatgcctgccattccggccagggcggcaccggcgacgtcgcgatcttgagcgccgctgaacggcttgagcttatgccgttcgcccaagtgtcgaccagaatcggcggagcgattaccgtgagcgtcacccttctgctgcttcatcaattctattaaactgaaaaaaagcctccgcatatgcggaggctctgttatttcatcacattttgaatataagagccgaatgccgcgccggacatgcccggcgacacacggacgcggtgaagcccgtaaagcccctgatctctagacgccgctcccggctccgtcgtgaccgccatacggtagcctgacgaggcggcggcttttaatgtttctttattatatcgtccgacagggtagctgatcatagacgtccgctgcccgaacatttgatcaaataaacgcttagagtccttcatttcacgtcgctgctgctgcggtgtgagcccgttcaattcgagatggttcatcgtatggctctgaatggaaatgccgtgggcggccatctccttcatctgcttctcagtcagatgattcttatgcccgataaagtttccgatcataaagattgtcgctttcatcttgtatttctttaaaatgggataggccgctttcacattgtctgtatagccgtcatcaaatgtgaccagaacacatttttcacgcggctccttatcctccgtcagcatcagataggcctcttcaggagtcatcgtataatagccgtgatcatgaagccacttcatatgctgccggaattcttccttcggcacacgcaggctgtttccctctgaaatgctgtgatacatcagaatcggcagtctcgccatccctttcgtttgaacccaggcggacgtatccggctcttttttgatttgccgctttacggactttttttcgctgtgcgcttctgccttcggaatgctttgttcggcgcttgcctcatgacccgagcaggcggcaagtgtaaacacggcagccaaaaggcacatgcacatgatcatgcgtttcatcgttttcctgctttctgtcttctatttactttttatatcggttatgcgtcataaattgttacatcaaaaaaaccggacatccagctgtccggctttgcgttatgagcggattctgatttctgtttcactgtcaaaaaagtgagccttattcatgtcgaaagcgacggtcaattcctcaccggcacgaatgtcatggcgggcgtcaatccgggcgataaaatcctgatccccgatccgggaataaaccataatttctgacccaagcaattccgcgacattgattttagctgtgatggatgaattcttataagattctaccacaatcagctcgtcatgtatgtcttccgggcggatgccgaagatgatatctttgccggcataccctttttcccggagcattttcattttcccttccggcacgctgagagcggctgaaccgatctgaatggcgccgtccgtcagctttcctttgaaaaagttcatcgccggagaaccgatgaacccgccgacaaatacgttttcgggatgttcatacacttctttcggggtgccgatctgctgaatttttccgtccttcatgactacgatgcgtgtcgccatcgtcagtgcttctgtttggtcgtgcgtcacatagattgtggttgtttgcagcctttggtggagcttaataatttctgcccgcatctgcacccgaagctttgcgtccagatttgacagcggctcatccattaagaacactttggcgtccctgacaatcgcccgccctaatgcaacccgctgacgctgtccgccggagagcgccttcggtttgcggtgcagatactctgtgagccccagcattttcgccgcttcttcgacacgttttttaatctccggtttcggcatcttcctcagcttcagaccgaatgcgatattatcatagaccgtcatgtgcggatataacgcatagttttgaaacaccatggcgatatccctgtctttaggagcgatgtcattcactctcgtgtcaccgatatagaaatcgcccttcgtaatgtcttccagcccggctaccatccgcaaagttgtcgacttgccgcaacctgacggaccgacaaacacgataaactctttatctttaatatgaaggttaaaatcatcgacagccgcttctttttgatcgtaatacttataaatatgctcgagccgaagttccgccatgtatatccccctttatttgtaaacgctttcttaaataggattgtaacagcgtcagacggcggcggatataggcaatgttcataaaaaaagaccgctgtcttcgtgcacatttcccatttaatgtgatttttcatattgcagacaaatgaaataagccagcagggcgccccgatatgtcttaatatcaatacctgagcgttccgcaaatttatcaatccgatattgaagactgttgcggtgcaaatgcagttttttcgatgtgagcgacatgtttgagttatgttcaataaaagtctgaatcgtatgcttcagctccggttctttctgaaacagcagcgccgcttcttcgtgaagcaaggctgagagcttttctctgctttcctccgtgagcatggccggaaataccgtttccgcggtcagcgtgctcagctgcgggagatgacgccggccgatctgacaatattgctgttctctctgataatgaaggcgcagacgttcccccttgcagtaataccttccgacgaaaaaacggacactgaaataaaaatcgccttcgagaatcttcacaaaagatgcgatgtcatccgaatctggcgcttccagcttttcttcctccacaatcacgccatgatccctccccgtccggacaactgtatatgaaaccggccagaaatggcgcagcgcttctgtgaatgccccccagtcccgttctcccaataagtcataatggataaaacggacacgcggctccttgacatcaggcaccggaccttcttccagcagaaaacgccgccacctctttgctgccgccgtctccggaaaaaaaacgcctttttcttcagcgggcgtcaaaaatgattccagaagcagtttctccttcggggtgatatcctccttcggaatggcgacatagacccgccttttctcatcataaaagcaaaagacatcctccgccgtacagcacgtatcagacaacacagccctcgggtaaattgccaataacgggttcatatgcgctcctttctatcgctctatcatattttcagtataaaacgtccggccgattgtatccacttcgttttaagaaacagctttcaggctatttcccgggaaacggatataaccgcttctgccggcataagaaaaaaaccctccgcgccggcagagggatcctttttatttagagatatcgacgaagccttcaccaaagacatcacgcacatcatgaacaatgacaaacgcttttgtatcacagcttttaataatttttttgagcatggaaagctcttgtttctggatgacgatatataaaatttccttcgactgccccgtgtaatttcctttacccgacagcagcgtaacccctctgtccatcagcgtgttgacctgttcagcgatttcgtgcttatgctcagatataattgtcaccgcttttttcgtattcaggccttcaatgataaagtccatcaccttcgttccgatgtacagcataacaatggtaaacatcattttttccgcaccgatgatgaaataagaactgaagacgacaatcagatcaaagaacaaaagcgcatagctgatattccaatcgagatatttgttcgcaatcctcgccaaaatggcagaacccgcagtcgtgccaccgactcgaataatgatcccgattccgacaccggcaaacacacccgcaaaaatagtattaataatgagttcatgtgaaggcgagtgccaatcatgcgtcagatgcagaaacagtgagttggcgacaacggtaatgatcgtataaagcgttgtttttccgtctaaaaatttatatccgataatcaataaaatcccgttcaaaatgatattcgtcaccccgggcgaccattcaaacacatagtacaagatcagggtgattcccgttaccccgccctctccaagatcattcggaatggcgaataaattaacggccaaagcaaagataaaagctccaataatcagcatcagcacatccagcaatctctttttcatcccagacactcccttttttataaaatcaaaaaagcccgggagagcactcttcattaaaagagcagaaactcccgggcttttatcccaacgtgtcacagcaggaacctgctgtgtgttttctctcggtccagaccaattcagcattgcggaaccctagaaaaccactgttttttatgttcagtttttatattatctttcaagattatacgggaaatcacgaacatgttcaaccactcttttttcattaaacctatggaaaatgcgaacgatctgccgatactaaaaaggaccttaaaatacatgactaaaaaatcattaaaatactttttttctcaaaatattattgactataggttattttacaggcattatagtatgtagtttttaagaaatagtttacataggaggaaatattatggcaggcaacctggtgtcttgtaaggcatgcggcaaagaaatcgctaaaggcgttaaaaaatgcccaaactgcggtaaagatcagagaaactttttcatgagacataaaatcatcacattgcttctggcagtggtggttattatcattctcgtaaacatcggcggcggaggcggttcttcgtcatctaaaactgcgtcttcaaaagctgcggaatctaaagaaaaactgtataacatcggtgacactgttaagactgagaaaactgaagttactgttacgaaagtggaaaaaagagattcagtaggctctcaatttgtcgagaaaaaagcgtctgacggcggcgttatcgtagctgttcaatacacggttaaaaatgtttcaaacaagccgttaagctctttctccattccaagagcgaaattagtagattctaaaggaacatcttatgattcagatattgatgcttcttcaagctatgcaacagaaacaaaagtagacaacagtaaaattttaagtgacttgaacccgaacattaaagtgactgacgtaaaagcttttgaagtggataaaaacgcatactctaaaggcacttggaaattaaagttcagcaacgatgttgaagtgaaaattaaataatcatcataacaaaagagaccctcatcatttgaaggtctctttctttttacaccttttggtacccgttcacattggaggactgccacttccaagagtcggcgcacatttcttcaagcccgcgctttgcttcccagcctaattcagccttcgcttttgccgggtctgcgaagcatgcggcgatgtctcccgggcgccggtcggcaaaacggtacggcacttcttttcctgatactttttcaaacgccttgaccatctccagaacgctgtagcctcttcctgtgccgagattataggcgtcggcgcccgttgtgttcagcaccttttcgagcgctttgacatggccctcggcaaggtcaacgacatggatgtaatcccgcacgccggtgccgtcctttgtcggataatcattgccgaacacctgcaatcgctcaagcttgcccacagcgacttgtgcgacgtacggcattaaattattcgggatgccgttcgggtcttctccgatccggccgctcgggtgcgcgccgaacggattaaagtagcggagcagcgcaatgctccattcagagtccgcattatgcagatcgcgtaaaatctgttccagcatcagctttgtctgcccgtaaggattggtggcgcttaaaggaaaatcctcagtgatcggcgttgtttccggaacgccgtaaaccgtcgctgaagaactgaagacgatttttttcacaccgtgtgcctgcatggcttcacataaaataaacgttcccgtcagattattatgataataacggagcggaacagccacagactcaccgacggcttttaatcccgcaaaatgaatgacggcttcaatctcattttcagcaaacacccggtgaacggcggcacggtcaaggagatccgcttcataaaacacaagcccttttccggtaatgtctttcacacgctccaatgcttccggtgaactgtttgacagattatccagaaccacgatgtcatagccgccgtttaacagctcgacacatgtgtggcttccgatataacccgctccgcctgtcactaaaatcgccatgaagaaagcctcccctattgaatgaattgaccatattatatcggttttttcttcctcaatcatccatttccaaaaagtttaatcgtttagtcatcgtttcttcataatttattttcattcgcgtaaaaaacagagccctcgattcaaacgggttgtgaaatagaaatccctcccccgcgcatggtaagataagacaaaggagatgacggtatgaaaaatgaaatcattgaacgctttacctcttacgtaaaagtcgatacacagtctgacgaaaacaatgaaaactgcccttcaacccccggccagctgacattggccaacatgctggcagatgaattaaagtcgatcggcatgacagaaattacagtcgatgacaacgggtacgtcatggcgactctgccggcgaatacggataaagacgtgccgactgtcggttttctggctcacgtggataccgcgaccgattttaccggaaaaaatgtgaatcctcagattattgaaagctacgacgggcatgatatcgttctgaatgacaaactcaatgtcgtcctgtcgcctgagcaattcccggaactttcccgctataaaggccagacgctgattacaacagacggcacgacgctgctcggagccgacaacaaagcgggcattgccgaaatcatgacggcaatggcgtacttgatcaaacatccggacatcaagcacggaacgatccgggtcgcgttcacgcctgatgaagaaatcggcagaggccctcacaaattcgatgtcggccgcttcaacgccgcgttcgcctacacgatagacggaggccccctcggcgaactgcaatatgaaagctttaacgcagccgccgcaaagcttacttgttacggaaaaagcgtccacccgggaacggcgaaaaacaaaatggtcaacgcttcaaaaatcgcgatggaatttcatcacgcgctgccgaaagaagaagcgccggaatatacggaagggtatgaaggcttctatcatttactttccatggacggagacgtttctgaagccgccctgtcgtacatcatcagagattttgacagagaccgcttcgcagaacgaaaagaatatatgcagaaaaccgccgatgcgctggcggccaaatacggcaaggaaagcatcaagcttgaactgcgtgatcaatattacaacatgagagaaaaaatcgaaccggtcaaagagatagtcgatgtcgcgtatcaagccatgaaaaacctcgacatcgaaccgattatcgaaccgatccggggcggaaccgacggctcacagctctcttacatgggactgccgacaccgaacattttcacgggcggccaaaacttccacggaaaatatgaatacatttccgtcgatcatatggaaaaggcggtaaacgtcattgttgaaatcgccaggctctttgaagagcgcgcttaaaaccaaagcccctgctttggtttttttctttcacatgaaacctttccttctttctttccgtatataaggtatgaaatggaaagaaggagtgaagactatggcaagagggactgtagcgaaagaattgaaaaaaaccttaaaagacccgcgtgtactggagacaaaatcaaacccttttaaaaaactgcggaaaatgttcaaacgatttttttaagataacatctcgttttctttaaaaaaataaagaaagcgctgtcaactcgcagtcatctgttagaagcagttattttgcatatcataaggttttttagggtactgaataacacaaggcaaacgaaaacaccgaagtagttaattagacacttacaaaaaatagtaataaagttatataaacgatcatcattcatcagccgatacaatctatagaaccacaacaagagcaaaatttcttcaacccatagttatttttacggaaaatgacgttattttttaaaaaagtgacaattgtttgaatacttttcgtttgttttttcgtacaataataataccaaaactttttttgggaggtatgtaaaatgatgctacttattttcgctgctttgacagggtatcttgttttctctttcagtaaggacaaccgccggaaaacgccaaagacaagcccgctggtgacagctgccgacacgaataacatcattgatttaaatgcgatccgtcaaaaacgccggatgccgctatcataaaaacgacagctgccgcaaaatcggcagcctttttttatgcacccggccgatatgaaaccttccgcctccttttttcgtaaaacataaaaaaggagtttttttatgtaccatttttacatcaaagagcgaatgtttacgtttaagaatcgttttcaagtgtttcttgaaagcggaaaagaagtctacaatgttgaaggaaagctgttttcattcggtgatgaactgaagctgactgatttggacggccgcacgctcgccagcgtcaatcagaaactgatgtcgctcgttccccgttacgagatttccgtcagcggcaaacccgtctgccaagtcatcaagaaagtcacgtttttcaaaccgaaatttgaaatttccggactcggctggaatcttaccggcgatgtgtggggccggaattttcaagtgacagacggaaaatcaaaccggatgaccgtcaccaaatcatggatgagctggggcgattcctatcatttgcagattgaaaaggaagaggatattgctctttgtcttgcgatcgccatcgtgatagatatgattctatttgagggtgacaaataaaaatatttatcgaaatatattgacaatatgagaaaacatactaagattaagagtattacagtttattctgaaaaatagcatatttccttatcaagagaggtggagggactggccctatgatacccggcaaccgctgttcagcagaatggtgctaaatcctgaagataaggttgagatttgcggacgcaagctcttccctatccgagggaagagtttttttatatttcatttcatcaggaaagaaggaatcgttcatgtcacagcaaaacacagaacaaccattgcatactcttctaagaaaaaacccgccgtttcgcgcggatcaggtcggaagtctgctgcggccggcggctgtgaagcaagcccgcctgcaaagagcggcgggtgagatttcggcagaacagctgcgcgaaatcgaaaacagagaaatcatccgcagcgtggaaaagcagaaagaaaccggcctcaatgtcgtgactgacggcgaattccgccgtgcctggtggcattttgattttctcgaaaatttagacggggttgaggcatttacgcctgaaagcggcattcagtttcacaacgtacagacgaaagcgcgcggcattaaagtaacgggagatattgatttttctcagcatccgatgctcgaagattataaattcctgcacagcattgccggcgatgctgttccgaaaatgaccatcccaagtccgaatatgctgtttttccgcggaaaattggaaaaagcggcctaccagaatgattacaaacaatttcagcacgatgtgtcaaaagcgtataaaaaagcgattcaggctttctatgacgccgggtgccgctaccttcagcttgatgacaccgcatgggccgttttcttatctgaagcggggcttcgtcagattgaagatttcggcacaacgccggatgagctgcgcaagctgtttgccgcttccattaatgacgcgatcaaggaccgccctgacgatctgaaggttacgatgcatatctgccgcggcaacttccaatccacatggacggctgaaggcggctatgatgcagcggctgaaacgatttttgacgggcttgaccttgacggattgttcctggaatatgatgattcccgctccggcggctttgaaccgctccgctatgtcaaacgctctgatcttcagcttgtgcttggattgattacatcaaaacatggcgaacttgaagacaaggacgcgattaaacgccggattgaagaagcttcacaatatgtcagcctggatcagctttgcctcagcccgcaatgcggattcgcctccactgaggaaggaaacctgatcacagaagaacagcaatgggcgaaactgcgtcatgtcgtcaacattgccggtgaagtctggaaataaaaaaaagacacgcgatcagcgtgtcttttctgtttacagaggaccggttccgattaaaatatcgatatctatcgtaatatccgccgcttttcggctgataaaccgccggatgctttcatcagtacatttccatgttaagggcgtcattttcacaagccgctcaaggtcaggctgcgataaggtcttcgtgtaacacagccgtttgcgctcaaaggtttgaaagcccgcttggaatcgtccggccgcagaatcggcggtgtcattccgccgaggactgtctccgaagaagaattcccttacttccttcaaataatcacgccgcggcaccgctttaatgactgtgccgccctttcgtaaaagcctgctgcattccttgtaattccaaggtgataaaacagacatcacgacatcaaaacagctgtcggcaaacggcgcatccgccacatcagcgacggcaaaaaccaaatgatccccgaaggcctttgcggcatgcagcacaccttctttcgagagatcaatgccgattcccgtcacggaaaaagcgggctgaagcaatttgcatacggcggctaaatgagtgccttctccgcatcccgcatccaatatcgccgccgttgtttgcggagattgaatgcggctgatgatggcggcgatctccttttgaaccggcccaaaaaattcccggctgtcaaaaagagcgcgtctcgcttcgaacagctgcctgtcatagcgggttttgaccgatttattgaggaaattcacatatccttgctttgatatatcaaatgtatgcccgtgtccgcacatcaagcttttgtattgtgagaccgccatggccgaactgcatagcggacacctgaatacggactggcatgattgcagtaattccgcgcgttttctttttatagacgtcaataaaaacacctcattcattcgttattccgatgaaatgaaaaaggcatagacaaataaacctcgcaaaattggaagtttaacctatttatctatacctctcattatctgtaacgaatgaactgaatgatcatgaaaatgaccccttttctgccgtcttttgaaggcggtgccctcagatccattttatcagctgcatcccgtctttacaatgaaccggaactgtttttcgggggctttttatacctttttaatccaattacttgtgaacatcctttattttctttatttataatataaatttattattttgaaaatatctaaaaaggttgattttcaaaaattgaaacgataaaatactgctatctcatgtaatatcgttattcttgtatatgatcagtaatatggtctgattgtttctacctagtgccgtaaaagactagactacaagaaagtttgcataaatttgaacgagtgaaaagcatatgatgctctcagtctattcttttcttttggctcttatttatcacactttctggctttcaggaatttgtgacgaataagagctttttttatttccataatacccttataggagttgctcacatgtactttttattgaacattgtcggtctcattgttgtcatggctgttgttttcttatgttctcccaacaagaagaagattaaatggcgtccgattgtcatgctcctcgtctttgagtttctgattacttggtttatgttagggacaaaagtcggcggctttgtcatcgggaagatcggcgcgttctttacatggctgatttcctgcgccagtcaaggaattgcgttcgcttttccgtctatcatggccaatccgacggttgattttttcttcagcgcattgctgccgattatcttcgtcgtgaccttctttgatatgctgtcgtatttcggtattctgccgtggctcattgataaaatcggctggctgatttctaaaatatcccgtctgccgaagctggagagctttttctccatccagatgatgtttttaggaaatacggaagctttagccgtcatccgccagcagcttgccgccgtcagcaacaatcggcttctgacattcgggctgatgagcatgagcagcatcagcggttcgatcatcggatcgtacttgacgatggttccgtccacttatgtgtttacagctatcccgctgaattgcttaaacgcgcttttaatcgccaatatgctgaatcccgtggacgtttctaaagaggatgatattatttacgttccttcaaaagcggagaaaaaagacttcttctccacgatttctaacagtatgcttgtcggcatgaacatggtcattgttattttagcgatggtaatcggatatgtggcgttaacggctgcgttaaacggcgtactcggactgttcatgcacggtttgaccattcaaaagattttctcatacatcttcagtccgtttgccttccttctcggattaggcgtacatgacgcgatgtatgtcgcacagctgatgggcatcaagctcgcgacgaatgaatttgtggcaatggccgatctgaaagggcagctgaaatcacttccgccgcacacgattgccgtggctacgacattcctgacatcattcgcaaacttcagcaccatcggtatgatctacggatcttatcaatctctgcttgatggtgaaaagtcagccatcatcggaaaaaacgtctggaagctgcttgtcagcggaattgccgtttccttattgagcgcggcgattgtcggattgtttgtctggtaaaataaaaaaagcgataccgctccgttttagagtgatatcgcttttttttattgatagacggatgcaggcacgaaaacgtcccggattcctgccgcgtatggtccgagatcatattgtccaaacacaacggcaatgccgtttttcgtaaagaagaaaggtctttcgttattcaggatgatctcttgttttttgacgtcctggtcaaacagatcgtcatgtttcttgatgtagccgtaaagatagtctctcgttttgttggctttcgtttttgtattgagcacatcattgagtgtgacccgtttttttgcggccaggtcgtaattaaaggtctgaacggctgtcagcccgtgtgcgccgcctgtgtaactgtagttttccgtctgaatgctgagcttgccgccttgattatacttcaccttgaaatctgcctggtattccgctttgtagccttgtttttcaccgtcttttttgttttttacatattcttggtacgagttttcaatatagcgtttgaagtcctgattgattttcttttcaaaagatgcgtttcccgtatttgtgacctcggggtacgtcagctgctttacatgcttatacgtctggcttttgacgacgggctttgcagtttgcgcggcctcggctgaaggcgcgaaacctccgaacggcgcggctgtcagcacggttaagagcacggccgccatcattttgaatgcctttttcatcacaactcctccttttcattaccgttccctttttgaaaacggattacactctatagacagcgcagatcagcaaattgtttctgggccttctttcacattttctccatgaaaaaaagagacatggataatccacgcctcttttaccgtgaaggtctttgcgcaatggcttcataaacggcttccgccaaatcggagttgccgaacatctccaaaacgccgatgacggtttgatcaggaatcggttctgattcctccttcggcacgacaagctcttcagccgtttttcgcagctcttcgtttaaaggctgtccggggtaagctttgctgtaaatggccatcggatcaaggtcatgattgacgcaccattgggcaaacaccaaaatcatcatgttttcgtcacgccggtaatattcttcaagttgtttttcggtaaacggcttcactatcaatcgctcctccagaaaatctacccctaagatacacaaacacagggcggaagtaaaccaaagagggtgaaactattatttcatcaacccgcctgctttaaatagcgcatgccctgactctctaaaactgttgtctgaatgtccaggacagcggaagatacggatttgtacggaagcaattttcgttttctcccaatattctttcacaagaaaaaagcgcccctctcatcaaaggcgctttttcattcttatacgtttctgtcccaatgccgatgctcagccacggctttcagaaattgttcatggtttccgtccggaacaagaccggggccgctttcggttccggcggcgagggcgagaagttcttttccttcaccggaggcgccgatcgctttgtaatggctgaaagcttcgttgacgaagtctctggccgatttttgggctttgaggctgtctgtgctttgttttccgcccggaatgaaaacagcgtcgtacaggacggaatccgctgtcaggaacgtggctgacgcttcgagctccgtgccgttttctcccttaacggttccaagcacaggactgatgatatcggctctgactcccgcctgtttgcatgcgtcaagcacttgtttgactttctcatcagaaaacccgtggtcggttaaaaccgcaacctgccttgtcgctgccgtcttcaccgtgttttcctggcttaaggccggggaagtgaacgtttcatcagattcacggtccttcggcggcgggttcacgccgattcctttcgcaacacgctcggcaagcccggcgtcgacgtgactgaagacatcaaccacctgctgctgcacatccttgctgttcacttttccgacttcaaaacagaacgcggagatgatatgttctttctcggcgggagacatgctgttccagaacatcttggcctgagaaaaatagtcattgaagctctcactgcgctggcggatttttctgccttctactttttcctggtaatgaacgtatccgccttcttcttctgaggccggcgacggatcattgttctgcagggaatttttatgataggcgacagggcccttattaatcgtcatccggtggtagccgtcgtattggttgttatggaacgggcagaccggccgattgatcggaatctcgtgaaaattcggcccgccaagacggatgagctgtgtatctgtataagagaaaagccggccttgaagaagcggatcattggtgaaatcaatgcccggcacgacatttcccgggtgaaaggcgacctgttccgtttccgcaaagacattgtcctgattgcggtcgagggtcatttttccgatcagcttgacgggaaccaactcctccggccacagcttcgtcggatcaaggatatcgaaatcaaatttaaattcatcttcttcgtcaatcatctgaacaccgagctcatactcgactttgccgccgttttcaatcgtttcccataggtcgcggcggttgaaatcgggatctttcccggcaattttctgcgcttcatcccatacgagggaatgaacgccgagcacgggtttccagtggaatttaacaaagcgcgcttttcctttctcgttgacgaaacggaacgtatgcacgccgaagccctccatcatccgatagcttcgagggatgccgcggtcagacatcgtccacatgaccatgtgcgcggattcaggattgtttgcgacaaaatcccagaacgtatcatgagccgtcgcagcctgcggcatttcattgtgcggttccggttttatggcgtgaacgagatccgggaatttgatcgcgtcctgaatgaagaacaccggaatattgtttccgacgaggtcatagttcccttcttcagtataaaacttcgtcgcaaatcccctggcgtcacggacggtgtcagctgaccccttggagcccgccactgttgagaaacggacgaaaacaggtgttttgacggacgggtcctgcaaaaatttcgcccgtgtatattccgtcatcggttcgtacacctgaaaatgcccatgaacgccgtacccgcgtgcatgaacaacccgttccggaatccgctcgtggtcaaagtgcgtcattttttcacgaaaatgaaaatcctccatcagcgtggggccgcggacgcccgcttttaaggaatgctcatcctcagacacgcgaagcccctgattggtcgtcatttttttgccgctgttatcagatcggtactgctccagctgttcgtcctttgagtgttcatttactcgtttgttttgatcatcactcatgtcagttcccccttttaaaacgaaacattctacagcacatttacccgcggcgttctttaaataaactgctgatccgctcattaggattttaggtctgtatttacatatgcggtcatacacattttgaaataagccattttcacagaaacaaaatgtgaaagcgcttaccaaaacagctgttgaacaggggaggtcatatcatgcttgccatactcggttttgtgatgatgattgtttttatgtaccttattatgtctaaccggctttccgcacttattgctttgattgtcgttcctgttgtgtttgccctgatcagcggatttggcaaagatctcggcgggatgatgattcagggtgttacagacctcgctcctaccgggattatgctgttattcgccatcctgtatttcggcattatgatcgactcaggcctgtttgatcctctcattgccaaaatcttatcgtttgtcaaaggagacccgttaaaaatcgccgtaggcacagcggttctgacgatgaccatttcgctggacggagatgggacaacaacgtatatgattacgattgcggcaatgctgcccctttacaaacggctcggcatgaaccgtttggtgctggcggggattgcgatgctcggttcgggcgtcatgaatattattccgtggggcggaccgacggcgagggttttggcttccttgaaattggacacgtcagaagtttttacgccgctgattcccgctatgatcgccggcgttctctgggtgatcgccgttgcttatctccttggaaaaaaagaacggaagcgtctcggcatcatttcgattgaacacgcgccgtcttctgatccggaggcggcgccgctgaagcgtcccgctctccagtggtttaacctgctgctgactgtcgctctgatggccgcgctgatcaccagcctgcttcccatccctgttctttttatgatcgcgttcgccatcgccttgatgattaactatccaaatgtcaaagagcagcagaaacggatttcggcgcatgcgggtaatgcgttaaacgttgtctcaatggtgtttgcggcaggcatatttacaggcattctctcaggcacaaaaatggtcgatgcgatggcgcattctctcgtttccctcatccctgatgccatgggtccgcatctgccgttgatcacggcgattgccagcatgcctttcacctttttcatgtcgaatgacgccttttacttcggtgttcttcccatcatcgccgaagccgcttccgcttacggaatagacgccgctgaaatcggaagagcctccttgctgggacagccggtgcatctgctcagcccgcttgtgccatccacctatctattggtcggaatggcaggcgtcagctttggcgaccatcaaaaattcactattaaatgggccgtgggaacaacgattgtgatgacgattgcggcgcttttgattgggattatttcgttttaattaaaaaaggatttccgctggcggaaatccttttctgtacattatttttttgtatagcgcacccagtcataatgagcgtatagcggatttacaccattgtaggaaccgagccagtcatcgacacctatcccattccacaagttcatcatgatctttcccggtgttgtcgggatttggcttgtcgcagtatgttttaattgcccatcgacataccattttatagagttcggctgccaatcgaacgcatacgtatgataggcattggccgcgtcaaatccgagatccgcaaccttctcatggtttcccgcgccatttgtataataattaaattgaacctttgtcgtgtcttttcctaaaaattcgatatcaatctcatcccaaggggtaccatccgttggacctgtataagtgaagaacgatgaaacgatccccgtgtttttagccggtttcattctgacttcataaagtccatagccataggtttgagcggagcggttctccccgcagtcaaacttgttataagacgggcttgtcagcgccaaacgcatttcacctgatgacgtcacggatacattatttgcacgccaagtgcagttgaacatatctccattggagtaaccatttgctttttgccagaaaccggagttatagctgttaaaaggttcaaaaaacgatccgcctgtttgagctgatgcagcagaagtgatcgcacacaaactcaaaaacaatccagtgacaagaatgagcagcactcgtttcatacgataaaacatgtcggcattcccctttctttgagagcgatttctttatcgatcatacatgattctgttaaaagggaacatcggtcagaataatgataataacgaatcttaaaaaaacctaaattaccatcagcacaaacagaaatgatccgcgctcattgtaatttaggttttgcatgcttatcagcaacaatcctaacaagatcatatgtgaatgtaagaaaaaatgaatccaagaacaataatgccaacgctttcattatgcttgtttgactaccctttctatgtgaatcgttaaatacagcagctcgtcactggtgagcttgtgctcatacgccctctcaatgcaagtttggattttcttcgtgcattcatacgcccgacggtatttttctccagcaaaaagtcgatgtgtgccgttaaaaagacgctgcgcgaaaaactttaagtgggtgacaaaccgataatagtgaagcgattcttcgttgaattcaatcttaaaatggtattttacgatactcaaaatctcttgcatgacttttgtaatgctgatgatattgggcatctcctcattcagctcggcatttacaatatgcagcgcaataaaacctgcttcatcctccggcagagacacgccagtcttgttttttaccatgatcagcgattcttttccgattgcaaattcgtctttgtagagccgcttcgtttcccacagcaaggcgttttgatatccagccctttcttattgcgctgaatggcaaagtaatatggtcggtcagcgacacatagatgctgtcgttgagctttttgccaagctgtaatttcgcatagctgataatctcctcggatactttcatacactcgatcggaatatcatacaaaagggttttgaacttcggatacatctttgttatcgagggtgagcactttctcaatgcgggcttcatctgccggatctcccgttttcttttgaaaagcaatgccccggcccatgatgaccaattcctgattgccttctttgagcacactgacgacattattattattgactttcgcaatcttcaattccgtctccctcccgcctgaccatttacctgctacaccttgattgtacatcctttttgtaccaggtcaatatctccaggtcaatcagaaaacgccgttcagaaatcattgtccaacgatgaggcagaggcgcatataatgcagagaaccggtttttgggaaggagcgtgtgtgatgaaacggttttcgaaagaagaaagcagctggatgctgtatgattgggccaattcagcttattcggtcattattatgacggcggtgttccccttgttttttaaagcggcggcggcggaaaacggcgtcagcgcagctgattccaccgcttatttgggctatacgattgccgccgcgacttttattttggcgatgctcagccccgtcttaggaacgattgccgactacaaaggatgcaagaaacggttttttgccttcttttttctgatcggtgtggcgggcaccgccgcgctggctttgattcccggcgaatcttggatgctgttattaatttgttatacgatttccacgatcggctttgccggatctaatgtgttttatgatgcgtttctcgttgatgtggccgcaaaggagcggatgaatatggtgtccgccagggggtttgggctgggctatatcggcagtacaatcccttttctcctgagcattgccgtgattctgtcagcacaagcggaggtgattccgctgtccgcccagactgcgggccgcattgcctttttaattacggcggcatggtggggactgttttcgattccgctccttctccgcgtccgccagcgctattatatcgagagggagccgcggcttgtgatcagcagttttatacggctggccggcacgctgaagcagatcaggaagcaccgggcgctgtttttgtttctgctcgcctatttcttctatatcgacggggtcggcaccatcattacaatgtccacgtcatacggggctgacctcggcatcagcgcggcaaatctgctgattgttttatttgtcacacaggtcgtcgccgcccctttttcgattttgtacgagcggctggccgaacggtttaaaggaaaaacaatgctttatgccggaatcggcgtgtatatgattgtctgcacgtatgcttattttatggattccgcttttgatttctgggttttggctatgcttgtcgccacttcccaaggaggtattcaggcgctgagccgctcttactttgcaaagcttgtccccaaacagaacgccaatgagtttttcggattttataatatcttcggcaagttcgcttcgattatcggcccgcttttgattgccgtcaccgcccagctgaccggaaattcgtcagccgccgtgttcagcctgattttgttatttgtgatcggcattgccatccttgcgtttgtgcctgaggaaacggcgtaaaaaaagcctgcacgcggcaggctttctattttatttcttggctttatggactttcagttttttgcctttgaccgtcgtatttttcatgatgtcaagaacgtgcgggccttttccgttcagaatttcgacgtatgttgcgttgtccagaatcgtgataatcccgatatcatcggctgaaacgccgtcgattttcgcgatcgtcccgacaaaatcgaccgctctgagtttcttctttttcccgccgttaaagtacagtttcatgatgtctttgtttaactgttcgcttttgtctgttttgacatcggggcgggcgttcaatttttccgcaaaagccgctttccgttccgctgtttctttctcggacggcgcctcccgcttttggatgcggaaaccgatatatgtctcaatgtcattcagaaaccgcgattcagccggcgtcacaaacgtaacggcccgtccgcggtgtccggcgcggcccgttctgcctgtgcggtgcacatagctttctttttcaagcggaatatcataattgatgacgaggctgatgttttcgatatcaattcctctggcggcaacgtcggtcgcaatgagatagcggaactcgccgcgcttgaattcattcatgacgtcaaagcggtcttcctgcaccatgccgccgtgaattttatcacaagggtagcccagcctgtccagctcatcggttaactggatgaccctttcttttgtccggcagaatatgatgcagctgtccgggttttcggtgatcaggacatcacgcagcaaagatgatttatcctcttcttctgttctggtgacaaaatgctcaatgtcttttgtcgtcaggccttccgcttttacttcaatcaattcagggtctttcatatatgtgcggctcagcttctcgacgtcatccggcagcgtcgctgaaaacaacatggtgactctgtttttcggcagatgctgaatgatggcttccacctgttcaataaatcccatattcagcatttcatccgcttcgtcaatcaccacatacgccagccgttcaagcggcagcgtccctttttctatgtgatcaagcacacgtcccggcgttccggcaacgacgtggcttttttgcttcagttcggttttctgtttgtcaaaagaagcttttccgaaaaccgccgtggcttttatccgtttgaaacggccgatattcgtgatatcttctttaatctgcgccgcaagctcgcgggtcggcgttaaaatcagggcctgcggtttgttttcctcccactccgcaagctcgcagatcggaatgccgaaagccgcggttttgccgctgcccgtctgcgatttgacgacgaggtcttttttttgcagcgcggcggggatgacgcgccgctgcacttcagtcggctcggtgtattgcaagccattcagcgcccgtcggatctcggggctgatcgcatattcattaaactcattcatgactaaactccttctctgtccggctcccctcattatacgcgaaatgccgccgctttaccctgacgttttgccgggccgttcgggggactgctttttcttcatgtcgagcacgacccatttggcgcaataaaagctcatacttccttccccgtcatcgacatagtagcggatcgattcccagccgccgtcgactgggctgatatccagatggatgtcggtgatgctttcaagatcatccagccgggcagacctcacatcctcaaaccgcagcacggcatcatactgtccgtcagtcagcttcagctcaaacaccgggattttatcataatactcgttatacccggtatagaacgtaaactccgtcaattcaaaacaacccggcgaacctggccccggcagaactgctttctcatgtttgtgccattccattttgcgcctcctttttttcagctgaattgacatgtctgactcaaatgaatttttttcttacaaatccccatgaacttctttatattcctgcacccaatctcttaattcttctatcgtatgcagatacgcatcaggcgaatctttcagatcaaacccgctcaaatatacgagcatctcccaaacggtttcgtcctcatccgccggatcacctgcactcacatactcagacgcccaatccgacacttcttccctcgccgcttgaccgttcaggatcagaccagcctttttcagacattctgctcttgtgggttctttcacgtcaaaatcctgcctttcatttcttgtttaaaatgctgactaacagcctcctggcccgttcgtgccgcccgatttcctggctgagctccggataatccatcaaagcgtttttcagctgcgcatattgcggatacagctcaaaaaaggatttatataaggctttacgctgccgtgcaggcatttgtttattcgccaaaacaaaatctaagctgccgcagacaagtgcgaagtattcataaaaatccccagcgcaggcagcaccctcaaagtcttcttcgaatctccctgcatctgaaggcagcggcccctctaattcttttttgtgtaatttcaagcttctgatgacgtcattatttaaagaatatctgttggatcttaacatctcatttagccgctttcccattactgatatcccgcttataaatccctgaattcgagaccgcgtaaatggcatcgccagtcagcttcagctgatgcccggaaagctcatcgccatccgcatcacagcacgttatctcttgcatcggcagactgacatcggccggaatgagagacagtgaatgatcatctttgcatacccaaaacccgttatctgaaatcgctagctggtcgtaaaccccggaatatgctttatcagaaataatccacactcgtttcacgtcggtttcttcaaacgcagcaatgactgtataagcgtaatacagcatgtagattagtccgtctttttctgcaagtgcataacagtcatctaccgcgggcgcatatatttctgaaagctgctgatcaatgtgggttttctttagctgcccgtctaaagtgaagcacagcacactgtgcccttcaggattttcatcactataaataccttcatcacttaaaccgatccacaggttttgtttttcatccaaaagactgcatgaaacccctgaagggagagaaaatgcactttgttctgttccttctgctgaaaatactttcactttatactcatgcgattcaaagaaaatcaacacataccagtcagccgaactctgttggaacagcataatatcctcatacgggatttgttcatcgatatgaatcactcgcgtatcgcccgatttgtcgatgatcgtaaacgaaagcccgccattctgatgccgtccgagatacagacgcccgcagttatcaaaatgacaaaaacatccttttactgattcttcgactatcttattcatttttattttcatgtcattgccccttgagtcttggatggtatcctatttatatcgatcgttcactccgtaaaatgatatgcagatggctgtaaaaagccatctgcataggattgatcaatactttaccagatataaatcgttatcactaaagataaacatgcgatcctgtacggctctgtacgttgtttctccttttctatcaataccgtgtatcatgacgtcagtctctttgtgctcttcatgaaatgcaaatagggtatcatcgtgactctgaatcagcagcaccctttttttcgaaacggatagctgatcacaataggagtattgatcgccgtccagcacatattctgcaacagtacgaattctgtcccgtccaatctgataatgcccgatgacacagcaatcctctccctcgaaacatacatacaaatcagatttgatcgattgtacggcatagcattcgtgcatcatttctttaaaatcgtcttcaaaataaaacgttctgtcttctgcatgaaaagcaaatatcgcttttccttgaggatttctctcatcatacataccctcgtccgttaatccgatccataataatccatcctcacccagatgaaatacattggcgcttaatagaaaagaacaaatcggattgattttattactgtttacgcagtatgcagccaattgacacgtatgattctccaggtaaacgatcacgatagtgtcatcatacgaatcaatcagatagaaatgggcatcttcagaaaatccgtgtaactcttttttgattaaaagagagctgcctttcataacctccaatattactttgtgatcgtgcaccgacacaataaatacttgatcatcccgacccgcattgaaataaatgatattttccctttcatatgacccaacacgctccgcggtaagttttaacatcagcaacactccgttgaataggaacctgaaatttatattaaattaatcaatgatatataaatctgctgcatcgtattcaaaccaaatgattttttcattactttcagtagttacatcaaccttttgagtgttcaggttcatgcaggacttatttttggcagggtttgctattataacaacaaaatcattgatcgatgctaaaaaatataattcatctaataagtaatctgccatcaattcttctttggttaggacacattcaatatgaatgaactttttcgatacagtattcatatttatcattttcttttcaaccttcttcttccattcttcaataaaagaagggaatgccattacttctattagagctgtttcgaactctaagtcattcattaatttgagaaaaagtatctttactcactagatcacatgaataaatcgaattgtatttaagcggattaatcacatccagattccctatagccctcaatgattctttttgtaaatttaaaggagtgttcatgtttgcctccgcgaacgatttcgttatgtaagaaaagagaggctgggaacctctcttatttgtttatttatgatttcggatgatacgcataaaatgattggtcgtcaaagcgaactgtttcagcttctacagcaatcagcattctgttcatgtcaatgagaaaattagcatttgattgatactccggaattacagcatttgatagattaccgattccttccgggtggtaactcatctcaaatacttgccaattgtattcttccgaatctattttttctaatctcatatcaccaatatctgcactaaaataaacagatgctgcatttttaacaacctgaaccttaaaacaggtcttttttaaagaactgataatcgacctttaaaatattacatccctcgtcaatataatctactctattgttcaatttgtttgtgcattgtcttctccttctcctaactaacactaacaaacccattgatagaagtgtcttgatgataaacatagattattcaaacaagccccaaaaatatattactctgcatatttgtcattaaatatctgttgaatgcaaaaatactatctggagattatttgaaatcccgtttagaacaatcagatgatatcggtagtaggtattaaaaatatacttatttgtaatgtgccgtaagtgttttttcaaattcaactggaaccgtctgatttgggaatacaactgatatccaatctaagacaacgccatctaacgatctccaagttgctagttcttttccttcactctgatgatcaatacctagaatacagatttcaagttctctctcaccataaatcgcccactttaaagtcggtgaagcccaaacaacacgagatgcaatattcattatacagtcacttttactgtgctttggataatcagttaagagtgacagatactcatctgcagttatatgcaaagggatctttatccagttaaaatactcaaattcttcgtagaattggtttatatgttcagaactgtctataacagccattaatataaactcatcatgatgttcattagccaaactcttaaacattccccaactttcttcagataatacccaatggaattcctcgaataaataataatttttcctttgcttaaaaacttgtttaggcaatgtttgatctacgtgacataaggaattaattatggattgatagacttttaactccttaggatgatcaataaaatagtgatccatcttatttcccctttaatgtcgcattctgattttgtgtgtgaatttttttctacctttaggtgtatattccgcggttggatagggacttgacttagcatgtttccttagggaatacttattcccatttttcgtcatagtgataacaccccatgatgaactgattttctccatccttgtcttcttaaatttttttcaaaagttcttctttttacattagtagaataatttttgaacctagaagtttttccagttatatccctataacttgagtaggcccttctagcccgtacactttttctagatagtttatatgttttagcagctttataaatccgattagcacccttaaataacttcccaggaccaaagttcgaagccgctgcccaggctgcacctctccatcctttacctgatttatatgccttatatccgtcataagccgcaaagccggcgttaatggctagccacacccaatgcccatctggatcaacattcatcaccgggttgttgtttccgtatgcatatccattctgatctaaagaatccccatcgctgcccgggtctgggtctagtgataagaatacaccgtttcttggttcgtagtagcgggccatgagatagtacaggccggtttcttcgtcgtattggtagcctgcgtagcggtagcggttgtcttttacttcgtcgcttgcttcggtttttgtcggatttccccacgcatcgtactgatatttggcaacggtttttccggtgctgtctgagatggcgatgacgtcgccgtgtgcgttgtagtgatagaaatatttcttgccgttctctgtataggataacagctggccgctgtcaccgtacgtatatgattttgtgacgttgttgtcggcgtctgtttcatacagaacgttcaagctgtctccgtcatagaagtagttcgtaacgtttccgttgacggttttttggattctgtttcctttttcatcgtatttgtatgttgcgaacggcttgtcttcgccttttttcgtgacggcggtcaggttgtcttccgcgtcccacgtatatgtgtatttgccgtcagatatgcggttgccgtttttatcataggacaggtcttcgtcattcaccttcgtcagctggttcatgatattgaatgatgcgttgactgatttgcttgcgccgtcctttgtggtggtgacgtttgtccggttgccgaagccgtcgtacgtatattgaatgacggtgccgtcttcatgagtttctttgacgagctggttgagcttgccgtattcgtactgcacctttccgccggctgagctgtcgatgaccgtgcggttgccgttggcgtcgtattcatagctttcccggaagatgctgccgccgtttttcgctccgatatgaagagagctgacaagattccgctcatcatatgagaagctcgtgccgacttcatttccgctgatgaatgtctggacattgccgttttcatcataatcaaatgtataggctgaagtgccgtctttcatttcaatcatttgatcaagtttgttgtacgtaaagctgtttgttcctttttggccgccgtggctccatgagaaagttttcagcttatctgaatcagccggatacgtccagctttggctgccgccgcggtcggttaattcggtcaggcggtttttgttgtcaaaggtgcgttttttcgttgtattttgttctttgtttgtgaccgacgtttcattgccgtttttgtcataggtaaagttgtatttttcagtgccgttatacgcttttgacttaacccggtcggtgccgtcataggtcagcgacacttcattgccgttggcggaaacggttttcgtcaggttgctgttggcgtcatattcactcttcagtacattgccgagcgggtcggttgttttgacgagcttgcccatgacgtcatattcatattgataggtctggtttgcgccggcccgaatcgtttttgtcagctcatttccttccttgtcatagctgtgaaggatggatgtgccgtttgacagggtcagctttgtcagctggtcggcctgatcgtattcgtaggcggttgtttcgcctttcgcgtcggtttcagacattttcttgccagtctcgtcatatgaagcagtgcttgcataacctagttcgtcttcttcttttgtgacgtagtttcctttttcgtcataggtgtttttcgtcaggatgcttccttcgattaatcggatgtcatcaaaccacgccgttcctgtggcgcttttttggaacagaatgctgatttcgattttattgatcggctttgttttcggaatgactgccgccgcccggttccattcctgtgtcccctgcgggaatttggcggtgtagacgcccgtcgtgccgtccgcataggtgacgccggcctgaagcgcgtaatcattgtcgttcgttaattttacgccgtctgccttggacatccctgtcagcgtgatatataccggcttatcgtccgcgctttggcctaatgtgacggtttgttttgcggccgcattggcttgtgatgcatttgtgcgggacgcttttaatgagctgtcatcatcgaagccttcatcaaggtcagcggcggctccgcttgtgctccagccatctgctttagccgtgaaactgctgttttgaaccgggttatagcttgaagagacttcgcctttttccagctgaacctgatcaaaccacgcttttcctttgccgtccttgtctttatgatccacttccatatagacgatggcttttcctgcattggccggtgttgtaaaggtaatctgccgtttcgtccagtcattctttccggctaatgcgcctgattcattgtgaatccattgaatgcgtttttggtctttgtcacgcagatcaatgttgaaatacgctctcgcctttgtcagatccgttttgatctggccgctgagtgtatacgtcgtattcggctcaagctgcacttcctgcgttgcggacgcatggccgtgctctgttccggctgaagcggattgtgaggtgatctccagtgctttttgtccggacagcgcgccgcttcttgcttttacagacgcgatgcttccgctgtctctcgtagcggtgagattccagcccagctttgttgcttcaaagctgccgtctttcagcaggcttgccgaagctgccagctctttgcttgattgaatgagatttccatacttgtcatacacggcggcggatgaggattttccgctttgatccgtctcagaaacagcatcaagtccgtcgtacgcaatatcagtgacgttcccctcggtatccttcattttcgttacgtcattgtttttgttgtactgatacgtttcggtgccgtagttgtcttttacggctgtgacgttgccgtctttatcatattgatagctttctgtcgctttgcccgcatccgcgtcgttcggatcggtgtcctgaatgacgttgttgccttcgtatacagtgttggtcgtgattttcagcccttcggcatcatcgatcatctgaatcgggttgcccgcctcgttatagccgtactgcactttgcggccgttcggctgcgtcatgagcagcgtttttttgccggcgtcatagctgtaatcatacgtttcttttttcgcattaacggctttggccaggcggtgcccgctgtattggtattcagtgaacagcggtttgtcatccgtgctgtttgcggaatactgcttgacgaggcgcccttcggcatcatagtcgtagcttgtgacgctgccgtcagtatccgtcacctttttgagaaggtctttgtcatatgaatacgaaatctttttgtttttcggccctgtaagagatgtgacatggccgttttcatcataggtaaatgtcagcttgcgccctgatgcgtctgttatggcggtcagctgattgctgtcgttatattcgtatacggttgtgttgttgtgtccgtcaacgactttttgaagcttgccgccttttttgctgaaataagcgttcgtctgatcctttgtttttaatacaaattggtcgcttgtttctgtcagttcgagataaacacccgtcggcggctgatacgtgccgtcagattttttcgtgaagacatgtgttgtcgcgtcctcatcaatataaacggctctgccgtcttcagaaagaatcgacatttccgcatcggcataccagccttggccgaacatatggtcagagctgtcaaggctgttaaaggtccgggagagtccgagcccggcccgcgtccgtcgattgacatatcttcttcattgacgatgacatttcccgtcgcgccgttcagctgtccgtccggaatgtcgataatagaccagaattcttccgttccgaggaattccgcaccttcatggaaaacagggttaaaaggtgccgtcggtatactgtcaccatttgcgtcataggcggtcagcgtaaaggaatagttcttcttccctttgtaattgccgtttgcgttttcgtaaacaggtgaagggtcaagcgccagttcgccgccctttccgtccgtgtgaagctggaattttcccgctttcacttcatcggctgacggccagatgtgtttgttttgggtcgtccaatgatcggtatccccgacatcgaatgattgatagtcttttccgttgtagatgttgattttgtagcctttggcgtttttgactttatcccatatgagattgacataacccgtttggctcgatttcgtgttcgtatagacgtagcctgtcagatttttcggctttgcgatatcaggcagcgccggactagcttccggtgaggcgatcgcttctccgtctttgttataggcgattactttaaatccgtatgttttccggtttgcgtctccgccggcatttttataaacggggcccgggttgatcggcaattccgcgccttttttgtctttcaggtgaagcgcatattttccggcgctgatttccgcctttgtcggccagatgttttgattttttgtggaccaggatgttttatttccgaggtcaagcgtttcaaagcttttgccgttaaagacttgcattttatacccggctgcgcctgatacggctttccaggaaagatcaaaccagcctgtggcgttgttgttattaaagcctttcgtgcttggtttctgaactctgccaatattcggaatgacgggcttggcggccgcagacatggcgccttctccctggtcaaacaccgcgctgaccgcgacccagtaatttttacttgccggatagctgccgccggagtttttatagaccggcgaaggattaagcgctaattcacttccgccttttccgtctgtatgcagcttatatttgccggagtcgatttctgcttttgtcggccagatgttttttccttttgtgctccaagaggttgcattgccgacagaaatggcttgatattctttcccgttataaagccacactttatagcttttggcgccttcagcttttttccagctgatattgaaaagtcctgtcgaatctccgttatgatacgctttgacagacggcgtgtccgccttcggaatcgtgtatgtcacttcaatgtatggttttttagcagagtttgctgatgacatcagcttcttccaatattcttttccgttgccgtttgtgtgaagcttaaagccgtaattggcgccgccgctgttccacgacttgactgcggatgtgacatcgaagcttgcccattggcctttatagacctcggctttgccgatgtttttggagcccggcttgtttttccacgtgatcttggcattgtcgtaattgctgtttacggtgtcgagccaaagccccgtcgcctttgatccgtaataggagtgggctgtgtatgctttaagcgtcgcttttgtcaccgtcatgtttttgatcggctttagattatcaaacttcataaatgcgtagttcgttccggttgtgccgtcataataacctgttttcagcacgtacgctttcaatccggcctcccatttctgcgacgcggcagagtagtttgtcgtcgggtacgcactcatgacaaaggtatcggatgacacggatactgatgtggaaggatcaatagataccggataaacccgcttgggatctttcagccatttttcatcggccgttacatgcagcaagtagccttcgctgtttttttcaagcttgaagctgacatcttctgacctgctgacctcacctgacttctcgtcgagatctgagtcggtcataaaaggcttcggcacggtgtagacgacattgtctttgtcatcagaaaacgcgatcgagccgtcttcctgttctttagcctgaaggtcggttttgatttgaaaggtgaaggaattgtagccttcatatttgtgaagcacaaggtcttcttttatgttttcgttaaatgtgtaggtttgtaaatcaatagcaggaaacacttgctgatacgtaagctcgttgctgtcttccttcacttttgctgaggcatctgtcggagtgattgcagcctgatcggggccttttgcgccggttaatgagtatgtgagcttatgatcaccgtgttcaaatgtagcgtataatccgtttttcatttgcttcagaaaatcggagttcagcactgtattttccgtcccgacatcctttgagccggttttcaattcaggagaaatgtcttcccagtccgcattggcggtttctttcgtatgaatggggtctgtgtagatttcctgtttgtatacaccctcgccctcataataaagttttgaattctcagttctttcagacgtgatctcaccgtcttgattgatatctttttgatcaaacggcatctgctcggatgctttttccgccggaagatctttttccgggtctgctgccggaatggcggcggttttcgcttgatcttgtttttcacgcgtttctgccgcaaatacatcggcaggcgcaatggaaatcataagcgttgccgcaagagtgccggccagccattttttccacttgttcttttttcctattttcataggttctcctccttcttttgtaatataggcttaacaatagtaatattattgaaattgtttatcaatattttcctaggtatttaaggttattttaaggattataggaattttgaaccttttattcatataaaaaaaccgccggctgccggcggttttttgtattatggatagcggagatttgtattttgcgctcccgcgtaggattgggcgaagtttttggcgtcctgggctgaaagcgtgccgtagctgtaatttgatctcggattccagccggtgcgcggtgatttcggggctttgagcgacgggaatgaaccggtgtcggtgaattgggcggtcccgtagtcgtctatcattccgcctttttcatttccgttaccgaaatagttggcttctgagaagacagtcgcgtttgtatgaatggtgaatcctaaattgaaattggtcacatagttgtttttcgcgtgaaaatagccgtatctcatcaggcccggtgaacgcacatagacgttattaaaatagttgttggtgatcgtcatatgcggatagccgatataattgcgtccttcgttatcatcattcggataaccgagaatcaggccgtacagatggtctgtgaatttagagttagacagcgtcacaaaatccgctttggcgccgacatacagaagctttcccaaatcgctgtggctgttcggattgtagctgtgtccttcaaaccacacgtggtcaatccagtaattctgcccgttcgctatgtacatcggaatgtcgttgttgcctgtaatggcggcattatggctgataatgagatttttgaaaatcacattgtttgatccggagccggtggtcagatagatgttggtcagcctgtggctggtataagagccgacgatggttttattggcgccgactgtcacaacggctttccccggggaagaaatatcacttgtgatgacgatggttttgcggtccgttccgcccgcattgtttttcagatcattgagattgctgacgtagacgacggggccgccctggcctcccgatacggcggattttgcttttccgttatgatccttcgcattgccagcgaatccggtaagtccctgcatcacatccggataagccgctgccgcttctgcctgcttggatgcggaacatacgatggccagacaaagcgcaaagccgagtgcagccaagaaagcgagatgacgcgtcttctttttcatgcccttcactcctttaatctcttaaattgcaaacacatgaagtattatacaattactatcctctttttccatgatctgtttgtctgctttttcgttatggctgaaaagccccaaaacaaaaaaagcagccgatacggccgcctatatacgggtgctgtctgcctgagtttccgccggcacggctttttgctttcgaatcagggacagtgccattcccgcaaaaatcaacacaatccccaaagattgataaaggtcggggcgaaaccccgtaaatacggtgtcaagcacaatcgccaccgccggatcaagaaatacgatgattgatataaaccgggtggataaaaaccgcaagctgtcaaaaaagagcaaatacacaattcccgtatgaatgataccggttgacacaatcatgatccagttcacatgcgacaaatcagaaaaagcgccgaaacggacgaacgggagaagaatgataacgcccaacccggtctgcaaacaggtgaccgcatatgggctgagactgttgatacctttcccggccagtgtcgtaaaggcgtaaaaaagggcggccagcacggcccaaataatacccgatcccatcagctgagaaaatgacgtatttccgttgatgccggaaatcagggcggtgcccagaaaacaaatcacgatggaagtgacggacacaatatgcagtttctcccggtatataaggctccctagaagaaggacgagaaccggagccagatgataaacggaaatggctatcgtcactgatgtctcctcaaacgatttaaataaaaacacccagttcagcacgagaaaaaatccgcaggccaatgtctgcaacacctcgcgccggttccattgttcggtgcggtgccgtccggaaccaaaccagcaaacgcccagaaacaaagaggcgcacagacatctcacaaagaccagttcaattgaaggaacattcgtatgttccgagaaaaagccgattgatccgaaaatgaccatggaaatgaccattttgatgacggcatttgatgtttgttcagcttgcattgatttgcttcccccatatcattgactgtttattcagacaaatactaacagccattttacttgattcagaggaagatttcatcctatttttcgaaagacggcggtcttttctcattaaaaaaagccccgcatcagcagggtcttctgtttaatgaacgatcagtacaggacaaggagacaattgtgagaccttatggctcacgcttccgagcatcatttctttaaatccgctgattccgcggcttccgacgacaatcagattgaaatgctgttctttcgctatgtttaaaatttgatgcgcaggttcgccttggacgtacaggctttccgcgtttaccccgctttcagccgctttctgcttggcattttccagaatggccgctcctttttgctcgacttcatgtttgatgtcttcaatgaagttttccggaacatagacaatccctgttaaggctgatgtggagacaacggcttcacgtcccgcataaagaatggtgagttcagcctgctgttctttcgccagatggatcgctgcgtccaaagctttgctgctcatgtctgaaccgtctactgctgcaagaatttttttaaacatatgaatcccgcctttctgcttttattgtcctcctctctttgctgaatgtcaattttgccggctttctccggaacattgcgcttacagactttctccgtttgtggcgatgacgtctttataccaaaccaaactacctcagcgttattttttaagcgcttaataaataggactttattctcttctttttcagtattacctattggtaaaagtagtgataaaatggaattattgatataaaaaaggagattatgatgagaaatcatagaggcttccatgaggaaattcagcaacaacaaaaactttatccaacatcacatcgcattcaaccggtcagcccaaaagaatatgcagaagttttgactttacatacggcaaaacaactgagcgagacatttcaaacacttgtggatcaagatcaatatgaacaagcgattcagctgagcgagaaggtcgcctctcagcttggaaaacatacgaatttttcattgccactttccacagtgctttatagtttaaatgaaatggaacttcctatttcagaggaattttctctacatcgtctgaaactgctaggaaatcatcaaactcatgagaactttttcaaagcaataaaacacgaaatgttaacggcggatcgggtagactttatggttagtttcacaaggtggtctggtgttcagcttttgatccctccgcttcaggagcttgctaaaagacatgtccctgtacgcatcattacatctacctatatgggtattacagaaccgaaggcgttaagacatcttcttcaatttgaaaatgttgagttgagaattgtaaatgaatataaaaaatctttccatacgaaagcatacttatttgaacgctgttctggacagcatagtgtcattgtaggatcttcaaatctatcacaagctgcccttacgactgggtatgagttaaatgtgagactacctgaaaccagatatctccccgtttatcaacaaacaaaagatttgtttgacactgtttggaatgaaaagacacagcctgttgacgaacaatttttacaagcctatgaggaattccaagctggaagccaaaaggtaagtgcttcctttgctgctcaaaactctctttacaaaacgaaaatgtccccgaatgccatgcaaaaggaagcattacgaaaccttaaaaaaacaagaaacgaaggggagacaaaagcagtcatcatcgccgccactggaaccggaaaaacatttttagcagcatttgattttgagcaatttaaaccaaataaatatctttttcttgcccaccgggaagagttactttcaaaagcaatcgaaacattcaagaaagtcacaaataatcatgaagattttggcttattgactggcacgaaaaaagaaagagataagcgttttttatttagcactatacaaacgttacataaaaaagatactttggaatctttttcaacagatgagtttgactacattgtgattgatgaattccatcatgcagaagcatctacctatcaagctgtattaaactactttacaccaaagtttttattaggtttaactgcaacaccagagcgtcttgacggtaaagatgtgcttcagatttgtgatcataatgttgtttatgaactcagactccgcgatgccctaaaggcagagctacttgcgccatttcactattttggaatttcagatcatactgtagattacgaaaaagtaaaagtgaaaaacggactgtacgaagagaaatcgctagtcaatcatttaaaaacgcataaacgagtagaatatatcatcaagatgatcaacatgtatggattccacggcgagaaaatggttggcttaggtttctgtacaaacgtcgaacacgcaatatacatgagtgatgaatttaataaattgggtttttatacaacttatttaacaggaaatgattctcctgcaaaaagacaagaggtcattcgtcaattagaggacccgcaccacagtttagaacttatatttacagtagatattttcaacgaaggaatagatatcccaaagctcaatctactattgttccttagaccaacggaatcaccaacgattttcattcagcaattaggacggggacttagaaaaactgacgacaaagagtttgtaacgatactggattttatcggaaactatcaaaagtcattcgttattccactcgcactatctggacaaacaagccaaaaatcttttgataaagattccctccgagtggccgtgacgcatgagttttcagatttacctggaggatcttatgttgacctttcagccataacgaagaaagaaattttaaataagatcgatcacattaaactaaattcagatgccatgctgaaaacgttatacaagcaatttaaacaagagctagggcgctctccagaattaattgattttctatactctgaacaggcacctgggcttaccttttttataaagaaatacaaatcgtgggtacagaccaaaaagaaaatggacgatttgaatgttacagatgaagggattctcaataaccccttggttgtagggatagtagcaagattagaacagcaattacctattaaatggccttatgaatggttaattttacagagcggttttcacaaaaatatcatcacaatagaagatgtaaaagaatcgttagaaaaacagtttcatattcaaatcacaacagatacacatgatgacctcattcagcgagcaatggagcgtttaacgaaatcagatcaaaaacagaattggcgctttggtacattacaaggtgatacattcaagttagatccagaagtaagcgagattttaaccgatccattattcggaccgtatattaaggagcgcgtccactatggactgattgaatttagacgtatgaacaatatagaagcccttgcttcaaaagagattaagctaacattgtatcagacctatacaagaaatgagctcatttatctttttcagtcaactgatcaggaagggacttggcgagagggtgtacgtagagttaaaaatcactatttaatctttatcaatttgaataagtcagaaaaagtagaagatcatttgctatataaagattattttattgatcctagccattttcactggcaaagtcaaaaccaaacctcacatatatcaagcgtagggcaaaactttattcaccataaggaaaaaggataccatattcatttatttgtgaggaaattcactgaaatgcacaacatcactttaccatttatttatttaggagaagcggattacgtatcaagccacggagacaagccaatgaatgtcaaatggaagctccatcagcctgtcccagaaaacttgtatgtggatttaacgaattaaagcagatacggtcggaagatcagcgggtgcccactctagtgattctagctcacgaataggcacccatctgaattccgcatgctcttttgctaccggcttccctgatacaatcctcgcttttattgaaattaaattgacgatgaccttctcatattcatgatgaatatcagctatcacatcgcccgtaacaattttacaatcaagttcctcttcaatttctcttacaagtgcttcccgagcattctccccttcttcaagctttccaccaggaaactcccacagattaggaagagacattgttggagaacgtagagcacatagaatttcattgttttcattttgtataactgcggcggctacttttattgtttttttcaaaattaaacttcctttcgttttttcttaggtatgtattcatatttttgttatcaattttatactgttcactgtaaacgatagaggttgagtccatcataattcaaatggtttattaaaagcaatagaaggtcattctcctaattagcaagaaaaaagcaccctccaaactggagtaggtgctttttcacttcactccccaaacagcctccccatcaccgctcagcacactaaacgtcacaacttctttctctctcgctgagtcccattctttcaggaagacaccgtcataatgtgtgccgttcaggttgattcgggctttgctgctgttcgttattgtccaggttccggtcatttccccggaaatggtgccgtcgttgttaagccggatggtttttggggttttgatcgtagctgtaatgtcttttccatgctggatgagtttgtaggctccggatgcggcggctgccgatatgtgtgtatccggttctcctgcgtagcggtacggcgctgcaacgggccatccgtctttgttcatgtacagccgatgcactctgacttcgtgctcttcgcctctgttcgggaaacgggtgtggaaaatgaggtatgatcgtttcgttttcccgtcgtaaaacacggagttgtgtcccggtgaaacgtagcccgtgcctttttcagattgtgaggcgaagctgtagccgcccatgagtttgaccccgtacggttcaattgctttgtcatcgaagaaactgccgtcttttcctttggcgtcaagcatgttatggcctgcggcgtcatagtacggaccgtccggatttttagagcgcgccacacgcatattgtagccgccggctgtgtcaagtccgccgaatgacagatacagatagtaatatttcgtttccggattgtagctgatgtacgggccttcgattctgctgtgatttccgccgagcagtttttttccgtagccttggttcgggagcgggaaaccggttttcggattcatttccagtataaaaatccccccggagtaagagccgtacaccatccagagcttgcctttatggtcaaaaaacgtttgcggatctacgacgttcgggtgaacgtttgcatgatacgtcgtgccgtcttcgctttttccttccatgcctgatttcaaaaagatgcctttgtttttgtagggtccttcgattttgtcactcacggcgacaccgagagcggatcgcggcgagtctcctttacaggcgttatagtacatgtaatatttcccgtcagccagctgagccacatccggcgcccacagcgtatcagactgggcccagtcgaatgtctcttttaattcggagtagacgttcgggatcaggggattattgggattgacgcttgaagacagttgctgccactgcatcaggtttttcgacttggcggaagccaaatgcgagccgaatacatagtatgtatcgcctgttttgatgacggacggatcatgcacgctgacctctgaaaaaacgggatgctgggcttttgcctgcggcagagtgaacccgataaccgctgctgagaccaggcacacacgaaagaaactggttttcattttctgaaatctcctcgctctcttcttttcttaaaacgctttcaagacaacgctctattttatgacgcggatggcggaaatatgtgatcaacagcgccggcttcccgatgtaccgctttaatacaatagcaatctgatttgtgaaagactggaaaaaaagttttgacttctgattcgcaaacacttaatataaaaaacagttactagttatcagaatatttaagaattgagtgaagcatatatgaccttacacaaagaccgccgcatcgggcgattgtccgtccttcttctgcttcatgagactgaagaaaaccagcagatcagccggctggaacgggacggctggaaagtctgtctcggcagggtgggttcaatggatgcgcataaggtggtagctgcaattgaaaccgcttccaaaaagagcggcgtcattcaatctgagggttatcgcgaatcacatgcgctgtatcatgccacaatggaagctttgcacggagtgacgcggggcgaaatgctgcttggctcgctgcttcgtaccgtgggcctgaagtttgccgtcttgcggggaaatccgtatgaaagcgaggcggaaggcgattggatcgccgtttccctttacggcacgatcggagctccgattaaggggcttgagcacgaaacattcggagtcggaattaatcacatatgaatcagcccatagatatcagatgatagggggctatgcgtgaaatatcattttcatggcatagctcctttttgtatgggcgctttaccaaagtaaagaaaaaggggttgaaatgatggtaacgttagacggttcctcactgacaaccgcagatgcccagcgtgtgctgtttgattttgaagaggttcaagcatctgccgaaagcatggaacgtgtgaaaaaaagcagggcggcggttgaacggatcgttcaagaagagaagaccatttacgggattacgacggggttcggcaagttcagcgatgtgctgattcaaaaagaagacgccgcggatctgcagctgaatctgattctttctcacgcgtgcggcgtcggtgatccgtttccggaatctgtatcgcgggccatgctgcttttgcgcgccaatgccctgctgaaaggcttttccggcgtacggactgagctgattgatcaactgctcgcgtttctcaatcatcgcattcacccggtcatcccgcagcaagggtcactgggggcgagcggagatttggcgccgctttctcatctcgcactggcgcttatcgggcaaggcgaagtcttttacgaaggggcccggatgccggcagctcatgctttggaaaagacaaaccttcagccggccgtcctgacctctaaggaagggctcgcgctgatcaacggaacgcaggccatgaccgcgatgggactgatcgcttacctcgaggccgaaaagctggcctatcagtcggaacggatcgcgagcttaacgatcgaaggccttcagggcattatcgatgcgttcgacgaggacattcatgccgcccgcggatatcaggaacagatggatgtcgcagagcgaatccgctattacttgtcagacagcaagctgacgaccgtccaaggggagctgcgtgtccaggacgcctattcgatccgctgtattcctcaagtccacggcgcatcatggcagacattagcgtatgtaaaagaaaaattagaaattgagatgaatgccgcgacagataacccgctcattttcgaagacggcgccaaaatcatctcaggcggaaactttcacggacagccgatcgcctttgccatggattttctcaaagtggcggcggccgagcttgcgaatatttctgaacgccgtatcgaacggcttgtgaatccgcagctgaatgacctgccgccctttctgagccctcagcccggcttacaatccggagcgatgatcatgcaatatgcggcggcctccctcgtgtcagaaaataaaaccctggcccatcccgccagtgtcgattccattccttcatcggcaaaccaggaggatcacgtcagcatgggaaccatcgcctcaaggcacgcctaccagatcatcgcgaatacgagacgggtgcttgccgttgaagccatttgcgcgctgcaggccgtggaataccggggtgcggaacattgcgcctcgtacacaaaacagctctatctcgaaatgagaaacatcgtgccgtccatacaagaagaccgcgtgttttcttatgacatcgaacatctgagtgactggctgaagaaggagtcttttctgccgaatgagcatcaccaaaaactgatgaccaatgaaggaggacttacaagatgactgatgtaaagaaatcaatccgcgccggccgcggcaccgaacttgaatgcttaggatgggagcaggaagccgtgctccgcatgctccgaaacaaccttgacccggaggttgccgaaaagccggaggatctgatcgtatacggcggcataggcaaggccgcgcgaaactgggatgcttttcacgcgattgagcgctccctcaaaacgttaaaagatgatgaaacactgctgatccaatccggaaaaccggtcggactgttccgcacgcacagccgcgcgccccgcgtcctgctggctaattcggtcctcgtgccgaaatgggcggattgggagcatttccatgaccttgagaaaaaaggactgatgatgtacgggcaaatgaccgccggcagctggatttatatcggttcacaaggtattttgcaaggcacctatgaaacctttgcggagcttgcgagacagcatttcggcggcagtctgaaaggaacccttacgctgacggccggacttggcggaatgggaggcgcccagccgctgtccgtcacgatgaatgatggcgtcgtcatcgccgttgaagcggatgaaacacggattgataaacggatagaaacaaactattgcgaccggaaaaccgcatcaattgacgaagcgctgcgctgggccgaaacagccagacaagccggagaacctttatcgatcggccttctcggcaatgcggcagaggtgcatcatgagcttttgaaccgcggcgtccatattgacatcgtgaccgatcagacttccgctcacgacccgctgatcggctatattccggcaggatactcacttgaggaggccgaccgcctgcgccgggatcagcctgatttatacgtaaggctttccaagcagagtatgaaaaagcatgtggaagccatgctcgccttcaagaaaaaaggggctatcgtctttgattacggcaacaacatccgccaggctgccaaagatgagggtctcgccgatgcttttgattttccgggattcgttccggcctacatccggcctttattttgtgaaggaaaagggccgttccgctgggctgcgctgtccggtgaccctgaagatatataccgcacggacgctttattaaaagagctgtttccagaaaatcaagccctccaccgctggattgacatggcgcagaaaaaagtcacgttccaaggcctgccgtcccgtatttgctggctcggctacggtgaacgggaaaagatggggctcgccatcaatgaattggtcagaaacggcgagctgaaagccccgatcgtcatcggaagagaccatttagactgcggatctgtcgcctctccgaatcgggaaacagaagcgatgaaagacggaagcgacgcggtcggcgattgggcggtgctgaacgcgctgatcaacacggcctcaggcgcaagctgggtttcttttcaccacggcgggggcgtcggcatggggtattcccttcacgcgggaatggtcgcggtcgctgacggcagcatccttgcggaacaacggctttcccgcgttctgacaagcgatccgggtatgggcatcatccgccatgcggacgcaggttatgaaaaagcggttcaagtcgccgaggaacaagacattatgataccgatgaaaaaggagcggtaacatgccgaaacaaatagataccatactcaccaacatcggccagctgctgacgatggaatccggcggcccccgatccggcgggagcatgcaggatcttcatgtcacggaaaatgccgtcatcggcgttcacgacgggcgcattgtttttgccggacatcaaggagcggagaaaggatacgaggcaggagacattatcgactgcgggggacggctcgtcacccccggcctcgtcgatccccacacccatcttgtattcggagggtcccgcgaaaaagaactgaatttaaaaattcagggcatgtcttatttggatattctggcgcaaggcggcggtattttgtcaacggtcaaagacacgaaagccgcctccgaagaagaactgattgaaaaagggctttttcacctcggacgcatgctgtcatacggcatcacgaccgcggaagtaaaaagcgggtacggactcgacaaagacacggagctgaaacagctgaccgcggcgaaaaaactgggtgagcgccagccggtcgaccttgtcacgacctttatgggagcacacgccattccgcctgagtaccggaacagccctgacgaatttctgaatcgcatgctgcagcttttgcctgacataaaagaaaaaggccttgcgcaatttgccgatattttcacagaaacaggcgtctttaccgtcagccagtcacgggactacctgaaaaaggcggctgaagctggtttcggcctgaaaatccatgctgatgagattgacccgctcggcggcgcggaattggcggcagagctgcatgctgtttctgccgatcatttggtgggggcatctgacgaaggcatcgaaaagcttgcggagtccggaacgatcgccgtcctgctgccgggcacgactttctatctcggaaaacacacttatgcgagagcccgggagatgattgatgcgggcgtacgggtcagtttggcgactgacttcaacccgggcagctcaccgacggaaaatctccagctcattatgtcaattgccgcgcttcatttaaaaatgaccgcagaagaaatctggcacgctgtcaccgttaacgctgcgtatgcgatcggaaaaggcgaagaggccggacaaatcaaagccggacgggcggctgacattgtcatttgggaagcgccgaattacatgtatatcccgtatcattacggcgtcaatcatgtccgccgtgtcatcaagaacgggaagacggtcgtttcaagggagggagccgctcttggataagtatccgtttctgcaaaaagccggctccctcttcaacgaccgccatgtgacaaggatcggcgatgtgacggaagcgtgggcgggacaaacgatcaaagggccggctttgatcggcgttccgctttctaagtcgtcaatcagccattccggcgcctgctttgcccccggtgcgatccgccgggcgctcggcggcatttccgcatattccgcggagctgcgggagcatgtcattgaccatctgtacgatatcggcgatattcagattcacgtcacggatgtcgtcaaatctcacgaacacatttatcggaccatttatgatattctgacggaccagcctgactgggtgcccgtcattctcggcggcgacaactccatcagttattccaccattaaagccattgcggaaacgaaaggaacaacggccgtctttcaattcgacgcccaccacgacgtccgcaacacagaagacggagggccgacaaacggcacgccattccgccgtctgttagatgaaaatatcataagcggacaaaacctgattcagcttggaatcagggagttcagcaacagcctggcatatgaaaaatatgtaaaagagcgtcaggcagacgtgcatacaatggagatgatccgggagaaagggcttctccgaacgatacaagacactttgccggccgttcaaaaaagagccgacgccatttttatttcggttgatatggatgtgctggatcaagctcatgcgcccggctgtcctgcgatcggccccggaggcctgtataccgaggaactgcttcaggcggtccggtttttagcccaggaggctgacatctcgggtattgagatcgttgaggttgatccgacacttgattttcgcgatatgacaagccgggcagccgcacacgtcattttacatgcattgaagggatttaaattgtcacgttaaagtcaaatccggcacgcgtgatctcggctgccggaagattctcatgccacgcaaaaagggggagatcacgatggatgttgatcaaggcggcaatcaactaaagcgcacgatgaaaagcaggcacttatttatgatttcattgggaggggtcatcggcacggggctgtttttgagcacagggtatacattgagccaggccgggccgggcgggacgatcgccgcttacctgatcggcggcttgatgatgtatcttgtcatgcagtgtctcggagaattgtcagtagccatgcctgtgaccggttcatttcaaacgtatgcgacaacgtttatcgggccgtccacgggttttatggtcggtatcatgtattgggtgaattgggtggtgacggtaggatcggagtttacagcttccggtatcctcatgcagcgctggtttccccacagcagcgtctggatgtggagcgcgattttcgcggctctcctttttgccgccaatgcattctccgttaaattgtttgcagaaacagagttttggttttccagcgtcaaaatcgtcaccatccttttatttatcatcttaggcggcgccgcgatgttcggtttgatttcattgcacggttcgggtgaagctccgatgctgtcgaatttcacctcacacggcggactgtttccgaacggctttcttgcggttttcatcgcaatgatttccgtaagcttcgccttttcagggacggagctgatcggaattacagcgggtgaaaccgccaatccggcaaaagatattccgcgttcgatccgaaatgtcgcctggagaacggtcatcttttttatcggcgccatttttgtgctgtccggactgatctcctggaaggaagccggtgtgattgaaagtccgtttgtcgcggtcttttcccagatcggtatcccatacgccgcagatatcatgaacttcgtgattttaacggctttgctttcggtcgccaactccggactgtatgcttccacccggatgctgtggtctcttgcgaatgaaaacatgatcagcgcccggttcaaaaaagtcacgccgaaaggcattccgctgaatgctctgctcgccagcatggccgtttcctgcatatccttgatctcaagcatcgccgccccgggcacggtctacgtggtgctcgtggcaatagccggatttgccggcgtcgtggtgtggatgagcatcgccctgtctcagctgttatttcgaaaacattatgtgaaaaacggcggacgcgtcgcggatctgaccttccgcacgccgttataccctctcgttccgatcgccgctgtgatcttatgtttcgcttcatgcgtaggccttgcatttgatcccaatcaaagaatcgccctcttctgcggaattccttgtatgatcctgtgctatctcattcgttttttgagaaagaaacagccgaaacaatccgtccgtgacattcatttggataaaaccatgccataaaaaaaaaggcacatactgatgaggtatgtgccttttttgtcttattccgtaatcagcgtatgaatcagtttcggcgcttccgctttttctgagatgcggatgttgtcatagactttggcggtcacgtcgtcaacgttttcgcggttggcgtaaagggtgacgagcggctcacctttttcgacgttgtcaccgacttttttgcggagcataataccgacggcaaggtcgatttcgtcctcttttgtcgcacgtcccgcgcctaacagcatcgctgcgacgccgatttcgtcagcgacgatttctgaaacgacacccgcttcttttgccggaacgtcaattttgtacgccgcctgcggaagtttggacggatcgtcaacgacagaagcgtctcctccctgattgctcaggaactctttgaacttttcaagcgctttgccgtttttcatgacttcctgaagcttcgttctcgcttcttccaatgtctcagcttttttcgccaatacgaccatttggctgccgagcgtgaggacgagttcgtttaagtcttcaggcccttcccctcttaacgtatcaatggcttcttgcacttccagagcattcccgatcgcaaaaccgagcggctgcgacatgtcagaaatcacggccatcgtctggcggccgacgttgtttccgatgcgaaccattgctttggcgaggttcacggcgtcttcatccgttttcataaacgcgccggctcccgttttgacgtcaagcacgatggcatctgctccggcggcgatttttttactcataattgagcttgcgatcagcgggatggaattcaccgtacccgttacatcacgcagcgcatacagctttttatcggcaggggtcaaattgccgctttgtccgatgacggctaccttgtcgcggttcacaagcttgatgaattcatcttttgacaattccacgtggaagccttcgatcgcttccagcttatcaatggttcccccgtatgcccaaggccgcggccggacattttagcgacgggaacgccgagcgccgcgacgagcggagcgagtacgagagttgtcgtgtcgccaaccccgcccgtagagtgcttgtcgaccttaatgccttcaatggcggagaggtcaatcgtttcccctgaattgaccatcgccattgtcagatcggcgcgctcctgatccgtcatatcctgaaagtaaatcgccatagccagcgcgcttgcctggtaatcagggatgcttccgtccgtgtatccttttacgaaaaattgaatttcttctgttgtcagttcttttccattttgtttttttacaataagatctaccattctcatgatctatcacctgtccttcatttatgttcagtgaatcaatccgacgatcgccgctgtcaggaaactgacgagcgttgcgccgtacagcagcttcagcccgaaccgcgcgacgacgtttccttgtttttcatgcagccctttcaccgcaccggtaatgattccgatagaggagaaattcgcgaatgagacaaggaatacagataccactgcctgtgtatgcgcgctgaaatggaaatcgccggatgagagcgtctgcatcgccacaaattcattcgataccattttcgtcgccataatgcttccggcgctcaccgcttcattccacggaataccggttaaaaacgcaaacggcgcgaatacatatccgagcagcgcctggaatgtaatgccgaagaccgcgttaaaaacgccgttgaccagggcaatgagtgcgacaaatccgatcagcattgccgctacgacgacggcgactctgaatccatccattatatactcaccgagcacttcaaaaaaggattgcttttcttcttcaggaacgaagatcaaatcctcttctttgctgacggtgtacgggttgatgatagaagcgatgataaatccgccgaataagttcagcacaagcgccgtcacgacgtattcaggcttcagcatcatcatgtaagaaccgacgatcgacattgagaccgtcgacattgcggacgcgcaaagcgtgtataagcgctgttcagtaagatagccgagctgttttttcaaactgataaagacttctgattgccctaaaatcgcggatgcgacagcgttgtaagattcgattttccccattccgttcaccttgcttaacgcaagaccgatatacttcgtgatgaagggaaggaccttccaatgctgcagaattccgattaaagcggatataaagacgatcggcagaagcacgctcatgaagaacgtcgtctgtttcgcattcacaagcccgccgaatacaaagttaatcccttctgatgcatattccagcaagtagttaaatccttttgcaaaaccgccgacaagaaaattcccgataccggtgttgaggagaatataaccgagaatcagctgcagcacgagcatgacggcgatcggccggattctgattctttttttgccgttgctggcaagccaggcaagacctaaaaacacaatgattccgataattccgatgagatacttcatatgtgttctccttttatttgtattcgcttacaattttttatgcatcaacaaagaaagaggatggcggaagctttcggcttccgcaatgctgattaatagtcgctgctgccgctgtctccgccgctcacgatagagacgcccgcacttgcgccgatccggctcgcgcccgcagcgatcatgctgtcaacatcagcttttgttctgatgccgcctgatgctttgaccccgatgtccggtccgactgtttttctcatgagagcgatatcttcagccgttgccccgcctgtagaaaaaccggtagacgttttgacgaaatcagcgcctgcggataccgccaagcggcacgcacgctctttttcttcatctgtcaaaaggcatgtttcgatgatcactttgacgagcgcttttttatcagctgcttcaactaccgcgcggatatcagcttcaaccgctccatcatcgccgtcttttaatgcgccgatattgatgaccatgtcaacctcagtggctccttttgagatggcatccttcgtttcaaatgcttttgtttccgatgtcgttgcgccgagaggaaatccgataacggtgcaaacgtcaactcccgtgcctttcagttcctccgctgcgagtttgacccaagtcgggttcacacaaacggaagcgaatttatattcttttgcttcttttatcagttgtaaaatatccgctttttgtgtatgcggtttcaaagcagtatggtctatttgacttgcaattgacattgtatgcacttcctttttcctaggatacgtttagaataaccgaattttgaacatatgtaaattggtaattgaaattatgttcatgaattgtcacaattcttgaatgagttttttggccgtatgctgatcagtaatcaaaacgttggcgtactttcctttcagggcaccgtgaatggccttgcattttctgctgccgcccgccaccagaatcgaacgctctttcaatttcaggtcgctgagctcaactccgatcgtcctgccgttaatgctgctgctgcaaatcctgccttcctcgtcaaaaaagcgcgaacaaatatcgccgactccgcgtgctttcagcaattgtttctcttcttcccggaaatagccgagtctgaaaagcagcgcctcatcccggacggttccgaccgtaaacagggcgatattggcttgtctgcccatttcaatgatccgcttaatatgtctgtcccgctcgaccatctgtttcacatcggcgctgtcaaatataaccggcagcggcaaatacctcggcatggtctgaaatgcttcggcgaacagctgaatcgtttctgacgaatacgtattgacattggaatgactgatgccgcctttcagctgcacgacttcaacgctctttacctgcttcggctccatgcggcttgcgatctggtacatcgtcgtcccccagcttacgccgagtatatcgccgtcctttacggttttatgcatatagtctgcgccatagcggcttaagtaatgtgtaatggcctggtaatcgtcgcttggagaaaagacgacgtgcgcctcaagcagcccgtatttttcttccagcttcgcgccgagttcatccagatcctcaaacgggtccatgacgcgaatttgcacataccctttttcctttgcgtactgaagcagccttgaaacggtggggcgtgacagattaagccgttcggcgatctgctgctggctgtaatctgattgataatatagttttgccgcttctatgctgagctgctgtttttcacgatccatgtcgcgcctcccctctccgcttatcatatcaccaaaacacgcggtaaaaaagcaccctctgatggggtgcctattttttcagcacaagctcctgaatcgcgtgcgccacgccgtgttcgttatttgatttcgtttcataatcagcaatctcccttacttccgggatggcattggccattgccacaccgcagccggcccactgaatcatggacatgtcgttgccgttatcgccgattgccatgacgtctttctgttcaatgccgagtttttcggccagcagcttgaccgcgtttcctttactgactttcgggtgaagaatctcatggaagaatggcgcgcttttgaccattgtgtatgtttccctgaatgattccggaatagaagcgatcgctttctccagcttgtccggatcgtcaatgaacatgactttcggaatcagaatatccttcggcacttcatcgatcgtgcggaaatgaagcggcactttcgtaatgtatgattcgtataccgtgtattcactgatatcccggttcggcgtgtacagattggctgtgtcaaagtaatgcatcggagtatccaactgtaagctcagctcgtaaagcgactccaaatcttcaaagcctaatgactgctcggccacgacaccgtttgtatacgtattttggacgagtgcgccgttataggcaatcacaaagtctccttcttcctgtaagttcagctcttccaaataccgacgcacgccgccgatcggccggcccgtgcacaggacgatattgaccccttccgctttggcggcatcaagcgccccgcggacttcagccgtcacttcatgatgatcgtttaatagtgttccgtccatatctattgcgattaacttgtacatcctgcatctcctttgtatccttttctgcttatgctttcatcatatcgttttttcgtttcaatgaaaaatcaaacggacaagtttctccgccttctcttcctataccgggcctgcctccggatgcggggccgtcttttccccttgtcagcttgttcgccgctgtcatctgttttctgcttcaagagcatcagccccgccgcaaagaaagggacggccgctatgtccagaagggcaagctttattcccatcgctgcgggaaagtatgcccataatgaacggctgttccgcctgatcatgatataagaaacgatttccagcaggataaacagagcgttcacccacaagtaaatgagcatcgccgcaaacagaaacagcaggagcgtattccgcagcgtgccggaaaacagaagagcgcgcatcatatcaaagaatgaaaaagactgcatgctgccgttgacgacattgggattataaatggtaaaacgcccgaactgatcaaaaagcataaaaaataaccataacagtgaaaaccattgaatgatatgtacgatgacacccgtcaaaacgagtctgtcggcagccttatttctcatgtgcatcctccccgccggtttttattcttgtcattgtttttgtttctccgtatatcttccaaatgagcgtatcgttttttcctcttttcaacgtgcttttgacggggtgcggatgtccgaggtattcaatctcgatcgtcccgtccgtgttttgtgagaccaccttgtaagcatctgagggcatgggaacctcgccgcggcctttaatgacctgctttgtcagcacgctgtctttcgtaaacgtaacggtttcagatctgaccccgtccatcgggcccggtttcagccccgcatcccatgtcccgtaataaaaagggggttcgtctgctttcttttgcgagcagcctgttatcatgacgcatccgataacaagaaccgtcatgatgaaaatccgtatgttccgcaacatgatcaccttcctttgaagctctttttacgcctgtaagttaggcggatgccgtggcactgtgcaattgactacatagtgtataaagacttcactagataaggagaatgatgaatgaacccatatcagtactacaccccatctgcctatttccctcagcagcaggaatacgaagtgagccccgttgagtatgagccgtatcagcagcaggaaagctattattatgcgccccctcagtctgaagagcggcagccgacggctttagaacggagagtcgcccagcttgaaagacaaaacgcccagcaaacgagagagctcacccgcctctcacaagaagaccagcgccaaaaccgggaaatcacgcgtatgaatgagcagatcagacggctgagccagtccattgaaatccatacccgccgcttaaaccgtttgaatcagcgcctgcgcgcagtcgaaaacagactcaatattccttttcacgctacagaaggcggcttctgagaaaaagggccggaatacaaagctcgacaggccatcccgagccttgtattccgctctgtacataacaggtaaatatttgaatccttttcttgcatgaatgcctctcctattctttcacatgataaatgtgtaaaatcaatcacttcaggaggtcttcatgatgtatcaaaaccaatacagcggaaatcagctgcagcaatgccgtcaaacagcacagcagcttattcagcagacacagcaaagcagtcagcagtacaagcaaatgctccagcaggaacagcaaaacattcaaatgcttcagcagatgcttaaccatgaacagcatgccgttcataccattcagcaagcgctgcaggggcatgaactggccattcagaaatgccagcaaatcgtgaatgtgtgcaatcagcttcagcaggaagtaagcggacacatgcctgcaccgatggcaaacgctaatgtttcttcattcccgcaaacacagcatcacacacaccgtttcagcagcattcataccagcaataggccggtcatgcaaatgacaaagcgcgagataccggctttgtcatttgtttttatctctgttttgtcagatcaatgcgttgagcgggttttccgccgaatttttcctccgcctcatgccttaccgcttcaaacgctcttgcttcgacgttttgtttaaacacatcaagctgtattaaataagccgcccgcactttcagcccgtggatgatggagatgacccataaaggcagcacgatatacacgcccggcgtgctcggcagcacaaaagcaattgctaaaataataaaatagataagtccgtatttcagccattttttgttcttggcccggtagccgatatagaaaaaggccaagaaagcggtcagcccaaacggcgcgaaagtcagcagcagccaccagctgtgcagcacttcccaccaagtccctcttttcgtaatcaacattcattcctcctcctttactactataacatggataatcaaggaaggttttctataaaaaacatagacggaatgacgtcttcctgctatattaataatgataatcattatcaccgaaataggggatcattatgaagaaacaatcatggctgatcggcctggcacttctgcttgttttcgcattaagcgcttgcagcggcgcgaaggaaaacaacggatcggcatcaggcaaaggaaagacagacatgcgtacatatgaatcaacaaaaggaaatattgacatacccgcacatccaaaacggatcgtcactgacttttatgcgggtgagctgctgtccgttgacgcaaatgtcgtcggggcgggctcatgggctttcaaaaatccgtttatcaaaaaacagctgaaaaacaccacggacatcggcaatcccgtcaatgtggagaaagtgatgcagctgaagcctgatttaatcgtgctgatgaaggatgaccaatacgagaaactatcgaaaatcgcaccgacgattgtcattccttttaacaccgcaaagaatacgaaagatacggtcagcctattcggcgacattgccggggcgaaggataaagccaaaagctttatggcagacttcaacaaaaaggctgaagccgatcaaaagcgcctcaaaaacgtgatcggcaaagacgagacagtcggcctttatgaaacgacggataaaggcgaaatctggatttttaatgacaattccggccgcggcggccaagccgtttataacgcactcggattgaaagcgccggccaaaatcgaaaaagacatcatgaaaacgggcgccatgaaacaggtttcccaagaggtcatccctcaatatgcggctgattatatgttcattaccgattacaatccgaatggagaaagcaaaacatttgagcgtctgaaagagtcatccgtttggaaaaatctcgatgccgtaaagaacaaccgtgtctttatcaacgatttcaacaccttctatccgtatgacccgattgccgtcagcaaacagatggatatcatcaccgacatgctgatcaaacgggctgaagaaaataaaaaataaaaaataaaaaaagcggcacagtcatgacactgtgccgtttttcatgttcactttaattttgactgtacggagcccggcatatcttcaaatctgacttcttcccaggtctcgacatactttcctttcgccttcaccttcaaatacgcgttcttccgaaggtctttcccggcgaaaaaggtcacttcttcttttttcccggatgcgttatatccgtctaatgtatactcagtaccgcccgggctaagatgtttgccatctcgatcaatctgtacataaacatcttgctggtgaataaacggattaaatctgtctgtaacatcattatgaaaaaagagaagtccgtatatgacggcagcggctgctaagacggccaggattgccaatgcttttttcatctgtgcactccccttacttgttcatttttttcaaatagcttgtccgcaccgctaggaagaacagaagctgaaagatgaaaaaccctccgatggtcagactgagcggccccgctacatcggaatagccttccaccgctaatgttctcaaagcaaacagcgtatgcatgacggcaatgacgaaaggaaagaaaaagagaatcgccaattgtatcgtcacgctttgtgccatttcacgctcactcagaccgattttggccaatgagcggtagcgctcccggtcctcatctaaatcggtgaacagcctgaaatataagaaactcgctgccgcgacaaagaaaacgatcgcgataaacaggccgatgaataaactcaggctcggcagctgcaccgtatcatagtacgtcccggcttttgccataaaatcagaatgcacgtcgatatagttgccgtaaatctcatttttcaaggattggctgatcccaagactgtctttccaatgatcatagctgtagccgtataatgacgctttctcaccgagtgatttcagctgatcaaaggtttgatcgttcaccgcgatgatggcattcaatgaaatcagcggttttttgacttcttttaccgtcagtttttggtcagacggcttgcctttttggttcagcagcttcagctgatccggcgcgtcgtttttgaaattgcggtcatacgtgcccgggaaatagacagcctcattatgtttcaggccgttcagcttaacatggaagtatgttgatacatccgattcgctgatcatataaacagggggaacagtttctccttcctgatagcgaacataggaaacatctattttgtctttcttatacgtaaagccgtgtgttttcagttcatggtcaatatctttcaaatgagtctgttctttcgggttattgctgaaagataaatactccatctcataggcggactcttccgccccgacggtcgatttgtacatcgcgagcacgcccgtcgccgtaaaggcaaccgcggaaataatactgacgataaagaacaggcgggcgttgtcttttaaacgatagacaaggtcagaaacccaaataacatttttcccgcgcagataaaaggttttccacttcttcagcgcgcgcagaatccagatgctgctttggctgaaaaagaaatacgtgccgatgacggtaagcagtaaaatgatgaacggctcggtcccgtggacattgcctttcagaaccatgccgtacccgccgcacaggcaggcgatgccgaataaggacagaagcacggacggcttcggctccggcttgatcttgtcagtgccctttattaatttgatcaccgtatttgatctgacaaaaaggatcgtgaactgcgataaaaggaaaaataagagcagaaatccgccggccgtaatgccgagcgctttccaaggcatgtacagaggcagcgcgtccatttctaaaatataagcgccgaccgtaaagaacgttttcgaaaaaatgaagcctccgataatccccgctgcgatcgacatgacgccgatgatcatgttttccgccgtaatgagctttctcagctgcaccggcgtaataccctgcatcagcagaataccgaattctttatttctcgatttcaaaaatgcgttaaccgaatacagaacaaataagaaagaaaaaacaaagatcatccattccgcggcggttaagccttttttggcgatgttattcaggtagccttcctttagtgccggatgaaacaggaacatcgcaaaggtaaagaaaatcaaaacggaaaaggcgctgctcaagaagaatgcaagataggcccttttgtttctcgtgacgtttttataagcgaactgaagaaaggtcatttgcgtttccccccagcatagacagcacatcaagaatctgctcataaaagacttggcggttttccccgcggtaaatctcattaaacagttcgccgtcttttataaagatgacgcggcggcagtagcttgccgcaaccggatcgtgggtcaccatcaaagccgtgacatgatcatcctgattcaggctctgcatcgtttccatgacatcttttgacgctttggaatcaaggtttcccgtcggttcatcggccagaataagtgacggcttatgaatgaccgctcttgcgatggcggcccgctggcgctgtccgccggatacttcaaacgtccgtttattgagcaggtcctcgattccgagctttttcgcgatgccgtgcagtttttcttccatgacagacggcgcttctttttcaagcgttaacggcagcatgatattttcaccgattgtcagcgtgtccagaagattgaaatcctgaaacacaaatccgagctgcttgcggcggaaatgagcgagctttgtccgcttcagccggtgcgggttttctccgtgaatcaggatatcgcctgaatccggccggtcgatcgttgaaatgatattcaaaagtgttgtttttccggagccggacggtcccatcaccgccgtgaacccgccttcttctattgaaaatgaaatttgttttaaagcttgataggatacttgtcctttataggttttatttatatgtttgacttcaagcatattcgccatgagaatcctccttatggttttattcttgttgatctgggctgctttcatgtagtgccggggcattcagcataaaaaatccccttgacgtaaatccatgttatcaaggggaaacagaatgagctatgttgttttcttaacgcagtcttacatttttgtaagaaatgaaaatcggaccgatgtcccttcaccggggacgagctgatgtccaccgtatgattgagcttgcccgtaatttctttgacgagatggaggccgattcccgtagattcttggaaacgccgcccgttttcgccggtgtaataagggtcaaacacccgcttgatatcttgcgagggaatgccgacaccgtaatctttgacttcaagcatcgtcctgtcttcatcgcggaagacattcagctccagtctgtcactcttgcctgccgaatatttgaccgcatttgtgacgacttggccgatcgcaaatttgagccatttggcatcggtgtaaatctgatgatcatcgcgaatatccattttcggatagacgcggtattgaataaaaaatcgtttatagctttgaatgaccgattggagaagctctgataaggaaaccgcttcgactttaaaatcccgctcaaacaggtcaagccttgatgaataaaggagcgtctccagcccgaattcaatctgccggacctcttttttgatttgttcaaagacgggctcatcctcttcctgaatgattaaattaatgaccgacagcggcgtttttacttggtgcacccattgattcatatacgtcacccgcgcgtcgagcttggcttcggtctcgtagagcttctggtgctgcagccgggtcagctccatctgcttttcatacagctctgaacagaacactgaagaaccgagatacgggatgtccgtcccttcctgctccgagctgagccaatgatacacaccgcggtctttgtaccagcgataggcaagataccccgccaaaataagaagctgcacgcccaatatgtaaaacaggtgggaaaaagaatgaagacccgcaaaccagtaataaaagaagacaaacagcccttgaaggagaaaaagcagaatcagcacggcatgagaccggagaaacagcttcatgacagcgccctcagctggtagccttcgccccgcaccgattcaatggaaacaggcgcgttcagctcccgcagtttttttctgagccgcgtgatatacacgttaagcgtattatcatcgacgaaaatgtcggtgtcccacgttttttccatgagccggtctcttcccgtcaccttttctccccgctccagcagcacttccaaaagcttgctttcttttttagaaagctcgcttttttcgtcctgaaagcgcagttcaaaccgttccacaaagagctgcacaccggcatattcaaccactttctctccctgcttggcggcgtactctccgtatgccctgcggatctggcttttgattttcgccagcacaatatcataagaaaacggtttttcgatataatcatctccgccgttttcaatcgccatcacctgatccatttccccgcttctggctgagatgaaaatgatcgggcttgtagaatgctggcggatctggcggcaccaataatagccgtcataagacggcaggttgatatcaagcagcaccacatcaggcttttcccgcaaaaagacatcaagaacagccgtgaaatccgcggcggccacggtttgatatccgtatttttcaaggtaattctgcaatagtccgcgaatgtcttcactatcttccacaatcatgattttattcaaactgaaccactcccgtttcttacactgctgccatcatcataatcgtttcgggcgtacggacgcaacaccgcacaaaaaaaccgccatcttggcggtttccgttttcatcagccgatctgctgttttacggctttaccggctgatccgaactctctcattttgcttcgcaccgtctcttccacggcttcaaggccgggtgtcatgtagccgcgcggttcgtacagatcgccgttttcctgaaacatgcggcgtgtttcgtctgtccaggctaccatacattccgtgttgatattgattttcgcgtggccgagcgtgatggcttttttgatctgatcctgaggaatcccggatgctccgtggagaacgaggggaatatcagtcatgcgggagatagccgccatttctttaaatccgagattcggctcgccctgatatttgccgtggacggagccgagggcggccgccagcgcgtcgatattggtttctttcacgatccgttcacattccatgatatcggcataacagaccccgccgacaagtccgtcttccatgccgccgaccgtgccgacttcggcttctactgagacgccgtgctttgcggcataatcggtgacttcttttgtcatcgcgatattctcgtcaatcggctgatgggagccgtcaatcatcactgagctgaatccggcgtcaatggcctgtctgcagcgttccgcactgcttccgtgatcaagatggagcacgacgggaacggtaatcgccatttcttccattaacgcgccgaccatggcggaaatcgttttaaatccgcctaaatagccgaccagacgatcggaagccgcggcgatgaccggcgattgctccttttgcgccgcttgcagaatcgccttcgtccattggaggccgttgatattaaattggccgactgcataatgctcccgtttcgcttctgcaagaagatgtttcatggtgacaaaagccatgttcacgcctccttcatgaagtattttgatacgacggcttccgttgtttcctttgccgttttgatcgtttcctccgcagtcagcttataatattcaggtctgaacagctctacggagacaacatcattgaatccgatttcttttaacgctgacagatgggcgtctaagtcaatcgcaccctgcccaggccagacgcggtcttcatccgttaaaaagccgatcggaaagtcttctgtatcgtcgatatgatagatgaaaattttctttccgtccgcctgcttcaagctctcaatattggagcccatcgcgtggaaatggaagctgtcaaacaccagtccgacattatcgcggccgacagcgttcacgatgtcatacgcctgttcaaatgtattgaccgtgcattgcgggtggccgacaaattcaagggcaatgtttacgccgtacggctccgcgatgtccgaaagctcagtcagcacctctatgctgctctttttgatttcttctttcaagattttccgctctgtcacaagcggcacggccaccacatatttcacgccgagcgtcctgcaggtttccatcatttttttgaattccgaaatgatctccctataacccttctcatcacgattgttgaagaaaaccagggcgttcagggcaagcggtttaatatgatgggtatgaaaatattccgccagatcggccagtgaatggtcttttaagtattccggcagcttatccattgtgcggatttcaatataatcatagccgtgcttttcgcacagttctaaatcctgtttcaggtttgaattctccagcgtagtcgcttcattaaagcaaagtttcatgtcagcctctcccatccgcgttttcgatatgaagggagtccggctgaagggcttttttgccccgctccgccgaactccatactcagcttatgccatacccagttcttcctttaatttcttaagcgtggtccggcttgattcatccgctctttcgccgacccaagcaaacacggcgttcgtcgcaattccgtcgaatttcatctctctcatctttctgaaaatcgtctcaaaatcgacctcgccttgcccgatgtccagatgctggtgaaccgttactttcgcatcaggcggattgacgatgtaacgcaggccgtgcgccgctttatgattaaaagtatctgcaaataaaacatgtgtgaggcggtcgccggcttcatcaaacatggtttcgatatcgcctttgccgtcatcatagaagaacgtatgcgcagtcgagtagacaagattgatccaatccttatcgagcgcgcggatcatatccatcgcacctttgtgcgtttcgataaaatcgtatggatgggcttgaagattgagtttaacgccttctttttcaaagacgggcagcagctcatccatggatttgatgaatttttcttcacttgtcaacggatcatactttgaaccgctgaattcactgttcatcaaatccacttcaagttcaaccgcaatttcgatcgcccgtttccagttgcgcacggcggcctggcggcggtcttcatcaggacccgcccagtggtaaagcggaagaagggaggacagcttcacacctgtatcctttaaaaggcgcttcaattgtttgatttttgctgaatcgactttcggatatttatagaaaggacaaaaatcctcgcgcggggacagttcgatatattcgtatccgagttccgccgttttatagaccatttcctctaatgttaaatcatcgcggtacatggatggatctaaggccagtttcattttttcactcccgatctattatttgttcacagtcgtaaatgattgatagaatgccggtttctcttgaagcgccactggctctttctgtccggattcctgagcttttacgcacgcgtctgttgtcaccgcggcaatataaccgtcccatgccgtcggaccgctgacttcgcctttcttccggatcgaatcaatgaagtcctgaatttccacatcatacgcagccgcaaatcggcgctgccagtccatcagaatatcggtgctgaattttccttcttttctcaagctgatgcttgacggttccggaagcttaatgacgccgtcttccccgacgatttcacattgaatgtcatagccgtatttacagttcacatagatttctgcattgatgacgatgccgccttttgtttcgatgatgaccatctgcggatctttcagatgcggcagcgcattttttgatttcttcggatagatgacttgtacggattcatagtcgtcattgacaagccagtggaggacatcaatttcatgaacgagcgtatcgacgacggccatgtccgttgaataattcgatgcgactgtcgggttgcggtgcgcacagtgaatcatcagcggctcgccgaccgcacggttgtcgatcgcttctttcagctgaacgtaaccgctgtcatatctgcgcatgaaacctacctgcaccaatcgttttcccgtcttcatttcttcctcgacaatgcgcatacagccttctgccgttgtcgcaagcggcttttcacaaaacacgtgcttgccgtgctgaatcgctttcaacacgctggattcgtgagccgggccccagcttgtcactaagacggcatccacattttcagcagcgagaaggctgtcgtcatcaggataaaccgaggcgttcaaattgaaatgctgaacggtctgctgcgcggcctcctgattcacatctgtgacagcggtaatttccgcgcccgacagcttatttgtgatgcggttgatgtgctcttttccgatagcaccggttccgataacacctatacgtaaattcattgatcgccactccttctgataatcaaataatggttctcgtctttcttttctctctgccgtcctgaggagcaccgtacagttcctcctgtatctgttcaagcgacttgccggacgtattcggtgcgaagacaagcccgatgatcatactggccgtcacacatatgagcagaataccggccataaaaccgatgccgaattgtgacatgatgaccggcacaaataaactccaaatgccgattgaaatacggacgagaaagaacatgagcccttgtgctgacgctctgtgttctgtcgggaacagctcgcttgcccacagctggtagttcgcctgctggccggctccgttattgatgccgatcgctaaaacaaacaaaagcagcatcgggagtccctgaaacggcagcaaaaacagcgaccagccgacaacagccataaaggcgcagattccgaacaccgttttccgatattgatctgcaaaaggcatgaagatacaggcgacgccgagcccggtgaagataaacagggccatctgcagaatgttggccgtatttgcggatacgccgccgacctgctggtagatgtacggcatgaagaatcccatgacgcccgcggcgagattccatacgagaaacacacccattaaaaacaaaatgttcttgaaaaatttcggctgaagcaagtcaaaataagatgtttttttcacggcggcaggccgctcttcactgtttttccaggcatccgactcaggtaaacgctttcttatcacatatgtgatcagggcgatcaccaatagatgcgcaaagacaattttatttcctaaaagcccgaggtcaccgaccaaaacggataacagcagaaccacaacggctccggcggcccacgccacctgcgccactccgcaatgcctcgcccggtttttctcgggggcgttttccgcgataatggtccatgaagccgtaatatccgcgcctacagaaatcccgataatcatgtatccgcataacagcatgggaaagttgaatccaaacaaaaccaaacaaattcctaaagcgtagacgagcatactgtttgtgtatacagcttttcggccgaccttatcagccaaatacccgccgagcagcgctccgatggccgctgatatcgcgtttgcgctgaaggcgccgagcaatccgatctgactgtcggacagcttcaagtagctgacccacatagataaacccgctgatcctgccacgatggaacctgcatcaatgtaatttgctaatgctgcggcgatggtccgtttgctgaaagctgattccgccttggcactattcatataagtcccctctaatttgcaggatcaagcagttcactgtcgatgtactttctcgcaatcagcgcgtactcaagcggattggcgactgccgggtcttgttcggcttcaatgacgatccagcctgaataatcatgacggacgagcgtttggtacacttcggtaaaatcgatgcatccgtctccgggcaccgtaaaaatgccctgtaaaaacgactgcctgaatgacttgccttcctgtctgcaccgctccataatgtcaaaccgcgcgtccttgaaatgaacgtgtctgatccgatccatatgcttgttgagaatcgtcatatagtctccgtctgagatataggcatggccggtatcataaagtaaatggacataccgcgggtccgttccatccatcagccggtcaacttcttccgccgtctggacgcctgtgccgagatgatgatgaaacgtgagctccagcccgtattcgtcagcgattttcccgagacggttcaagccttggcacagtgtatcccattcttcatttgagaagtgcggttttttcttaaatacatcaatatccaagccctggacactgtacgtctgttcagaaacgatggcggcatccgctccgactttctgcaaataatcacagtgttctgtaaattgttcagccgttttttcaataccgtcttgaatgataaagctgctgaaccatttccccgcaatccgcaagttccggagagccagctccttattgaggacggagggttcagggaaaaaccctcccacttccgtaccttgaaaaccggcgacaacaatatcgcttaacaaatgctgcagcgtattcccggctccgatctccggcatatcgtcattgcgccacccaatgggagcgatgccccacaaaatattttgtttgcccatcgtgatgcctcccctctagtactgcttcgcagacttcagcttcatctctttcgcttcgtatgcccgctgaacgctttcctgctcagacacttccgccacgccgacatgccaccagctgtcatagccgtccgtcatcgttttcggcagaaccttcatttcaattaaagtggatacctcttgcgttttcgcatcttcaagcgccgctttcagttcttcaaccgtattggctctgtatgttttagcgccgtagccctctgccaccttcgcgtaatcaacgtttaaaatctgattgtcctctgtgcggaactcgcagaaataactgccgctcccgtgatccatctgcaggttgttgatacagccgaacccggagttgtcaaagagcaggacattgatttttttgttatattgaagcgcggtaatcagctctgagtgcagcatcagaaagcttccgtcgccgacgagtgaatagacttctttgtcgggatgagccagcttgaggccgagcgtgcccgatacttcatatcccatgcaggaatagccgtactccagatggtacgtattcgggacgttggaatgccacagccgctgcagatcgcccggaagagatcccgccgaactgatgacgacgctgtcttcaggaatcgtgtcgttgatggtcaacagcgccgttgtttgcggcagctcagtctcgagcgcgtcggcatactcgtttaacacgtcctgtgagaaatggtttttaatttccggcttgaacgcgtcacgtgtaaaagtgaccttgccgagccggtcccgttcagccagccattcatctttccagcctttaatcgccgtgccgaatgcacttttatatccgtctaataagccgtgcagcctgccgagcgtcactttcgcatcggctacgacctgaaacgcgtcaagtttgtatgcctgcatgcggctgacattgatattcaaaaattttgctttgtcaaaatcaaacgccgttttcgaggatgtcgcaaagtccgtgtaccgtgtgccgacaccgatgatcagatcagcctggcgggcggctttgtttgcggcaagtgtgcccgtgatgcccatgccgcccagattgttggcaaaatcggcttcaaccgttgacttgccggcctgcgtttcgacaagcggaatgccgtatgtttcagaaagcgcgattaattcctcacgcgcgccggagtacttcgcgccgccgcccactaaaatgacgggacggctgctctccttaattctctccgcggcgcctttcagctcacgctcgctcggctgcatccgatcaatgtaatgaacacgtttttcaaagaagctttcatcaaaatcaaatgcttctccctctacatcctgagaaatgcagatggtcgccgggcccgcttttgccggatctgtcatcacttcaaatgcccggattaagctgctcatcagctgctcggggcgggtgatgcggtcccaatagcgggacacgggctttaacgcatcgtttgtcgtgacggcggcgctgtattcctgctccacctgctgaagcaccgggtcaggctgcctcgtcgcaaaggtatcggccggaagcagcagcaccgggatatgattggccagcgccgtacccgcggcagccgtcaagttagcggcacccggaccgaccgatgtcgataccgcgtaaatttttcttctcagcatctgcttgctgtatgccatcgcggcatgcgccatgccttgttcgtttttgccttgatagactttcaggtgcccggcgtcctgctcgagcgcctgcccgatccccaacacatttccatggccgaaaatcgtgaagatgccctcaacgaacggctcttcttttccgtcaacatgaatgtactgccggttcaagaattgaatcagcgcttgtgctgtcgttaagcgaattgtcttacccacaaacgatcccaccttttatacgttctatttaccgttaagactgtgctgcgcttcaatcagttcgatgatttcaccggcagccggcattgcttctgaggagctgtgtttgctgacgacgatggaagcggaagcgctcccgtattttaacgacgtttcaatatcccggccgctgaccagtccgtagatgaaagctgacgcataggaatcacccgctccgaaggtcttcagcacctttgttttataggcgtgcgcccggaaaacttctcccgatctgctgtatgcgtatgatccgtcaacgccgtgcttaatgacgacaaggtcggcggagtgcgcaaacaaatggcggacggtttcatcgttatttccgccgctgcggttttccattacgtcaaattcgtcacgcgtaccgatgacgatatcggattgttccgccgccagcgtgtagtacacggctgtttcttctgccgattgccatgtatacggacggtagtcgagctcaaacacgacttttacgtcatgtttttttgcgatttgcaccgcttttaagacggcttcgcgcgacgggcttttcgcaagcgccgtacctgatacgagcagcattttcgcgtttgcgatgtagccttcattgacttcggacggctctagatacaaatccgccacgtcatcccggtacatcagaatgctgcactcttcaggactgagaatttccgtaaaagcgagcccggctttgcgtccttctctgtcaacggtcatttgtgacgtatcgacgcccttttcctgcatataagaaacgataaatctgccgtgctggtcatccgggattttgccgataaaaccggcttttaatccgagcttagcgctgccgatcgcaatatttgccggggagccgccgacatatttagaaaacgtcatcgtttcttccatcggccggttgtattccgccgcgttcaaatcaatacacgcgcgtccgatcgcgacaatatcaaactctttttcttcattaaacgtatatttcatcgttatctgccactcctcacttgtcagcgttccagaatccattcatgggccggatcattatgaaacttccattttcgtgtcggtcccgccattacattcatgtagtaagaggtatacccgtccggaacaccaaccgggtgatagcccgccggcacgatgacaacgttttcattttctgcggtcatcgtctcgtcaatcgagcggtcgtccgtgtacacacgctggaagacaaatccctgcggcgggtccgtttcatggtaataggtttcttctaaaaatgattcagccggcagattgtcttggtcatgtttatgaggcgggtagctcgaccagttgccgctgtccgtgtaaacttcaacaacgagaaggctgtttgccgatggatctgaatcggggagaatgttatgaacggttcgtttgtttgccagcttgccgcgatgttccacaccgttgtcttccgctttaatcagctttgtcggaagctggtgttcggacggagagtagcacagcgcgaccctcgccccgctgacggctgtgattccaaaagagcggtcattggacacataaacgctgtccgtcggttttctatcaaatacgctttcacgggtgccgatgctttcaaatgtctgatcataatcagtgacggtaacttttccagttaccgcaacgatgcagcactccgtctttttcaaatcttctgtataggttgagccgggagcgagatcaacgactttaaatccgacgtatttgaggtctgaattggctgaagtgacgtcatgtatgatggtcacgccttgagaaatttcatcggcctgcggtttgcgcagcaaatgactcatgtttattcctccttaatggatggtaaaagaaaacccggacggaatcacaaagccgtccgggccggctgtctgatcaattgaagtcaggagacgggtatcgtgccgtcacgacttttttacgtgtatagaagtcgacgctgtcttttccgtttgcgtgcaatgtgccgaagaaagaagacttccagcccgagaacgggaagaatgccatcggcgccgggacgccaaggttgatcccgagcattcccgcgtcaatattctcacggaagtagcggatcgcgttcgcatttgacgtgaacaggcaggcgccgttcgcaaattcagactggttggcgatgtcaaccgcttcttttaaatttttcacacgcatgaccgacagaacaggcgcaaagatctcatctttccagatcgtcatatccgtcgtcacgttgtcaaaaatcgtcggtccgacgaaatagccgtcttccgttacatgttcacggccgtcacaaagcagtttcgctccttcttcgatgcctttttcaatatagctgtgcgtgcggtttttgttgtcctcgcggatgaccgggcccaagaacacgccgtcatccagtccgtttccgatcttgatgtctgcggccttttcctgtaatttcgccataaactcatcggcgattccctcttcaaccgtcacaaccgcgcatgccatgcagcgctctcctgccgaaccgaatgccgcgccgataatgtttgtgaccgtatcttcaaggtgggcgtcatttaacacgatcgtatggtttttcgcgcccgttaacgcctgcacgcgtttcaaatgttcgctgccttttttgaaaacatactcgccgacaggttttgaaccgacgaatgagatggctttaatctccggatgctcaagaatgccgtttacgacgtcatgcgcgccgtgcacgacattgaagacgcccttcggcagaccggcctgttcaaacagctctgccagtttttccgttaacagcggcgtgcgctcagaaggcttcagaatgaaagtgtttcctaacgaaatcgccatcggaaacatccagcacgggaccatcatcgggaagttgaacggtgcgatgccgccgaccaccccgatcggatagcggtaattcgccgcctctacatctgtggcgatagaggcaagtgaatcgcccatcatgagtgacggcgcgcctgctgcgaattcgacgttttcaattccgcgtcccacttcaccgagtgcttctgtcgtgtttttaccgttttccaaagtgatcagacgggcaagctcttctttgttctgctggagaagctgctgatagttaaatagaattctcgcacggcgcggcactgccgtcttcgaccatgttttaaacgcttctgacgctgagcggacggcgtattccacatcctcccgcgtagaaatcggaacctggcacatcacttcttttgtagccggattgacaacgtcttcatattgatctgtcttactttcaacccattcaccattgatgtagtttttcagttttctgatctctgccattctcattgcctccttaaatagtaaacatcctgttcagctggataataacggatgaatatattcatcttttacatataaaagacatgaattaaacgcttacaaatgctaaaatgatggtgactcccaatcttttcatgtaaaagttggtcatgtgccggataaagcaaacggttacatctttcacttttgattttacaggttatattttggtcatttcttggttacattgtaagcccaacacaccttcaagtcaatctaaaaaatcaaaattttttcattatttttatcatactttttttaagcgggaaaacaggaacttggagaaccgtgtcgaatcgtacggtgggaaccctcttttttatcatttgttaagtaactattgattaactcttggtgtttattatatattttaattactttaagaattctagaaggagtttttttatgaaactgatgcggattcaggagatggaagaatacattctcaaacacggagccacttcgctggatgagctgtgcgaggtattcaacgtctctaaaaacacggtcagacgcgatattaataagcttgcggaaaaaggggtgatcaaaaaggtgtacggcggcgtgacgtcagcagaaaaatctgtgctcgtcccttttgagaaccgcaccattcaacatcaggatgaaaaaatcaaaatcgcccgctatgcgtcgcggtttatcgaggatcacgatcttgtatttattgattccggcacgacgaccaaatcgatgctggagacgcttgacccggataagaatgtaacggtgttgacgaacagccttgatattattaacgccgcttcatccatgaaaaatatcgacctgatcatcatcggcaataactacaaacggaagacaaggtcgtttgtcggcattgatgatccgggcacactcaataaatacaacattaacaaggcgttcatgtccgctaccgggacaacgatcacccacggcctgacgaattccgacttactggaatacgaggtgaaaaagaaaatttccgaaaaggcgaacgaagtgtatctgctcgcggatcattccaaattcggcaaatccacgcttttgacatacgcgccttttgaccggcttcacagcatcgtcacttctcagcagctcgatgaggaatatacgaagtattgccaagagcaccaaatcgacattcacttggcatagcgttatagttaatagagaacgctgccgtattttcccggcaggcgctatgatatccaattttttcagggggcgaaaacatgagcaaagtaacaatcggcaaaactgacctaaaggtatttccgatcggtttgggaacaaatgcggtcggcggacacaatctctatccgaatctgaatgaagaaacgggaaaagaattggtccgggaagcgattaaaagcggcgttaccatgttagataccgcctatatttacggtgtgggccgttctgaagaattgatcggcgaggtgctgaaagaatataaccgcgaggatgtcttcatcgccacaaaagccgctcatagaaaagaaggcaatgactttgttttcgacaactcaccggcctttttgaaacaatcggttgaagacagcctgaaacggctgcagacggattacatcgatttattctacatccatttcccggatgagcatacaccgaaggacgaagccgttcaagcattgaatgagctgaaaaaagaaggaaaaatccgttccatcggcgtatccaatttctctttggagcagctgaaagaagctaataaagacggcttagtcgacgtgattcaaggagaatacaacctgctgaaccgtgaggcggaaaagactttcttcccttatacgacagaacacggcatctcattcattccgtacttcccgctcgtatccggactgctggccggcaaatacgacgagaacacaaccttcccggaaggcgacctgcgcaatgatcaggcgcatttccaaggggagcagtttaaagaaaacatcaaaaaagtcaaccagctcaaaccgattgctgaaaagcacaatgccgatacggcgcatatcgtgcttgcctggtacttggcgagacctgaaatcgatatcctgattccgggcgccaaacgcgcggatcaattaaaagacaacatgaaagcagcctccattacgctatctgctgaagaaatcgcgtttattgacaagctgttttcctaagaaaaataacacgcctttttgaaagggcgtgtttttttatgtttatatttttctcttcggggaatgaaatagttatctaaataaactattatgcgttccaaaagatgaggaggatcatctgtgaagaaaaacaccaaaaaatacctgatttactttttcggagcattgggcgggctgctttacggctatgacaccggtgtgatttcaggggctttgttatttattaacaatgatattcctttaaacacgctgaccgagggattggtcgtcagcatgctgctgctcggtgcgattttcgggtccgccttaagcgggacatgctctgaccgatggggccggagaaaagtggttttcgtcctttcactcatttttattatcggcgcgcttgcctgtgcggcttcgcaaaccgtcaccatgctgattatctcccgtgtcatactcgggttagccgtcggaggctcaacggcgctggttcccgtttatctatctgagatggcgccgacaaaaatacgcggaacgctcggcacattgaataacttaatgattgtaaccggaattttactcgcatatattgtgaattacatattcaccccgtttgaagcttggcgctggatggtcggtctcgcggcagtaccggcggcgcttttattaatcggaatcgcgtttatgccggaatctccgagatggctcgtcaaacgcggccgtgagcaggaagccagacaagtcatggaaatgactcacgacaaagaggatatcgccgttgaattggcggaaatgaaacaaggagaagccgagaaaaaagaatctacgctcggcttgctgaaagcaaaatggatccgtcctatgctgctgatcgggatcggcctcgccatcttccagcaggcggtcggtatcaacacggtgatttactatgcgccgaccatctttacaaaggccggactcggcacttcggcgtccgttctcggcacgatgggcatcggtgtcttaaacgtcatcatgtgtatcaccgccatgatcttaattgaccggatcggccggaaaaaactgctgatgtggggaagtgtcggcattaccttgagcctggcgtcactatcagccattctccttctggccggcctgtcagcttcaacagcttggctgaccgtgctgtttctcggaatctatatcgtcttttatcaggcgacatggggtcccgtcgtatgggttctgatgccggagctgttcccgtcaaacgcacgcggagccgcaaccggatttacgacattgattctgtcggcaaccaacctgatcgtttcgctggtatttccgcttatgctgagcgcaatgggcatcggctgggtgttcggaatattctcagtcatctgccttacatccttcttctttgccgcttacatcgttcctgaaacgaagggcaaaagtttagaagaaatcgaaacgcacttgaaaaaacggttctccttaaagaagcgcagcaaacaaaatcaaattcttaaacagcgcacactgtaatcaaaaaaggaatcgccccgctgggcgattcctttttggcgtcataccatgactttgcagatatcattcgtaaactcgaccggatcatggatcggcagcccttcaatcagaagcgcctgattgtacagcaggtttgtgtataaagcaagcttttcccgatcttgtccgtgcgcgttctttaacgtctcaaacacttcgtgattcgggttgatttccagcactttttccgctttgacctgctggctgtcaggcatggcgtttaacactttctccatttcgatcgtcacttcgccgtctgtcgcaaagcagaccggatgagattttaagcgttttgaggctctgacattcttgactttatccgcaagaatctctttcatgctttcgaacaggtctttatattcgttttcttcggcttcagtctgcttatcatcttcgtcactgtcgatgcctaagtcggcgcttgagacggatttgaactctttttcctcgtagcttgtcagcattttgatcgcgaattcatcaatatcttccgtgaaatataaaatttcgtagcctttgtccgccaccatttcagtttgcggcagcttttcaatccgctcatatgaatcgccggacgcgtaatagatatatttttgatcctcaggcattctggacacatattcgtccagagtgacgagctttttctccttagatgaatagaagagaagcagatcttttaagacgtctttattcgcgccgaaatcattatagacgccgaatttcagctgtctgccgaaagattcatagaaagattcgtatttttcccttttgttcttcagcaagctcttcagctcggctttgatttttttattgatgtttttcgcaatcagcttcagctggcggtcgtgctgcagcatctctctggaaatgttcagcgacagatcctcagaatccaccatgccttttacaaagctgaaatgatccggaagcaggtcggcgcatttgttcatgatcagcacgccgttggaatacagctccaatcctttttcgaattccttcgtataatagtcaaacggcatgttttccggaataaacaaaatcgaattgtagcgcaccgctccatcgacgctgatatgcacgtgggtcagcggtttatcaaaaccgtaatgcttctcggcgtaaaaagcctcgtaatcctcatccgtcagctcgcttttgttttttctccagatcggaaccatgctgttgaccgtctgttcttcctgaacttcttcaaattcgttctcgctgccctctttcggcttgttgaccgtctcttccattttgatcgggtagcggataaaatcagagtactttttcacgatcgctttgatgcggtagttttctaaaaactcatcatagctttcatcttctgtgttttcttttattttcagggtgatttccgtaccgacggtttccttgtcacacggcgcgatcgtgtagccggcggccccttccgactcccatacatacgcctcgtcactgccgagcgccttacttttcaccgtgactttatcagccaccataaacgccgcataaaacccgacgccgaactggccgataatgtcatggccgtctttcgagtcattttcttgcttgaaagcgagtgaaccgcttttcgcaatcgtgccgagattctgttcaagctcgtcttttgtcatcccgataccggtatctgtgacggtaagcgttctcgcttctttgtccgccgtcacttttatatagtaattgtcttgatcaaacgttaatgaatcatcggttaacgccttgtaatagattttgtcaatcgcatcgctcgcgttggaaattaactcgcggagaaaaatttccttctgcgtgtaaatggagttaatcatcatgtccagcaatcgcttggattctgctttaaacttttttttccgcacttcagatctctcctttaattatgctttgatgttatgtaaaatcttttcagcatctatttatcatatacagtgacaattgtcaactaggattagcagatgcatatattgtaaatttaacatgttaatggattcatttcacccattttatcaataaaaaagagagaatgttgatcatcctctcctctctgcttctttccggcggccgaattccttcttcatccatatgtatgacgggtagaaaaacaaactaaataagataagagatcccaagtttcgcaaagactcatgcagaacatttcttacagtgagaggaaacgtgatgtcctgaaacagaatagagataacggtgtagatcacaaatcccataggaacaatggcataacaataaaacgctatctccttcttatgctgtatcttcaaaatatgtaaacctcccaatgatgtatatacataatattaacatatttaataggtaattagaaacaaacctccgtatgtttatccccctattcagcgggaacaggtatagaaaaaggaggaatcgcaatatgggaagattaacagacaaaaccgcaatcatcacaggggccgcgacaggcatcggacaagcgacggcacgggttttcgccgatgaaggcgcccgcgtgatctgcggtgacatcaatgaaagcgaactgaatgaaaccgtcagcgccatcagaaaaaacggcggagaagcagaagcctttcaccttgatgtatcagatgaagaaaacgtaaagtcttttgcagacggcattcagcaaaagtacggaacaattgatattctgtttaacaatgccggtgttgaccaagagggcggcaatgtccatgaatacccggtcgacctgtttgaccggatcatcgccgtcgatctgcgcggcacatttctgtgcagcaaatacctgattccgctcatgctcgaaaaaggaggctccatcatcaacacctcctccatgtccggccgggccgcagaccttgaccgttccggctataacgccgcaaaaggcggaatcacgaacctgacgagagcgatggccattgattacgccagaagcggaatccgcgtcaattccttatcgccgggtacaattgaaacgccgctcattgataaattggcaggcacgaaagaagacgaaatgggcgaggcgttccgtgaagccaacaaatggatcacgccgctcggccggctcggaaaaccggaagaaatggcggctgtcgcgctcttcctcgcttcagacgacagctcttacgtcacgggagaagacatcaccgcagacggcggcatcatggcatacacttggccggggaaaatgctgattgataagaagtggaaggaagagacggagtgacgatagataataaaaaaagccagtgtaaaaaaaacactggctgaacaagctgagggcgggttacttaaaccagcccttttcctttgatcgggtaatggcttcaattcgatttttcacttctagtttatccagaatcatcgaaacgtaattgcggactgtgccgcttttgatgctgagggcgtttgcgatttctttcgtgttttttccgtctgcgacaagctcgagcacctctttttcccgttcggtcagcgggttttcttcactataaatgtcctccattaattcaggtgcatagacgcgtctccctttcatgacgctgcggatggcgctgacgagctcatcgctcgggctgtccttgagcatgtacccgctgacgcctgcttttagcgcccgctgaaaatagccggagcgggcaaaggtcgtcaaaatgatgattttcacaccgctgtccttgagttcttctgccgcttcaagacctgatttcccgggcatttcgatatccatcagacagatgtcgggcgcatgtttttccacgaaatcgatggcatcctggccgcttgtgcctttgccgacaaccgtcatatcctcttctaaattcaacagcgaaccgagtgcgccgagcagcatttgctgatcctcggcaatgaagatgttgatcatctgctaccatccttttcttttgattttgaatcattcgggattctcatggtcagctttgttccggcggctgtatcgatggctaaactgccgtttgcgaattcaagacgttccctcattccaagcaggccgtgcccctttgaaaaaaagcggtcttctctgcattgaaagcttccgtcatcttctaccgtaatgacaacctctttccaaagctgctgaatggtgatgcggcatactttggcgccgctgtgtttcacgacattggtgacggcttctttaatgcacatgctgacgatgttttcgttcagcaaagagatatgtttgggcgcttctttttcttcatacacaaattcaattcctgccgcttcaagaatttgccgaacattgccgagctcatccttcaatcggatgcctttcatcgatgagacgatttgtctgacctcatttaaggaagtgcgggccgtctgctgcacgcttttcagctcagcgcgggcctgttcagggtccttatatatcagctttcgggcaaggtcgcttttcagtccgattaaggagagcttttgtccaagtgtatcgtgaaggtcccgggcgatgcgctgcctttcttccagcttcacaagatcggcaattcgctcatttgcatattctaatttctcctcaaggcgctcccgtgcctttctgcttcgaatgctgagcggaagcaggatggcactgatcagtgtaatgacgataaacggaatttgtgtcaaaaaccattcttttttcagaacaaggctgaagttgacggcaaccgccgcactgatgatatgaatgtaatataagatgtaaaatggaactttgtctcggatatggccgatgaagtaggcaataaagaaggcgaaataaatataactgaacagcatggctgagccggtcgaaatgccgatcagaagaagcgcccataagtaaagcggccagccttttgcaacaaatgcaaagcggtatgcgccaaagaaaacgagcgtgaaaatgatgccggccacgatgacgaaggtagaagagcttttaaaaataaaataaaaaggcaggatgaaaaaaatcgtccatatataaggagaaatcccgttcagtttttgaaatttaaaatacttcttcatctttgttccaccttctgctgcttgtgtctaccatcactttatcaaaacaccgccttcattgcaccctcacgcatgaagagaaggctctttctgataagagaaagagccgtgcgccgtatcaggcatttttctttaaaggttctttcggcaccggatggggcgccgatgttttccgcgcctcccggaaggtgacaaactgcttttcgtcctcatcccacagacggaatttcatggattcaagacttgttttaagcgtaatggtcggtacgttttttaaaggctcgtgtccctcatgagcggcttccagcttgtagttcggcaccttcggacttaagtggtggacatgatgatagccgatattgcccgtcagccattgcaaaagcttcggcagcttgtaaaaggagcttccttctaccgcggcctgcacataatcccaatgctcatcggcttcaaaataagaatcctcaaacgtgtgctgaacataaaagagccagacgccgattgaccccgaaataaggaaaatcggaccctgaacaagcaaaaagttttcccagccgagaagcaagcacgtcgcagcagccaataagacaatcgccgcgttcgtgaaataggtgttccagcgctccttgcggcgggcgccttttacattgaaacggtttttaatcagaaatacgtaaatcgggccgagaataaacataataaacggattgcgataaagtctgtagcgtatttttgtccaggctgacgcttcgttatattccttgacggtcatcatccaaatatcgccggtgccccgtttatctaagttgctgcttgtcgcatgatgaatggagtggcttcgctgccattgaaggaacggaaacagtgtcagcacacctgaaataaacccgaacagccggttcagcttcttttgtttgaaaaaggattggtggcagcagtcgtggaaaataataaagattcttgtcaaaaatcccgctgctataacagtacaggcgagggtcagaagataggagacattgaggctgaagtaagcaagaaaccaaagggcaaaaaacggcacaaacgtgttgaaaagctgaatgatactatgctttgtatcggcgccggaaaatgcggcaacctgcttttttaaagacgcttgtttttgagttgcggcgtgattgatcatgaatgtcatgtcccttctttttcattatgacctcaagtataacggggcgcccgacgcggttgtagtagcagccatcatgccccgaatatgacatttgtcatgtttggcggcagaatgctaatcaggcgtcatatggaaggtttctttcatatctgcacttctcaaagaaaacagcaaaaaagaacccggcctgttttcggccgagttctttttcatcatcctcacagcaaaatcacccgatacttcttcacatccaaaaactgcagaaactcccgggccagcatatccggcgcgtggtcttttccttcatgaagacgatattgaatcagaccgacgagcatggacgcgacatagtatgcatagagctttttgcccgcctgaatgtgcagaggctgatgaagataaaacgattgcagcgctctgaacatttccgggatgacgtcaggcactcctgaaccctctctcagaaaatgaacgagcggaaggccgccggacagcgccgaaaagagccggacgagcgcggcttccgcttcttccacggaacagtcggcaggatctccttttaccgtcaataatccgatcagatcccggcatgattgatggatgatcgttttcagcaatgcttctttgttggcgtaatggtcataaaaagtggcacggcggaggttgctttgacgggcaatatcggaaatcgtgatcgccgcgtactcttttgtttccgccattaagccgatcatggcttcttgcaaggcctgcctcgtccttgtcacccggcggtcggcgggctttttttcttcttgttccggcacccggcggccaaacagccagtaaaaccgtttttgagaaatcaaatcccacacctgtccgctgatttcttccggggatgccccgggctcctcattcagccagtacaacacaatggcatatgtgtataacgcgcggtaatgaatgtacatatcctgttcagtcggtgagaaatccgcattgaccggtgacagcagcacatcatgccggaacacatcttttaaaaaagcatgaacgtgaaaatacggcattttatgacggtccatcatcgtttgaaaaaacacccggtgccggtcaacaaaagacagtgtcggatgcactttttgccatccgccctgtaaatgaagcacatctttattcttcagcgaatcatacagcgcttcgctcagcccgtctttcatttcttcctctatatcctctaaaatcgcatatttatcttcgtaataaaggtacagtgtcccccggctcacgtgcgcccgttcggcgatgtccttcatggtcacacggcggatatcccgctctccaagcatggccaaaagcgcttgtttgatgtcatttgtcatagaatccggcataagagacactcctttcattagacagatcacggcaatttgtacggtaacgtatagatgcgtttacgctgtctttgccgcaaaaacacatcacattataataggccctgaagaaataaaaaagcaaccagaggaggaaaaccgatggatcagcatataaaagcagacatcaaacgcgtctttgcgcttcagaaaaaaaatcaaaaaacgctgcgtgcttcaacagccgggcagcgcagagaaaagcttcagcgctttttagatgccgtcaccgcacatgaagaagaaatcatcgaggcgatcagacgggacgtccgcaagccttatcatgaggtgaaaagagcggaaacgcagggaacgatcaaggcgattaaagataatatgaacaatctcgacacctggatggcgccgaaacgcgtcggctcatccgtcagccccgacgctgacggcgtattaatgtacgagccaaaaggccttaccttaattctcggcccatggaattatccgtttatgctgacgatggctccgcttgcggctgccattgcggcgggaaacagcgcgattgtgaagctgtccgattttacgatggagacgagccatatcgccgcgacagttattcgcgaggcatttcacgaagaagaagtcgccatttttgaaggtgaggtcgatgtcgcgacagaactgctcgaccagccgtttgaccacattttcttcaccggaagcacgaatgtcggtaaaatcgtcatgacggcagcggcgaagcatttgtcgtccgtcacgcttgagcttggcggaaagagcccgacgatcatcgacagcggctatgatttgatggacgcggcgaaaaaaatcgccgtcggcaaatttgtcaatgcggggcaaacatgtatcgcccctgactatctccttatgaaggaagatgtacaggacacctttacagatctcctgcagaccattgtcaatgcaggttttatggaggatgatcatacggttgaccgcaacaaattcacgcagattgtcaatgaccgcaactttaaccgtgtcaaagccctgtatgatgatgccattgaaaaaggggcaaaaacggcgttcggcggcgtattcgatgctcatgaccgcacgatttctccgaccgtgctgacaaacgtcacgcctgatatgaagatcatgcaggaagaaatcttcgcaccgattctgccgattatgaattacgaagatatcagtgaagccgttgattacatcactgaacgggacaagccgcttgccttgtatgtattcagccataatcaggagctgatcgattatgttctgcagcatacgacgtccggcaatgcttctgtcaatgatgtcgtcgttcatttcactgacgtcaaccttccgttcggcggtgtcaatacgagcgggatcggttcatatcacggtgtgtacggttttaaagaattctctcatgaaaaaggcgtattcattcaagcctctaaataaaaaaaagaatccgcgtgcgcggattcttttttattatttttttgccccgaatgcgagcagtttcgtataagtgccgacgtagagcgtgccgtcttcagccagaaccggggaggaaatgacattgctgtctgtttgatagcgccatttttcattcccctcagcgtcaaccgcatagacgtttttatcgtcagaaccgaagtacacattgccgtccgcatcaatcagcggcgccgttctcacaggcccgtccgtatagaaagaccagttcatattaccggttttgctgatggaaaacagctcgccgcttcccgaaccgatatacacattgccgttatggtcgatcgctaatgaagagctggagaaaccgtttaacgggaacgtccactttacagcacccgttgatgtataggcgtataagttgccgtcctggtttccggcgtaaacggtgccgtctctatcaataaccggataacctttaaacccgttggacgtcgtttttgaccatttcacttggcccgttccggaattgatcgcgtaaaagatattattgtacgttgccgtatacagagtgccgtttgatgctaacacgggagcggagccgaccacgccgtttgttttaaatttccacttttgcgtccatgtcgatggcgacgtcggtttaatcgcatagatatagttatccagcgtcgacacatacagcgtgccgtcagagccgatagccgcatcggaactcggcgctccgctcagcggaaccgatgttaaaatgtttccggtttctttgtcgatgaaatacagttttttatcgtgagaaggaagataaatgacaccgtttgttccgagcaccggagtcagcgtataggtcgtcccgaggttttccgtcacccatttcacagtaccgtccggatgatacgccgtcagcttcccgtcttttgattgaataaatactgtgccgtccccgtcaaccgcggctcccgcaccgttttgaggggtggccggaacattcttttcccattttaacgcgccatcggcagtgcttgtaaaccggctttcccttgaccagttgaacatcgtcggagacatcgcctgcgcgtcataccgtcccgccaagaaaccggatgccgcatgattttgtttaaataccgtttccgcggcttgagcagccgccggatgcagccattttgcccccggcagatcagaaaccgcccccacagataaagccgcagcaaccgcagcgccggccgccaatgttttcattcgcaatgaagctgtcttttttttcaatgtcagttcctcccgtttctattaaaaactgctataccgctttcatcataccataatcatcctatgaaatatttgtattttcggtagatttatagaacaaatgtcacatagcctgctgatgcttcggggatgatcgaaacgcggcaatataccacaccacattgacgatgaaagccgcgcctgaccaaacgaaaagaccgtaataaagagacagctcctgccctaaggaaattgcggtcaataacgccaccaacaagacagccgcgcaaatgataagcccgatcccgcaaaaaacagccatgatgattttcatgccacgaacaccgagaatatacataatgagcgggaccgcatatataacaaggatctgaccgacggcggcccacatgcccgcggaattaaaacgattcgcgttcggccccgtttctgcaagcggagaaagcgagacgaggaccggcaataaacaaaacatcagagcggaaagcaaggtcaccgcaaccgcaccttttttcttttgattcatgtgaatatcctcctgacaataacccggcttttttaccggtaatctgataatatgttatattttagcacgatatttacttaatttgagaatgttttgtcaaaaacgaatttacaaatccagaaaaatagatataataaacgttatggaaccgatattgattcataaagcgttatctaacaaaacacgaagtgatattatgacgtggcttaaacacccggaagaccattttgatgaaagaccttatcttgatcagggactcagtttccgcaccggaatttgcgtcggtgatattcaggcaaagtcagggcttgcgcagtccgtcatctccagctacctgctgacgatgcaaaaagccggcctgctggaatccgaacgaatcggaaagtggacctattacagaagaaatgaaaaacaaattaaagcctttgctgactatgtccagcaccagctataaccatgaaaggagggatttttttgttctaacatatctatttttctatatatgtagttaaataaaaggaggcatacataacaatgaaaaaaagcagctccatcttcattctatttttggcactaggggttttcgggattatcacgaccgagatgggcattatcggcgttcttccgcaagtggcggacagatttcatatttctgcttcaaaagcggggtggcttgtcagtattttcgcgttcatcgtcgctgtgtcgggaccgtttttgaccttgcttgcttcaggtataaaccggaaatacattctgcttttagcggtgctgatgtttgccgtttcaaatgcggtctacgcgtatacggcgcatttcagtgtcatgctggcgtttcggatcattccggctttatgccacccggtgttcttttctgtagcgcttgcggccgcggcccggcttgtccccgccggccaatccggaaaagccgtaacgaaagtcttttcaggcatcaccgccggctttgcgttcggcgtgcctttcacgtcttatctggcggatcgtctctctcttgaagccgccttcttattcggcgctatcatcagtctcatcgcgttcacgggcattcttctctttttgccatccatgccggtcacagaaaaaatgtctttcagaagccagctcggcattcttcgcaaaccggctttgtggctcaatatcgctgccgtcacctgtctctttgcggccatgttttctgtctacagctattttgcggagtacctcgggcgggtgtcccatatgatcggcacatgggtcagcttcatgctgatgagtttcggggtgattatgatagccgggaatttcgtcttcggtgctttgttatataaaaatatgaaaaagaccgtcatcctgtttccgcttctttatacagccgcctacttgctcatatacgggtttgggacgtctttcgcgccgatggccgtcctcgtcttcgtatggggcgccgttcattccggcggtctcattgtcagccagacatggcttactgcggaagcaaaggaggcgcccgaattcggcaacagcctgtttgtctccttttccaacctcggcatcaccatcggaacggcggcgggcggctggtttatttcacatttgggaatccatcagctgatgtggtgcggcatcatgtttgcccttctggctttcgggctgatcatgggacgcttggcatggggaaagaggctgctcgcagaagcttaagctccattgcaaaatccggaatgattacgtataatattccagattaaagcaagggagagaaaaagatacatggaaagaccggcaggattttggattcggtttctggcttacgtcattgatcaaatcatcataggaattccgatttttatcattcaatttatggtctcttttttatttgcggcaggcgttgcggcggctgaccccttcatgaccgaaaatcagtttaacatctcttttctggtgttcggcgtcattccgattcttgtgagctctattgtgatcagcatcttatatttcagcctgctcacagcctcaaagatgcaggggaccctgggaaaagcattgctcggccttaaggtcgtcaatgaagatggcggacgcatttccatcggccaggccttcggacgcgctttcgcctatatcatatccaagctcattctttatatcggattcatcatgggtgccttcggagagaaaaaaacgctgcacgacatcatgtgcagcacccgggttgtttataaataatgtccccaagtccgggccttttgagcccgggcttttttatgacggctgtgcccgcctgatgtcaatgccgccttctccgtcagcctcaatgcggatcgtcccgttcacaatgacagacagcggatggaactccgcatgctgatcagaaaaaatccagcggcggccgctcggccctaaaagcaaaaacgccccatcattgtaatcacccataaaatgaaacccgttttcactaagaggcgcatgctttctcaccggaatgccgagacgctgcagctccttccccgtcgataccacctcggcagccgtcagattcacctcaccgatattcagaacggactcaatcgaaaaacgttccgcgcttggcggcgatgtgtctctcgcgatgaattccgccagattgttggacggatctttaaaataaaaggaacgcgcctgaatatgggagaaatacacctcatcctccccatcttccgtttgaaaaacgactttatcctttatccacgccttcgcctcatcaaaacgattattcggaatgttaaacgcaaaatgatacgtcggttgagagtgagaatcggcgcgcctgaattccaactcactttctcccgccttgatggtaaacgaatccccggactcatcaattaaaggaaaacctaacacccgttcatagaagtgtttcgtctcctccaacgcacaactgtacaaagtaatgtgatttatttgcatgatcataccccctttggtttatactgccatatagaggggttgattcctactgtttcgattcaccaattgagaatccccctttcgcccggcgctaaacatgacaaacagcgccaaaccgcttataccaggcgttttttaacgtctaaagcaaaaaaagcagaaaataataccccatatagcttgacaaaaaataaatgttatttaataatctatatataattagaattattattgaaagataaagtgaatgctttgtctttttaatatatttcaaatcacatttcaggaggaagatattatgtctttaatcggaaaagaagtactgccattcgaagcaaaagctttcaaaaacggtgaattcatcgatgtaacaaacgaagatttgaaaggtcaatggagcgttttctgcttctacccagcggatttctctttcgtttgcccgactgaacttgaagatcttcaaggacaatacgctgcactgaaagaattaggtgttgaagtatactctgtttctacagatactcacttcgtacacaaaggctggcatgacagctctgaaaaaatcggcaaaatcacttacgcaatgatcggtgacccatctcaaacgatctcccgcaacttcgacgttcttgacgaagaaactggtcttgctgaccgcggaacattcatcatcgatcctgatggcgttatccaaacagttgaaatcaatgcaggcggtatcggccgtgacgcaagcaacctagtaaacaaagtaaaagcagctcaatacgttcgtcaaaacccaggtgaagtctgcccggctaaatgggaagaaggcggcgaaacacttacacctagccttgatttggtaggtaaaatctaaggagtgcattccattggtacttgatgcaaatatcaaagcacaattaaatcaatacatgcagctaattgagaacgacattgttctcaaagtaagcgccggtgacgatgacacttctaaggacatgctggctctcgttgacgaactggcttccatgtcatctaaaatttcagttgaaaaaactgaattaaacagaacaccgagcttcagcgttaatcgtaccggagaagacacaggcgttacattcgccggtgttcctctcggccacgaatttacatcattagtgctggcattgcttcaagtcagcggcagagcgcctaaggctgatcaaaaggtcattgaccagattaagaacatcagcggagaataccgctttgagtcttatatcagcctgacgtgccacaattgccctgatgtcgtccaagcattaaacatgatgagtgtgctcaacccgaatatcacacatacaatgattgacggcgcggcattcaaagaagaagtagaaagcaaaaacatcatggctgttccgactgttttcttaaacggtgaatctttcggcagcggccgtatgaccatcgaagagattctcgcgaaaatgggcagcggcgcagatgcgtctgagtttgccgacaaagagccgtttgacgttcttgttgtcggcggcggacctgccggcgcaagcgcggcgatctacacggcgcgtaaaggcatccgcaccggtgtcgtcgctgaacgcttcggcggccaggtactcgacaccatgagcatcgaaaacttcatcagcgtcaaagcgactgaaggaccgaagctcgctgcaagccttgaagagcacgtgaaagattatgatattgacgtcatgaaccttcagcgcgcgaaacgccttgagaaaaaagacctcttcgaacttgaacttgaaaacggcgctgtactgaaaagtaaaacagtgatcctttcaacaggtgcccgctggcgcaatgtcaacgtacctggtgagcaagagttcaaaaacaaaggtgttgcatactgcccgcactgtgacggaccattatttgaaggcaaagacgtagccgttatcggcggcggaaactccggaatcgaagcggcgattgaccttgcaggtatcgtcaatcacgtgactgtgctggagttcgcgcctgaactgaaagcagacgaagtcctgcaaaaacgtctttacagcctgccgaacgtcactgtgcacaaaaatgcacaaacgaaagaaatcacaggcgaccaaaacgtaaacggcattacgttcgttgaccgtgaaacaggcgaagaaaaacacgttgaactccaaggtgtattcgtccaaatcggtctcgtgcctaatacagaatggttagacgaaaccgtcgaacgcaaccgcatcggcgaaatcatcgtcgataagagcggcgcgacaagcgttcccggcctatttgccgcaggggactgcacagacggcccgtacaaccaaatcattatctccatgggatcaggtgcaactgccgctttaggcgcatttgattatttgatccggaattaatgtaaaaagcgctaccctgcttacacggcaggatagcgctttttttatattaaaacggcatactgcatggcagtacaccgtctgaagtaattcaatctgtctttctccctctcgcccgatagataagaaacaatccaataaaccacagcggcgtcagcagcaaagccgggcgcgtcgcatccgcaaacagcataatcaccagaatgaaggcaaacagcgccagcacggcgtaattgataaacggcgcaaacggcgccttgaaagacgagcttgcgtgtaagtccggacgggttttcctgtatctgatatgacagacaagaatcacgccccacacccaaatgaaacagatcgcgctgatggttgtcacgatgccaaaggccgcttccggtatcaatttgcttaaaagagcgcccgctgacagcacaataaccgatatccataacgcgcggctcggcacatgatttttattcagcttcgcaaaacttgccggcgcctgtttcgttttgcttaagttatacagaatccggcttgttgaaaacatcccgctgttacaagcagaagcggcagacgttaatacgacaaaattaatgattcccgcggctaacggaatgccgaccagactgaaggtctttacaaaaggactttccgttgcattcagctgcatccacgggttaatacataaaagaatgatcaatgccccgacgtagaaaaataaaatccgcaatggaattttattgatcgcggacggaatattttttttcggatttgacgtttccgccgccgacacacccactaattccacaccgacataggcgaagatcaccatctgaaatgaaagcaaaaagcctgaaaatccgttcgggaacaagccgccgtgctcccacagattcgccgctgaaaccgttccggtatgcgttttgaacccaatcaccagcagaaccaccccgatgacaattaacgcgagaatcgtgactaccttaattaaggcgaaccaaaactccaattctccaaaaatcttaaccgttaacagattaagccctaataaaatgagcaaacagataagtgccggaatccactgcggaatatcaaaccaatatttcacatacacaccgacggcgatcacatccgccatagccgtcataatccagcaaaaccaataagtccagccggtgacaaacgctgcacgcggccctaaatacgcctcggctatatccgttaatgattggtaccccgctttagataacagcagttctcccagcgccctcatgacgaaaaaaagcgcaatacctacaataaaatacgcaaagatgatagaaggacccgccagctgaatcgccttaccggaccctaaaaacaatccggtaccgatcgtgccgccaatagcgatcagctgcacgtgccgattcgataagtccctctttagctctcgctgctccacatctgactcctccttacctctctagtgaacgacgagcaaaaaaagccaataaaaaaagagattggatgccctccaatctcatggtcataagaatatcaaattatatttgcgccgctgacaatcaacagcatgacaaatacatattcggtactcttctgtccttttgcctgagattgtgaacccttcggcgccgcggaaaacccgcggtctctccagaagccgctcctgctgtagtgcgacccacagcaatcatagcctgctacgtattgagtttccgatagaaataactatcagctaactttttattttaatggaagttgaatgcattgtcaacaggggtatacgctcacagcgttatcccggtccaatttttgatgcctgaagcgccgtatcttccgttttcattgtctcaaaaaggcgttatgcggtactatcatataaggtctaatcatttaaacattatgtcatactttaaattcactttatcatacaattgctcgtaaataaaaaggggatggacgagattggaaaccaaatatttagatctgctcgcacaaaaatacgattgtgaagaaaaagtggtcacggaaatcattaatctgaaagcgatactgaacctgccgaaaggaaccgagcatttcgtcagtgatctgcacggggagtaccaggcattccagcacgtgctgcggaacggttcaggaagagtaaaagagaagatccgcgatattttcaacggcgtcatttacgatagagaaattgatgaattggcggctttggtctattacccggaagacaaactgaagctgatcaaacatggctttgatacgaaagaggcattaaacgagtggtataaagaaacgattcatcggatgattaagctcgtttcttattgttcttccaagtacacccgatccaaattgcgcaaagcactgcccgcccaatttgcttatatttccgaagagctgctgtacaaaacagaacaagccgccaacaaggaacaatactactccgaaatcatagaacagatcattgcgctcggccaggccgataagctgatcaccggtcttgcctacagcacgcagcgattggtggtcgaccatctgcatgtggtcggcgatatttacgaccgcggaccgcagccggataaaatcatggaagaactgatcaactatcattcagtggatattcaatgggggaatcatgatgttctctggataggcgcttattccggctcaaaagtatgcctggcaaatattatccgcatctgtgcccgctatgacaatctggatattattgaagacgtttacggcatcaatctgagaccgctattgaaccttgccgaaaaatattacgatgataacccgtctttccgcccgaaagcggacgaaaacagaccggaagatgagattaaacaaatcacaaaaattcatcaggcgatcgcgatgatccaattcaagcttgagagcccgattattaagagacggccgaactttaatatggaagaacggctgttactggaaaagatcgattatgaccgcaatgaaatcacgctgaacggaaaaacgtatcaactggaaaacacctgctttgcgacggtgaatcccaaacagcctgacgagctgctagaagaagaagcagaagtcatggacaagctgctgttttctgtccagcactccgaaaagctgggccgccatatgaattttatgatgaaaaaaggcagcctgtatctgaaatataacggcaacctgttgattcacggctgtattcccgtcgatgaaaacggcagcatggaaacgatgatgatagaggataaagcttatgcgggccgtgagctgctcgatgtatttgaacggttcttacgggaagcgtttgcccatccggaagaaaccgatgatctggcgacagatatgacgtggtacttatggacaggcgaatactcctccctcttcggaaaacgggccatgacaacctttgagcggtatttcattaaagagaaggaaacgcataaagaaaagaaaaacccgtattactatttgcgtgaagacgaggcaacctgccgaaacatcctgaaggaattcggcctcaatccggatcacggccatatcatcaacggccatacaccggtaaaagaaatcgaaggcgaagatccgatcaaggcaaacggaaaaatgatcgtcatcgacggcggcttctccaaagcctaccaatccacaacaggcatcgccggctacacgctcttatacaactcatacggtatgcagctcgtcgcccataaacactttaactccaaggccgaagtgctgagcaccggaaccgacgtcttaacagtgaaacgattagtcgacaaagagctggagcggaagaaagtaaaagaaacaaacgtcggtgaagaactgatgaaagaagtggcgattttggagaaactgcgggagtatcggtatatgaagtgaagaatatggagttcagagatgattctctgggctcttttttttacggttacggactaatgagtccctttccctatacgtaaaacggatttaaccgcttcttcaatctcccgataaccggtacatctgcaaatattggactccagccaatttttaatcgtgtcatcacttgcattcggctcagtattcactaaagcatgacaattcatgagaaaacccggtgtgcaataaccgcattgaaacgcgaatttttcaataaaggccttttgaatcggcgtattgatcagtccttcaattgtcgtaatatcctttccttccccttctgccgcaagcattaagcaagatttcatcggcaccccgtccgttaataccgtacaggcgccgcaatccccatttaagcagcccggctttgcaccagttaatccgagacgaagacgaagagcaaataacaaagtatcagccggtctgaccgtcatctgtctttcctcgccatttactttcaacgtaataggatcagacatttggacctccttctaattcccgtaaggcatctaaaattgtatgttgcaagacaaatattcggtattcacttgagccttccgcatcatcaagaacgggtttgggtacatactgtaaagacctgcgcgctctatcttctaatgaatagcttttatcgttaagcacagcctccatttcagcagaacgaaacggaaatggacatacgccgctgaaagccattctgatctcatcatcttttttcagcgcacagactgtcaccaatggatatccgacattccactgctgtcttcttttgatactgacaaatggcaagtcaacatacgctcgatcgacaacgatatgaaataaaaaatcacctttttgcaattgtatttccttgttaaatactttatttataggatggtaatgaatccccgctctccctgcaatccctagcaaactatcagaaatcagcaacggcagcacggcctcacggtagtagatgcccccgcaaatgtttccgcccaggctgatcttatttcgagtcgtccgatcggctatttcacttactgttttacttaatagcggaaatggattttcttcctccagtttcgttaatgacacacccgctccgatcaccagttcatgttcataaaagcggatggtttgaaatcccggaagcgcgttcatgtctatcaccgcatccgtatagatgatattcagccttcctaacgtgataatttccgtgccgccggaataatacattggtgttttcttttcggccgcaagcgagtgaaatagattgattgtttcttgaatggtcttcggtttaaaataatcaaaatcaaacggtatcatctttccacccctcttgcgtcctccataattgttcgggaatgagaggaagttgattcaattggacacctaaagcggcggaaaggcaatttcccaatgcggccggcatccccagcagtccgtgttccccgccgccgcgcgctccataaggcgcaatcacatgcggggtttcaacaaattcaatgatatattcaggctgctctccatagtgaagggggcggtatgttctaagctgaggatttaatactctgccatatgaatcaaatacaaaggtttctcttcctccgaatgcgattcccatactcatcccccccatcacttgacccttgcagctttttcattcaatactgttcctatatccacaacagaataggcttttgtaattcggtacgtataatcccgtttatccaactcaacttcaatcccctgagcacctacagcccattcgggtcccggctttcctcttcccgtttcccggtctaaattcgtcatccgggttaatgtgtaattgccgctcgcaatgatttggccgccaatggtatttccattcggaaacgtatatccgtaagcaatgtcttttatgtcaacatgtacagaaggatgatctataaaataaacctttccgtcggccacttccaattcctcgacaggaactcgcaacacacatgatgccgcgtccttcagctttcgaatggcttcctccgctgcattcagtacggcttttccggccattaacgtccctctgctccccacggttttccaatgctcgggtgttgtttgtgtatctacaagcatttttacgtgaattttgcttatatccattttcattcgttccgctaagatttgggctaacactgtttttgtccctgtcccaatctccactatccctgacatcaaattaatgcttccatcaggattaaaggttaaaatcactccggacgttgcatttgtatcaaatgttgaggttttccaaatacagctgatccccttcgcccgtatcttccggccgtcgatttcaattcgctgtccctcgtcccaattcattaattccttcaatctttcaatacatttcggtacatttccgaccgtgcttgaattgagaagaacttgagtcggtgtggtgtcaccggggcgaatggcatttttatagcgaagttctaacgggtccatgttcagcttttccgccaatacatccatcgtccgctcaaaagcaaataacacttcagcatggctgtagcctctgaatgcacttggatatggatgattcgtatacatacaatatgaatcacacgatatatggtcgatagcgtacggacccgtacaatcaaccaccgcagcccggctgatgtccactcctttatcagagtatgctccgccatcaaataaaagctgaatgtccgccgcctttaaaattccatcctttgtggcccctaatttgacaatggcatccaatcctacatgaacgggagatgtgatcatatcctcttctctcgtattaaacaatttgacgggccggcctccgactgcttttgatgccaaataggcaatcacctctaactgaacggctgcttttcccccgtacgccccgcctactaaaggcgttttgacgataacctttccgggttcaattccaaaataccactgcattaattttttaatggcaaaaggggcttgagaggatgtggtaatgataatctcctcatccgcccgaatttcagcgatcgagcatcttgtctccatcgcagcgtgatcagaagggttaaaggaaatctggaattctgctgtcacatcactttccctaaatccgtcttcaatatttccttttctaaccttatccacgtttgcgatatttgtcttcggaaccgggaatacaccttttgtcttctcatagcggtccgcatgttcatgaacgagcggcgcatccttttgaaaggcctcacggggggaattgacgacgggaagaggtttataggatactttgatggcatccgcggcccttttagctgtaatcggattttccgcaacaacaacagcaaccggctcaccatggtatctgacccttttataagcaatcggcgatctgtctttaatttcttcacctgcaagcggaaaaggttcatcccccaatatcgctctcacgccgggaatcttccaagcttctgaaaagtccatcgacacaatatcggcatgagcatatggactggtcagcatttttgcgtgcaacgtccctgtttcttgaaaatcatccgtatatttcgctttacccgtcactttttcaagggcctctttccgaatgacactcttcccgatatactccaactcattcactccccgaatttattcagcagcagcgtataatcttcaactgtatcgacgtcataaaaaagcaaagggtcttgaaagctgatcatttttcccatattgatcatactttcacggatcacatgccgggcgccctgatctccctttaactgatgcaataccgggaaacattgatttgagaataaaatgggggcataggaagatgctgattttcagcggcgataaatgaataacggcgctctttttgataggaatcaattaacgtattgatgatatctgcggtgacaaacggctgatctgcaaggagaatgataacggcgtcagcctcgtacgctgccgctttttgcaaaccgcattgtatagaatggccttggcccttacccgcttgctcacattctgcctggctccacttatttgacatgggatctaaaaagaaaaaatccgaaagccaatgcagtgaatctccctttctcgtaataacaaaaatatgatctaattcagataacaaggcatttttaagagccatacttccgagggaaacgccattgagaaataaacttcgcttatccgttcccatgcgtctgcttgtaccggctgccaggtaaatgcctgctgttttcataggcgagacctttgttttcgcattttttgaatcatctcgccgacaatgcttacagcaatctcttcagggccttgtgccccgatgggaagtccgataggggaatgtatatcttccggaatctcacccccgcctaaaagccgctccgtacgccttctggggcctaatacgcctttataaaacacattctcgttttttaatgtatgtaaaatgatctgatctttttgaaagctgtgcgtcataatgacaacaaaatccctttttgtcatgctcaggcctttcatgacttcttcaggcgctcccgttatcaaatggccggcttcaggaaaatggccgtgatgacataaggcgggacgccagtcaatcaccgtcacatgaaagcccgcacgagccgccaacgaaactaacggcctcgcatcttctcctgctccgaagacatataaacaaggttttggcaccatctgatggataaaaaacaaatcagatgtatgttcatcccttttgattcccttctccgtctgtctcagtttttgaatacggccttgttccatcacatccccggttccaaacacgctgccgtcttcagcgatatacagatcttccttcggctctaacgtttcagtgaatcgcttcattcgggtcacagactttttttcatctaagcatgtcttgactgtcatcagatgccgttccaattccccttttacaggctcaagcaacaccgtcaaaacaccattacagccaatgccctgtccccaggataaatcgtcttccgcactcatatcaaagcggacaatcaacggttctcccgcagaccagacctgttctgccctttcaacgagatcttcttccagacaaccggcggataacattccgactcttgttttatcctctaaaatcaacatcgaagccccttctttcttataagcggacccctctgtttgaatgatggtagccagtaccttagctttcttagaattagcgatgacatccaaaatccggtgtatatcatccatctcatgtcccccgcttttacctgatcatatctgtatatccgtattctctttttccagaaaacattacaaacgcttcagcaatttcttcgtttctaaaaaaaaagagtctttatagaccttatgaccgggcggcgggtgcgacagcatgtcggagcggagagattccaataacacgttctgttccttctgtttccgattgtctgtttcaccctgctgtatgcctttaagatccgaaaagtattcacttaacacttgtaaatcattccccagctcccttttatcacttgaagataaagctccttctttttcccattcttttaacgttttcactatatttgacagatactcaaatccggcgttcaacttttgcatctctatttgatagcttgaaatgatgtttttatgtttttttctgacggggttgaattttaagctgtcagaggctgtttgcagcatctcttttgccgtatgcagctcctgcagaagatggttcattttatattccataaggttcccttttccttgtccccactctgattgcacccatttggaaaggtctgaaagtgcgtcggaaagctgacgggccaatgtttgaaaagagtccgctgccttttttgtgtagtccggcggaaaaaggaacatgtgaatcagaatggcgatgatgacgccgatcaccgtatcgatgattcggtcgaatgcataatctttagagtttcgttcaaacgtaaagaccaataaaatggtgagcgctacctgatgcagaaccgttacatctattcgtaaccactttgcaatgtaagtcccgcctaataggaacagccccagcatccagccattcattggcaagtgactgacaagaaaggacgttagcatgatcccaatcgcagttcccgcaatacgatgaaaagaaaaacgaatcgactgatctatcgttggctgcaaacataagataacagacagaggcgctaaataggggtgatcagagcccgccagttttgccgcttcccaagaaaccgcagaggcaatcgccatcttccaaaccaaagatgttttgttttgaattttttcacttttcatcatacgccccctcctttcagaaaccttttccactaggtttccgtgacggaaagggatttatactgtcgtgtggaaaatgcggaagaagctgttgttcgcaataaaggtgcttctctgagctcttctttacggtttctatcctccttgataacttcgcatcagatatgaaccctgctctcctatgactttcgaagggaaacatacaaaccttgttggttaatgtgatgaaattgggtgaattttttatcattttatatggtaaggctttaacaagcagaatgcctttgttagtatggcaaccaaaggaggaggatcaattatgcaaagcagaatgaagctaaccgcagtgaaactggcagccttggtattcctagcaggtgcctttgccctcccggttttacctcatgctgcggctgccgcaggttcccaagctacatacaaagttgaaaacctcaacgacagtgagctgaagatgacgttcaatcatgcagatgttcatattgacgctaaaggcaatgcaaccctaaaagacaacataacgggcgaggagcaggctcttccgaaaagctctactgacaaaaatggtgaccccgttacactgaaatatgaaaaaatcaaaaatggcgttttagtcaaagtcgtaaacaaagacgctggaaaaacaagcgggtcaatcagcacccaatcagtcgggaaatgtattctaggtactggcggcggtgcggtaactggcggcggcacactgggtcttgcaggagctgctgtaggaacagtcacaatacccggcatcggaacagtaggagcgggtgccgtcggagcaattaccggcgctgttggcggtgcaatgacgggagctgccgcatcttgcttttaatcatgaaaaaaaaagggcccgcgcccctttcttttactaactatggaaggtggtcgacatgtacaaaatcatcattccttcaatactagccatcttcattctctggatactcttacagatttcgctggagataagtatcgttaagaatccattgaattattttattgtattcattgtcttctttctctttataaagatggtgaaagagaagcaacagtaggttgcttctaatcagctgtggggaaccagattttagtggatctggtttttttgttttgttcactataagccaacaagtgatttcatagtaaatcgaatattgacaacaaatcggcctgctatacaagataatcgggacttatgatcttggtttaccgagtctttatataaaaagtattttcctttgacataagagcatccgattgattaaactcaaggctttatctccctagaaatatttagccgtcacagtttactgcgatatgggtattattttcttgtacggttagtagaataatcactttaaattcacttttagcaaatgcatttatataacttccccgcaaaggaataataatgtgtttatcctattgcctatacagcacagagggattaacaaaaccagcgttttatacctaggtctgttaacatgctatataaaataacataaaaattaaatgtaaaataatatagagaggctccaattaattcattatgtcattcaactcagagaattcatcttgcagaattctaaaaccttcgttaatattcttttcatatattaatcgtcttttatttgtggattcctgagaatagaaagaaagatctatttctactccttcatttttaaagagctcagcacttgagatttttgtgaatggtattaactgacccgttctaatatcttgtaaaacccctttaatttcaaataaagttaaaagctctctcaagtttttgtcgtgggataagaaaaatggtataaaatatcttccttcactattcaagttagagaaatattccattaccctcggagccataaaatcccaagctgtgttttcaattttttcgagtaattttttttgattaccacctttattaattttattaaatatcccaacagatttaggattcttgaaatatttaagcgcaataaccatttctctttcataataaattcctactttattttggacatattcaagtaacttaatcattttattttttgcatttttttttgaactgaactgtattttgataattccgatcagaagtaatgttaaattctgatgcatatctaagaacttctttaatgaacttttaccatccctagttttatataatttatatattatatcgtctactctttggatagcctcaaacttcgaaatttggtattcaataatattcttatttatgtatatatcattatcaatgcttttaaatagctctaaaaatactaaattctcgtacatatccctatgtttttttatagaagcatcaaaactcccattatctttaataattttattataattttctactaaatagaaattataatcataatgaaatttatgttttagtagagtatctatagttttgtaaatactttctttctcaaattcactactcccttgattgttcaaaaagcgaggaatataactagcataattagtatctaacatcacagaatagtcaataggaaatgatatacttccattaaataacatatcattcagtaattcatcatccatgtaatataactttccggtttgaaagtaagaaataaagtcttgatcaactgcatttaccaattctcccaatccaaccgggaaagtatctttatcataattatctaggtttatactcaacttaaagtattttaaatgttccttgtgcttattccatactaaaaatacttcccttggtgtttctgccgttgataaaaaataaatcacctttcttaaaatcatttcttctttcatgtatttactccttaataatttgttttcaaatttgaaagtaaattatttgattcacatttattatctctttttttctaaacaagtttattgagtaatattaattgctctagtctgtatatatttttgtgcttctgtcctaaccaaataatgattatctatggaagctttcttcaatattaaattattaactttggaatctataattgctaatttttcaaagtttcctattataagattttttatatatacattttcataatccatagattgtgaaagctgagtcagtataactttttgagttttggttgttatcatttttagcaatgctttaattgataaataccgtatatcttgatttttgtcattcttcaaacttaaagtgaattgaataatgatactacgaatatctgattctatatttttaaatgattcattatttatagcatttataatggcctttaagcattggattttttcaaactcatcctcattattaatttcacttaatagatttaataaatcaacattatctagttggcaacataccattttaagcataaaataattaatctttacggttaatgtcgaatatttttgaaaaagatcatcttttccttcaaagagatggttttcgtgtttaatcaaatattgatataaatctttaaaattataatcaatattttggaaattctgtttaatataaatagttaattgtaaagcactcaccttatcagaatacagtagattagttgcacataacgattcattacatacttgaagaacttcatttaatagatagttatcaactatttcacaaccctctttaatgatattttggattattagatatgggttttgcgctttcacactgtaaatcccatttttaccttgtttctcaatttgttccttgatctcctgaacataactcataatatggctttctcttttgacactagatgtttctaaattataaattttgcgatctgattcagacatgttacttaatacaacttgatttaattccgaagtacccgctattatctgttttcttaaatttataattgcatataagaggttatgacactggtttgctagattagaatctaaaatgattcctttcaacaaattctttattttttcaaggttttgagtagatatccctttaaaacttattattcctatcaaatttaaagcatcatcataaaagcgaaacatctttttttctaaaatttttatgcatactctagatatttcatcggcttcgattctattgatattttctttcaaagaatcaaatattaattttcccatagacactataaaagtattatcaatataattatgaatctcttccaataactctcttttgatacacatgtaatcttcatcgctaaaataataccctaaatgtttaaatacttctagcttagattttattctttctgattttaccgggaggcagtttgtaaaattataaatattttttacatcaatataattgatttttcctaatatgctattaaagtaggaaattatattttctgtttgcttgctatctccaactattactgccatttttaacagcaacactctgaattcccaattggaatattcctcacataattgaaatgatatatcttttattttatttctcaataataataattgagttaaagatccattaaaggcaccaacaatataaatgttagtcaaatatttaatataaacatctaaattactaccaaggttaacagtatacacagtttcagttttcttttttgttgatgctttattaatttctttatataatagcttttcatatctatcaattgatgggtaaaacagagattgacgcatactttctaactcttcttgtgcagcattcctagaggagaatttattttcctgatttaacttttgattttctatatttattaaatctatcagtatatcctgtgaaatccaatcaggcaacccactttccttacataagtcaaaagcttcctttaagtattttaatacagaatcaaaatcatcgagccagtaaaactgaatagctttccatcttaattttactactagatgcatattatcactttgctctttttttatttgctctaaaaataaatccccattgaattcttcaatacttttttcaccaaataatacttttagaaattgctcataaaatctatctaattcactcgtttctttcacttctttattaacagaaaatatcttttttccgatatatgcttttgatttatcaattccttgtaaaatacgtttctctagtgattcagaagctattgaacctatttctattttattctgttcagaattgtgaaattcttggtctatgagtctatttttacaatagtgtctataaatattacatatgtctgttattaaatctttaaatccttgatttgcaaattcattaaaactattaactatataatatttagctccttttgctccaataagttcttcttggatttgcgtaggtttactttctttttcattacaaaatagatatattgacttttttgggtgtgatttggctctagttatttctctaacaattgcagatgtaacatcatctttattatctattaagaatagacatacatcactatcatctagggcatataaataatcctgttctgcggactgtgtcgaagctccactttcctcaaatagatatacatcagcaatctttgtcgattcgataagtttttttagttgttttcttacttcatcatacctttcaaaaccttgtccacaccttgaacttataaaaactttaattttattaggtaacaaaatgtcattcttcaaatttcaacaccctctatagattatatttctattgtaataaacgttaattaaatgacgacttaaataatataaaatttatcatagtctctatctaagtgagatttgaatcatttttgattaaagtcttcgaaacatccctatggtaacaagcttaattaagactaatgacagttgagaattgatgtagctttatgtgaatttttttaaatctaatatagagttacttaagcataaaaaattaatagggaagctttatactccccctttactcttatctctataatattagtcttccttaccttgaaccatattaagtccggctctgtatagaaatggtgtccaataaggtttatgactaccctttttttcctcaaaaaatccaatagacactaattcatttgcaatatttattgtatcttctttgtttattagaaatatttttgaaagggtaccaacatcatgttcagttttctggtcttcaagtttttctatgtatttttttagatgtgcatattctgcataaattgtttgctctaaacgaattttggatactacttttaatgcgtccttcaaagcacttcgtcctatgatttctgaataagagttttctggagtaccagtttctaacaatttaatttgttttgccctagcctcattcattaaatgaatgagttctcttggagctgttatttttaatccatccttaacccgtccaatcatccatttaaatgtttcaggattctttcctacttcaacttttttcgggaaaatagaatagaatatttttttctgcttgtcactatcttttaatacatcatctttttccacattaaaaaatttgcaaagaatatcgttttcaagaatacgactaaccagtaaatgtaaaaaatcctgttctgaccaatcaatcgtcacttgctttgttatatgacttgcctccctaaaacccgttttagtaattcgtttccaaatatcctctctaataaagatttttaattttatatgtttgtgcagttttatattattgtaaacctgaaaaagtgttcttagagctaaggtttcaaattcaggttttccgggaaatgctacatcaagtctatcaaatgttatccaaacgcttaagtcaacacttttaagtgcctcattagccatttcaagaagttcaaaaattgatatagctcctaattctctatgttctttacttggttcatttaaagagattttcccttttaaaataggtatattagttgtaggttctacggttactactccttcaacttcttttacatttctaaagaattcaaaaacataatctctaacattcgtaaggagacgtcttatccctttaccttctaataaaccttctaattcaagtcttctaataaaatcttttacttcttcgcttctattacgaaaatctttgattttatcacctatcagagtaatgatatagatagaccataggtactgaaacgaggtttcagttaaatcagcatcaccaagaacagatttaaaaacaggtgtgccctctaggttttctgcaggtattaataaggtgtttttcgcagcaaaactaccctctttttttaataattgcatatataatgcacttttacctgaacctttcactcctcggactacatcaatttcccccatcaacaattgattccatactgccgtttcaacaaaatacgatgctaaattctcatcctcttcggctaccctctccccgaaacgcgagttcataagtaaatctatttttctttccaaaatggtcatcctttcattcataatatttccatatgaatatattataacaaaatatgatccttaacgattatttttatgctgaatacatcaagaaaatggtatttgcaaacctcactcacttatgataaggctccccacgattaatccgaaacgcccggtaaatctgctcaactagtatgagccgcatgagctgatgaggaaatgtcatttttgagaatgacagtttgtcgtctgcgcgcttcatgacggcgtcgcttaggccgagtgagccgccgatgacgaaggtgattttgctttttccataagtcgccagcttatctattgtatcggccagttcttcggatgttttcatttttccttcgatggcgagggcgatgacgtgggtgtccgggctgattttggccaggatgcgttcgccttctttgtctttgacgattttcatgtcttggtcgctcaggttttccggcgctttttcgtccgggagttcgatgatgtcgatttttgcgtaggctgagagtcgttttttgtattcttcaatgccttgcttgaggtatttttcttttagttttccgatggtcacaatattgatattcacaggtcatccccactttagaaacaagttattcatatatattgtccacaattgtggatatcttttctgtattttgtgtaggatcattcgttccctactagatatgttgcagtgtccccacataattcacaggctgtggataaactgttagtatgttcgatttttctgatttcgggcggaagctcatgatcatctatgtacatgtccagcacggtttcgatatgttcttcacaagaataataagcggttttcattgttacatcctccggttttcttttgcgcgcggcaattgttctcttttcaatataacctatttatacacatgttagtagtgcttcgggctgagttttatccacaattcggcaaatcacgcgcaaaaagagccggtgttttcagcatccggctctttacgtgttttctcttttttctaagcgaaggacgaacagaattcctaatagacacgccagcagcgtacagcatacatcaatccagtccggctttccgccgtttaaaaaagagttggttatcacggaaaccaggagaatggtgacggtcaccgcggcaagctttttcttcatcggctccctccttcatctgactgtcttctgcttttacggttcaaattcctctatttctttttcttgctatatagccttatcatgagggtcacaacgatatatacaatcataatcaatgccccgttactcacatcagggtatccaatcaacatattcattatgacaaaaacaatggttatacaaatgacggacaacaataagaagatactgaatgatttcaaatgaacaccttctttcccgcagtaacgtttcattataaaaagcttaccaaaagcggcaagctcttccgaaatgttcatactctttaaaacccatccatcacctgcacatcatacagcttgagatggcttttcggcgtgacgatgttttttaagtttgggatggtcaggtcgttcagctttttgcccgttttcaggtcgaaggattcgattttggcgggctttttgtagctgtacgtgaacagatacagctttccgttttgatgggtcagctccttgaagtcggccttcattcgtgatgcggggagggtgaaggcctttttgctttttccggtctcagggttgatgcggtagacggttccgaagccgtcaacgaaatagaagctgcgatgctccatgaaaaagctttttttgaagctgaacggcatggagtcatagatcgtctgttcgtcatttttataagcggcgatgtcatacgttttgatggcgccgctgtttttcatgactttcaccatttgatagatgtgatcggctttttctcctctggtaacaaagcagacagcgctgtcgtccacggcgagctgggattcgacagacgtgccttctttatacgtccacgtcgcgattgatgttgtatggagcttttctttatcggcctgaatgtcttggacgtgatagcctttttcgtcatctgtcggcgtgagcgcgaaaagatgatctttaaaaaagcctgaggcgcggatatagtgcgggatgacgtcttgcttccacctgccgtccatctggcggtacagctctgagcgatagctgccgccgctcttgtcgtagcccgaattatacagcgtgtaaaagcctttcgcccgttcgatatatcccgcgctgtctcccgtatgctggtacgctcttttatacgtgtgaaggccgtcctgaacggtgtagattccttttttgtcctccagcagcacgctttcgtcatgcactttggccgatccgagctcaagccccttcatttgataagaagaaagccgccctttttcatcggcgaagagggcgtagctttttccgccgccgaacgtgtcttggtcagccgcagtggagaaatacagcaacgcctctttatctttcagaaaatcagggtcatttaatgtgtctctcgcaacctccgcagggtcttccgtgcggaaatagaagaagcataagaccgctgcggcggcgatgatcactaagggtatccagatgatttttttcacgttgttctccttagtgaatggtcaggatcgtggttgtgtaggacgagcttgtgatgtcgcgcgggtatacgcctaagccgccgttagagtcgatatcaatccccgcttttaaaaggaatgccgaccacagcagttttgagcagtttttggcgccttcatggcccgtatttctgttattgacgaagttgaaggagtactcatcacccactcttgatacggcccagtcagcggcggcttgtttttgagcatcggtaactttcacggtctggacgattgaattgtcttcgacttctctgccgttataagcaatctgacggacgccgtctcccggcacggattcgacaattttatcagcggatgaatacatgccgacatgcccgtgattgtaataagccgtgtatgagttcgtgtaataaatattgccttttgtgcttttcgggagttttttggttcctgacgatccgcccatcgcagagagtccgtctttggaagcgattacatttccttgcaccttgtctgccgtgatttcttgatgaaactgcttgagaattgcttctgttgaaacgtgcttctgtttggcaagctctttggcggattggagaacgtcttgaggagtcgtgccctgctgaaggtctgcgatttcttttgcgtagcgtggtatttctgtttctttcgcttttacattcaaaccggagaacgacagaaccatggtgaatgacagggcaaacgggaggacggctttgaacagctttttacacattgacttcgcctcttttctcaaaggttaatttttccacgttttcattatatgacgaaattgtgataaaaaaatatacaatttacagatttttaaaaattttataacaatatgtaaatcatatacataaatcattttcaaatatcaggaaatctggttatcatacaagaaagggggaggacatatgaaggacagaacgatcggttcgatgcgggtttccgcaatgggattagggtgcatgggcatgtcggaatactatggcagccagagtgaggaagagtcgatctccacactgcatcatgccgttcatctcggcgtgaatttgtttgatacggctgatcaatatggattgggtgcaaatgaagaacttgtcggcagagcgctcgccccattcagaaaggagctgtgcctcgcgacgaaattcggttatgtccgaagcgaaaagggtgagtttatcgaaatcaacggacggcccgattatgtgaaaaaagcgtgtgatgccagtctgaaacgccttgggacggattatatcgacctttattatctgcaccgggttgatccgcgggtgccgattgaagaaactgtcggcgccatgaagaagctgattgacgaaggaaaagtgaggtatatcggattgtcagaggcttccgcagaaacgatcaggcgcgccgtccgcattcacccgattgccgcgcttcaatcggaatattctttatggagcagggaagcagaggagcatgtgctgcccgcctgccgtgagctcggcatctcatttgtgccttacagtccgctcggcagaggttttctttccggaaagatgacgtcgacagatcagctggatgccgatgattacagaagaagaacgccgagattccagggagacaatttggcggtgaatatagggctcgtccaaaaatttaccgccattgcccgggaaatgaatatcaccgcgcctcagcttgcgctcgcatgggttctcgcaaacggcgatgacctcattccgattccgggtacaaaaaagaaacactacttggaagagaacctcgccgctctcgacattgtgcttccggaggatgtgaaggcgcggttggatgaaatgtttccgatcggcacggcggccggcgagcgttacccggaacaaatgatgacattgttagatgaataacaaaagaggcccatcgtgcgggcctcttttcatgacagctttttgctcataatgacatccgtctccaggaatcccgtcttctcatacagcttccgcgccgtttcgttatgagcgaacacatggagagaaatcttgcggacacccagatctttggctttgtcctccagccttgcgagcgcctcttttgcatagcctttgccgcggaaaggcggatgaaggccgaaatcataaataaatgcgtcctgctgcgggtggtccggatcggcgtgcagccacaaccagccggcattttcctttccgtccaatgtcagcgtccataaatagtgatcggctgtctccaagccgtctggaagcaggtcttcaaacgtcagctccgctaattccggcgcttcgtcaggcagccacgttcccgcttttaccttttcttcagcgtaatgcttggttgaatgagcgagataggactgaaactcttgtcctgtcatcggctgcagcgtgatagccattgaatcactccttacacgaaagcgatatcatgcagtattatccgaaggctccgttttccgccggttttatgatttgttcggcttgtgccgttgaaccagtttgtgcaaataatccaatcgaaatgagacttgccaaggctgctgagagtacaatgaatttacatgttttcattacgaatcccctccgttaatctcaaaatttggtcattggcatcaattgattcctgaaaatacttcgccgccggtttgtatttctcctgttttttaaaatgcgccgcggcctgatacgacaaatcggaaacgtcactccacagctctttccttcttaactcggcgaaagctgattcaagcgcttcttcattgcggtcaataaagacatgctgtaagatgcgcagcttttgggtgtatacgggctcgtttttttcttcagcggcattcagcgctttatgcagccaaaatcggccctcatccgtctttgcctgcttcaataacactctggccagcatgtacagactccgcaccgaatacgctgatcgcaaatgctccttttgatcaagagccgtttcaaactcgacccgcgcctcttccagtttttcctgtctttcatagcaaatgcctgcgttaaagtgggcgagcgcttcaatatgcggatcgcccgctttggcggcttgatgaaccgccgtctgcaggagctcttcggctttctgatagtggaacaagtccattctgttacagccgatcaccattaaacactgtgcttctctgaccgcgtacatttcattggctttgtagatctccaacgctttttccgcgtggttcatcgcaaagtagttttggcggatttcatagtaggcaatcgccacttgataattaaactcggctctttcaatctcattcggtatgtgccggagcctgctttcagcaatccggtaaaaattaatggcgttcataaaccgtttacggtaaaactcgtgcattccggaaaagaaataataatagtattgaatcatctggtctgttttttctttatcggcgttcagctggatcgtttttaaaatgccgtctgttttctcatactcttccattaaaagcttatagcgggaatcaattaaattaaaataaaggagcaccgtttgattttgtgtcatattttgcagatccgtaagcagttgttctcttaacgcctcagccgattcagtgttgtgctttttgatttcctcataccagtcactgatttttttcgcaactgtttcgtgggccatcacctcagccatctgtcaggacacctccctttcccattttgtgtaataaatatatcatatttacaggtccaaaaagagggtggcagcccgctagtttcctcgtggcaacaaaaaaaacctccgcaggtgcggaggcgcatattttataatagtttttttcctaacaaagattctaccagctcgaccgctgttttgccggttttgtttttgtgatcgaggatcgggttgacttcgacaaattcagctgaagtgatgatgtcggcatcatacagcatttccattgccaaatggctttcacggtagctgatgccgccgacgacaggcgtgcctacgccgggtgcgtcgctcggatcaaggccgtctagatcaaggctgaggtgaacgccgtcacagtctgacaggtagtcaatggtttcttcaatgacctttgtcatgccgaggcggtcaatctcatgcatcgtatagactttcatgcctgtttccttaatgtattcacgctcgccttcatcaagcgatctcgcgccgatgatgacgacgttctccggcttgattttcggggcatacccgcccagattcaccaacgtgtcgtgcccgacgccgaggctgacggccagcggcattccgtgaatattgcctgacggcgatgtttccagggtgtttaagtcgccgtgcgcgtcgtaccagatgacgccgagctgtttatagtgctttgccgttcctgtcagcgttccgatcgcgatgctgtgatcgccgcccaagacgagagggaaccgctcattctcaatgacgctgtccaccttttgggcgagctgctcgttccccgagagcacagagttcaaatttttcagctcttcatcatgtttgagtttttcacgattgacggggatgtcgcctaagtcttccaccgcataccccatgtcagataaccgttcaatgagatgcgcgtagcggatggcgctcgggcccatgtccactccgcgtcgtgcttgtcctaaatccatcggcattccaataactgagatattcttgttcatccgtttttccacctcaacatgttgtatgttgtcctgtgcgggtttctcaaagatgacttggacacgaaaagatttaaagctctatctgtttttctgactgcttatgcttttttacatacagatgatagacgataacgcacaccgccatgaacgggatgccgcaataaagggcgagccgctgttctgaatcaaatgcgagactgatcagaacgaccgtatttaacgtcagcccgataataggcagcaccgggtacagcggtgttttaaacttcaggtcttccactttgccgccttcgcggatgtatttccgtctgaacatcagctgtgacagggaaatcgtaatccagccgacctgcgcgcttagtccggctaatgataagagaaacatataaacggtttccggcgctgccactttagacagcagggacaggcaggcgacggccagcgtcacgatcagagcgttcatcggcacgccgcgtttagttgttttgccgagcgatttaaaggcttgtccttcgttcgccatggcatataagatacgcgtcgatgcaaacaggcctgagttggccactgagagcagcgcaattaagataacaaagttcataatatcggccgcatatggaataccgatttgttcaaacaccacgacaaacgggctttcgaccactcccgccttcttccacggaatcatgccggcaatgacgatgatggagagaacgaaaaagacaagcgttctccataccgtctgccggatagagcgcggaatcgttttctcgggattttcactttctcccgcggcaaccccgatcagctccgttccctggaacgcgaagtttacggtaatcatcgtaataagcatagccttaatgccgttcggaaacaatccatcctcataaaaatgagagaagaaaggagcctgctcgccgtgtttcatgtcgatcaggccgaacatggcggcaccgcccaaaataataaacagcagaatgactaaaattttaatgccggaaaaccaaaattccgactcagcgaacgcttttgtggtaatcgcgttcaaaagaaacatcagtccgacaaacacgaggcaccacacccatacgggaacatgcggaaaccagcggagcatcaattgtcccgcagataaaaactcaatggcgcatgtcaccgcccagccgagccagtacagccagccgaatgcgaaaccgaaagcggggctgatgaatttggttgcgtacgtctgaaacgaccctgatacgggaagggcaaccgcaagctcgcctaagcagagcattgtcaaaaacataataaaaccgccgaccagataagacagaaccgcgcccagcggtcccgcctggttaattgtaaatccggtactcaggaaaaacccggtgccgatcactccgcctaatgaaatcataaacaaatggcgcgatttcattgtgcgctgaagctgattctctttttgatttgtattcactattctgcaccccttcagcaacttgtattggaaccaagccggtgctttgaaaccgatttgctgtccaaagagcctctatttgtatatgaatgttatatgaaattcattttcgtacataaagatacattatactaaaatactgtctccgcgcaaatagagtgtgctgaattttttatttgtaaattccatacaagccgagggaaagcattgccgcatcaaggtattacgcgttttgaagcacgtttgtgatcttttggatcgcccagtccaagtcttccttggaaatcattaacggcggtgcaaaacggatcacggtatcatgtgtttctttgcataaaagcccttcgcctttcagcttttcacagtacgggcgggccgcttctgtcagttcaacaccgataaacaggccgcgtccgcgcacgtcttttatgatcgggttatcaattttctcaagctcttctttaaaataccggccaagctgaagggaacgctctgccagcccttcttcctcaaggacttcaagagatgcgagcgataccgcgcaagcgagcgggtttccgccgaatgtcgagccgtgggaacccgggttaaacacgccgagaatgtcacggttcgccgcgatgcacgaaatcgggaagacgcccccgccgagcgctttgcctaagatgaacatatccggtacgatattttcccaatcaaccgcgaatgttttccctgtgcggccgagtcccgtctgaatttcatcagcgatcagaagcacattttcttccttacaaatagcggccgcttcttgtaaaaatccttccggcggaatgacgatgcccgcttctccctgaatcggttcgaataagaaagcggctgtgttcggcgtgatcgcccggcgcagcgcttctgcgtccccgtatggaattaattttatacccggaagcataggtccgaaaccgcgtttatactcatcttctgaagaaagggataccgcaagcatcgttctgccgtggaagttgccgatacacgcaatgatttccgcctgattatccgctactcctttgacctcatatgcccagcgtctcgccgctttgacagcggattcaacggcttccgcccccgtattcatcggcagaatcatatcttttccggtcagcttggctgttttctcataaaacgggccgagctgatcattatggaacgcgcgtgacgtcagagtgattttatccgcctgatccttcagcgcctgaatgatcttcggatgtctgtgcccctggttcaccgcggaataagcactcagcatatccatatattgattgccttcagggtcttttacccaaacaccctgcgcttcggaaataacaatcggcagaggatgatagttgttcgcgccgtaatgtgaagtttgactgataatttcttgagattttgtgaaagctgacataatctgattcccccttgttttgtaatcattcaacattagatcttgctttccctttttataaagcaagttccgtgccaatccgaaaaaacgggatgtttcgccagcattctttcttttcctgcaaaatattccggcagtttgcgtgcaaacttcagccaagcgcaaaatttttttgcgtttcctgttcgatttattttaaaataatgaatgttaagacgattgagagggggaattgacctgcacacaaccagcgaattttacacactcgtgttacaaagcattctggaagagattgatgtcgggctgcatgtggtggatgagaagggcagcaccgtcatttacaataagaaaatgatgcagattgaagatatggatgaacgggacgtcctgcataaaaacctgactgatgtatttatgttttccaatcagcaggacagcacgctcgttcaggcccttcaagaaggcaaaacgattaaaaatgtaaagcagagctatttcaataacaaaggccaggaaatcacgacgatcaaccacaccttcccgattgtgcaaaacggcgagatcaagggcgccgtggaaatcgccaaggacgtcaccaagctcgaacggctgatcagggagaacatgcacagaaaagaacagaacagctacacgtttgacagcattctcggcaacagcccggtcattcaggaagtcatcgaaaacgcgaaacgggcaacccgtacatcatcgtccgtgcttttggccggcgagacgggaacaggcaaggagctgttcgcccaaagcattcacaacggcagccagcgctcaggcgccccgttcatctcacaaaactgcgccgccctgccggacagtctggtcgaaagtattttattcggcacgaaaaaaggcgcctttaccggagccatcgaccagcccggcttatttgagcaggcgcagggaggcaccctgctcctcgatgagatcaactctctcaatctcagcctgcaggcaaaactgctccgcgcccttcaggaaaagaaaatcaggcgcatcggatcagctcaggacaaaccgattgacgtccgtatcatcgccacgatgaatgaagacccgatcaccgccatttcagaagagcggctgcgcaaagatttatactaccgcttaagcgttgtcacgctgatcattcccccgctccgggagcgcaaggaagacattctgcctctggccgaagtgtttattcagaaaaacaaccacctgtttcaaatgcatgtcgattcgatcagtgacgatgtgcagcaatttttcctggagtatgactggccgggcaacatccgcgagcttgaacatatgattgaaggcgccatgaactttatgacggatgaaacgacgattacggcggcccacctgccttaccaataccggatgaaaatcaaacccgctgacacggaaagcaaagcagccgcaagcacccagcccggcacagatttaaaagacaaaatggaaaacttcgaaaaatacatgatcgaaaaaaccctgagaaaacaaggcaataacatatccaaaacggcaaacgagctcggaatcagcaggcagagcctgcaataccgcctgaaaaaattcggtctggaccggatgaaatgaatccatacaaaaaaaggctgaggtgctcctcagcctttcgtttatatctgattggcaagccgctctccggtaaaccaaaagttctcactcactgccaatgtatgttccgtattctcgacttgatgccaccaatggcgcggcgcgtaaatgatttctcccgccttttgcctgaagcggatcggagacgccttttgcgccagcggtttttgctctatatctttttcatcaaagacattgatatttccttcgtacaaatacggagagtcgtccggatgatagaaaatccattccttctccccgaaaatgacgccgttccacgcgtgcgtgctgttaaaatcctgatgcagcggcgtgcctgtctgcttagaaccgagaaagaaccatttccagtcccgtcccgtttcttcatccgctctcaatgtgtcttttgtaaaatactcgggtgcggaatagacaaggtctaagtcattttggttcagctgcgtaaaattccagtcacagtaccatttgtcatcattctgatcaatgtactcgatatagttggaaagctttacttgtttaaacgttttgaccccttcgatatctgatttccggatggtgaccattctgtctccatagtgttcgtcaatgtattcaagcgtccacggcctgcattcccagtgatccattgcccccgtcaaaataaaaggtttcttatcagcatactcgcttacaaaaagatcgtacgataactcattgattgtcagtctgtcaatggtcatatccattccccttttattcggcaatctgccgttttttttgtttggcgtaactgtatggacctgaaaagatggtgacgttttgattctcaagccagaaaatcttgttgaacttctccagcaggtttctgtcgtgagaaacgcagatgatggtgccttgaaactgcatcaggctgttttcgagaatttcctgagattcaatatccaagtggttggtcggctcatccaggatcaggacattcagctttttttccattaagatggacagcttcagcctgattctctcaccgcccgacaggacggaaagttttttaaagaccgacgacccgtaaaatccgtacttggccagcatattccgggccatgccctcttcagtcagcagattttctttaaagaattgcagaatcgtctgactcgaatctccgacgtggctcttttgatcaatgtagcctatcttaagattttcccctactttaatggtgccgtccgacagttctctttccccgatgatgcagcggatcagcgttgttttgccgacgccgtttctgccgacgatgccgattctgtctttatgctttatacgcagattcacattttgatataaaagggaagatccgttggccacctttccgttttcaatgaacacaatatcttttgaaccggcgcccgcttcctgaaatgcgttttttaatttttgctccgtccggaccggcttattgatcagctcgatccttttcagcgccttttccatattattcgcgcgtctgtgcagcccgacagacggcggattcgagcggttggcccaatctctcagctgggcgatggattccttcatcttctgtatttttctctgctgttcttcatatttctcaaactgggcgatgatgaattcttcccgctttttcaggtattcgctgaaaccgtaaggccaaatcttcacctcggtatcgtcaatctcgagcactttcatcgccgtctggtcggcaaacgttttatcgtgggtcgtaaacagaatggttttattcgattttttaataaacccttcaagccactcaatcgcatgaacatccaaatggttggtcggctcgtccagcagtataatgtcgtcgttgcggattaaaatttcggcaaggccggcttttgttttttcgccgccgctcagctttgaaaacggctgatcctttaattcgctgaggctgagcccgttgcatacctcgtcaatcatcgcatgcatctggtagccgttgttccgctcaaatgtttccgtgtattgactgtacttttccaataaagcagtcagctcgtcctcacccatcggttccgaaagcttcagctcaatggccttcatttccttctggatcgccgcgagagcttcaaacgatttttccagatattgatacaacgtcagatcctcatggggatcagcgatctgcttcagcaaaccgaccttcgcccctttgttgatcgcaatcgttccttcatccgcctcaagctcccctgaaagcaccctgaacagcgtgcttttgccggaaccgttcggcccggccacaagcactttttcgccttcattgatgaagaaagaaacttgtttgaaaatggtatctcccgctaaatttaccgtaagattatgaatattcagcaactcacatcatccctttgtcattctggttcaaagctcgactttattctggatggcgacgctcgctttcagtttgtaaaagctgagcatcataaacagcgacaataagatggataataccccgattgcggtcagcagcaaagctgaatcaaaatagtccgttaagaatccgataaacggaaaggcaatgaacatgaagagcgaggtcatcaaactgataatggacagcagcgtggctctcgttctggacggaatctcattattcaccacctgactggatacgggttctatcacatcatagagcgcgttgatgacaacaaaagctgcaatcgtcacgtacagactgcccgaaggtataaacagataggccgccccgatgatgcagaatgtcagcagaagcacgcgcctcggcgtgaatttttccgccggctttgaagaaaagatggagcacagtgcctgcaagatggacagccccgcaaaaataatggatatattgcgcacggacagcccttcctgacttaacagatcttgtccgtacatataaaaaaccgatgtaatcgcaaagaaaacggagagtgacagcaccaaatatttaaaggctttgttcagcctgaagaaatctttgacttcttttaagatgtccccgaccgtctgcgtttcgtgttcactgttttcaaatttgatctccgtcagctgtgtaatgaccgccatcgcaatcagctgagtcacaatcccggcgataaacacatacgaccatgatatttcctgcaagtagccgccgatgcccatggcgatcgcaagaccgagtatgacaagtccgttataatttccgatggatttgccgtaccacttttctttcccttgttctttcagtgaatcaaacaaaaaggcgtgatccgttcctgatataaacgtcagcccgataccgtatataatatgagcgatgaagagggcgatgaagttatggaagctcaggaacatcaccaaatagacaatgaccataaaatgaccgagcaagagcgatttttttctcccgattctgtccgagatgacgccgctcggcacttccgccagaaacatcgccaaattcaggaccgattgcaggatgcccactagaaacaatgaataattcatgcttgttaaatataaaatccaaattccccgttcgaaaaagaagtttccgaaaaaaccggagaagtaaagcaaatttcgattccgcaaatgaatacccctttccagctatctgcatttaacatcatgaacagaaaggagcccgtcagtctttacactaaaaccctctatacatggatcttgcagatacagacttttcccaaaacaaattgggcaataatgagttgtattctcgaataacccaaaaagttccttctttttttcagatcctatggcatcaatgatcgtttttttcttccccggatcgctgatgtcgcgaatgaaatatttgatatagctcagctcatgcatgtaagccggcaggaacaaatgaagctcaatatcaaacccgcttttatccatatggtaataatcattgaaatgactgacgcgggagacggatacgtccgctccggccctccgaaacaattcagtcagcctttcaatgatctctccgttgggataataatcggcataaacaattcggatcggctcttcttttgtcaaaaggggcggatctttctgcggtgtccgtccgctttcccatataccgatcagtgaatcagtcggtgtgatgatatgccccaaatcgccggccagcttttgtttatcaaaataatgctgaatgaaagttctcagcatgccgtcctttaccttgaaggtaaataacatcggcaaatgattttctttaaaatcagcatactgccgatacctcatgttggaatgatgaaactgggtgtggcaggtcacatcggtctgattcgcttcgtacagccagatgcttttttccagatcatcattcaaaataaattggatgatctgaacggtgcggtgatccgcgggcgtcattttatattgcggattccgctcaaattccagtcccttctcaaacgtacgcttgaatcggtacgggccattttccggcacatcgcccccggcggtcgccggaatcagaaagctgctctgcaaaacggcttctatttcatcagacggctcgtccaaggtgacttcaaagcgtttttcgcccgttacgttcaccccgagctgatcggatgagacgaggccttttacatacggaacggcctgttttatgttcaggaaactgccgagatggggactttggttttcttttgtcagatgatagatgatcgtttgaaccacaccctcggcgtcacctaaatagtccgggtgaatgtccacctgacaggtgcggcgatctttgcggatgattcggcagttatagccgtcctgcaggctttcatacataatgctgcaaatcatcttgcttgtgtaatcctgcgtatctaatgggttcaagcgtatcgggcttgtgtcgatttctattttcagagggtcgcccggttttctcgccgtacgatgcatcgtcttcataaagcgctttccttttgagaaagcttcgtttctgtaatatgaagtccgtcaaagtccaggccgatgcgggtattcagggatttcgggcttccgcctgcaaggtatgtgataatgtcatgagacataaacgaggatataataccgtttgtcgctcctaacgaacctttgatcggttcatcggggtaacagttcagaagtccggccggcatgtttttttcataggtgacgccggattgataggattcaggcgtgagcagaggcccccattggccgctgaagctgccgacacccccggtcataaacgcgatattccgctccttacaatactgataaacccattcagaaatgttatggggtttgtcagcggcatttatgacgatatcaatttcgtacggatctaacacacgcaggtcctgcggctgtgtcatttcctgatggtaaagtgctgcgtccgcatggggattgatacccgcgatataatctctgcattctgagatctttaatttgcctacagaagattgagtatagacgaattgtctgttcaggttatgtactgatacggcatcgaaatcaatgagaataaaatgctgcatgcccgccgccaaaaggttttgaagaatgatcgttccgacgccccccagacccacgatcgctgccctgctgccgtctaatctgttttggatcagattggggttttggttgtatttctcaaaatggtacagctgcttttcagtgatgcagccttcacggccgttttgccatggctctattaaagcatccaatttcattaacgcatcgaaaaactggtttcccgcttcctctcccagaagatcagaaagctcttgtttttcacagccggtgatcagccgttcaaccgcctctttgatctcactcgtatgcgcaagcttaatcgcctttcgatattgaatgataatatgccccgtgtaggtcagcacctgcacgctgtctttaaacttccagcgcttacagtccgttgacatcatgacataccccctgaaagataataactccccaaaaaggggagtcacggctttactagcagcgatgcaccaagcttgctgtttctgtatcaagatcaagttcttcaatcttcatcagtacacaccccctttgccaataactagatattatcatcaatattggaaaaggacaagttattttttgaaaatttagaatttatatataaattgtgatatttcttccgctatcccggtttatcccggcagccggatgatgaacacggagccttttccctgctcacttttcacttcaattgttccgttatggctgtcgataatggtttttgtaatggcaagacccagccccgcgccgccggattgacgggatcgggaggtttccgccctgtaaaaccggtcaaacacatgaggcacatgctccggagcgattcccgttccgttatccgcaatcataagcatgattcctccgtctttctgcagggagacggtgatgacacccgtgtcttcatccgtatgctgcaccgcattgtaaaagagattgagaatggcctgcttcattttgtctttgtcaaaaacagcttctatcttttgatcaacaaagaactcgagtttccggtttctcgcaagcagcttcagctcagcctccatttccaaaatgacgtctcccaatgccccttttttcatttcaaagctcggctcccggtcaatcttcgcgagaaacaaaagatcctctatcagcttattcgccctgacggattccgcgtacatgctttgaagcgctttttctttctgctccggcttttccgccgctccgcgcattaaaatttcgataaagccgtgaatggaggtaagcggcgttctcagctcatgtgatgcgtctgatacaaaccgccggatgcgctccttcgcttctttttccgcctgaaacgcggtttcaatccgttccagcatctgattgatggagatgcccaatgactcaatttcggcctgcttcctatcaatcggcagccgtttatcgagactgccggcatgaatgtcacccatcatatgcacaatgcgggacagcggcttgagtgtgagccggatcaccggcaaaaaaacaaacagtccgataaccaaagccgcaaaggaaagtatcgcgaaaatgctgatctggcggaaaagcgaatcattcagaggctgggtcagcgtgctcatctgtacaactcccgcctgccttccgtcaacggaaatcgcctgaaacacgacgatgatttcctcacccgccttattgtgagccacctgatagtgaagcgccattgtatctgtcagcgcatcccgatacacgtttttcgggaaagaaggagcggctcccgcgtgcgggtcttctgataaaactgacatcttgtatgattgattgataaaagcaaccgtcaccccgggataaatcacattcggatgagccggtgtttcggaacgggcaggggttttgattgacctccatacgctttgatccattgaattgatatcactctgaatgctgatcgcctgattttcatacatcgtccgtctcataaacatgtactgtgtaccgccgatgaaacataacagcaaggtcaaaatcgccagtgacctgaacaggagctggaaccgcagggttctgtacagccgtttcatgccaggtccaccctgtacccggcgccccgaaccgtgcgaatcaccttgtgttctttgtccttcagcttttcgcgcaaagaacgaatgtatgtctcgacgatattgtcttccccgagaaccgttccgtgatgaagccccatcgttaaagaatcaatgagtgcagactcgccgtctgcactcagcagcttgatgcctttcaacttattcatgatgcagtctctccttagatgtatcagcctgtgtttatttttttcgcttccccttctattattcgcttttatctgaaacaaaacggaagctaagctgaattggtgaaagtaaacgctgaaaacggagccatctgcaaataagctgccggcagtttcatctgccgctattcagcagcaccagtctgtttcaatcacaaagttctaaggtcatgtctgcctttttctacatatatccattttcaactgaacgtgttgtgacccgcgttcagttcttttttatagcttctgaaaaaaggcataaaaaaaagcgcccctgaaaaaggacgtttaatatgacatgtttcattttcttaaattctgcattctaaaataattcttccttcacattcaccctcgatttcattcaatacgatgatcacatcagccgttttcatgtgtttcacctccctgcttcacaatagtataatattaacaaataaatcaataaaaaacagcccggatgtccgggctgcttttttatttctgtaatcgatctgcttctgtcagtttgacttccgctgtttttttctttcccgaacggtagaacgtgatgttcacacggtcgccgatctttttgcgatacaggcgctcacggagatccacaacgtcattgaccttatgtccgtcgaacccggtaatcacgtcgagctttttcaaacccgcttttccggccggtgaaaacgcgtcgacacccataatgaccgccccggttttaacgcctttcggaagtttcagcgtctggctccaatggtagctcgcaatatccgttaaggatttcatctcaataccgaggaaaggccgtcggacttctccgtatttttctaaatcctgaataacgggaatgacaagctttgacgggatggacaggccgattccttcaacggcggattcagcgatcttcattgagttgatgccgaccaccttgcccgaaatatccatcaaagcgccgccgctgttgccgggattaatcgcggcgtcggtctgcagcacttccgcattccaatccggatgtccgtcgccgtttgagtcaacgggcaccgctctttccgtgcctgaaatgatcccctgtgtcactgatcccgcaaattcaagtccgagcggatttccgatcgcaatgaccggttctccgactttgacttgatcagaattgccgaactgggcggccgatttgattttatcagacttcaccttcagtaccgcgagatccatcagacggtcgctcccgatcagctcagcaggcacgcgcgaaccatccttcaggctgatctcaatctcagtcgcaccttcaatgacatggtgattggttacgatataagaagtgtttccgttctttttgtaaatgacgcccgacccgcttcccgcttcgccgccctctccccaaatatcagtcttttggatattgagaacgccgactaccgaatccgatacacggctgaccatattcgtgacagcgtcattgacatttacgttgactgttttcacctgttcgctgccgagacgccggctggtgcttttgctgctgtctccatggtctccgcctgtccagtacggcatcaggaaagccatgagcgcggccccgacgatgacgccgatcagacttgatagaaagtatcctctcttgctgcggcggggctgttcggaggcgtactgttcatcatcgcgattataatccaccctatctcaaatcctttcaagagtactcgatttgcttatagtgtgggtcagatcgcggattaataatcatgattcatttggaaaaattacacggcgcacagcggcgtcggaattttcggatcggtatcaaataactgaaacgtttccccggcgacaaatcctttcgcagccaatgtctgctgcacggacattctcgccagttccttcatattgttgtcttggctcagatgcgccaaatagatgcgcgatgtgccgtcgccgatgacatcagtcatggcgagcgccgcatcttcattcgagacgtggccgacatcgcttaaaatccgccgcttaatgctccaagggtatctgcccatttgcagcatgccgacgtcatggttgctttcaaacacaaacacattggccgaacggatgatgcctttcattctgtcgctcacatatccggtgtccgtcatcagcgcgagctttctgccttggtagtggaaaacataaaacatcggctcggccgcgtcatgagagacgccgaatgactcaacatcaagcccgccgaaagactttacgctttccatcgggaacaaaaacttttgtccggtatcaagcttgccgatctgattctccatcgctttccacgtcttttcattggcgtagacgggtagaccgtactttctcgcaattacgccgagccctttaatatggtcgctgtgctcgtgagtgacaaagatgccgtcgacgtcgtctatcttgcggccgattctctccatcagcccgtccatcgctttaccgctcaggccggcatccaccagaaaagaatgctcctctgtctccagataaaacgcgtttccggtactcccgctcgcaagcacgctaaattgcaagcccattgtgtctcactccattatttattttgattgttatcaatgactgtgctttccaatgcattcacagtgtacgtttgctgtgtctttttcttcgtcccttttgacttatcttcaattgtaattctccataccggcgccagcacctgcgtacttgtcagcgggtattgggcaatatagccgaacttgacgcttttaacggcgcaattcgcttttaagtaattttgagaatacaataattcgaccgcatcaagctcaggaatcaggctctcggtctggattcgcttgaatgactccagcatggtctgctcgtaggatacgacctggtttttatcgttcagatgcagaatcacctgtccgatcgcatccgtggacgagtcaaaatcctgataaataaactgtccgtcatatgtctggtaaaaaatgatctgtttttgatccttgtcgactttccacagtttatatttttcaccgccggttactttagaactgacgagcgattccgcatcctcctgcggtttttgcttcgataaaccgaccggatcggtaaatttcattttcagcgttgtgaccttatgatcatccgccggcatttccattaacggcttttgatccttcaaagcatcaatatcttcagcggtaaataccttttggcccgccgtcagccggtagcccgtcgcggaatcagaagacaggttgccgaatgtgatatggtccatctccatgtctttttccacgtttgaatttttaatcacttcgtattcactgctcgagcgtttttcaaaaaactgatagccgagaaaaatatcgaggatgaggaaggcaatgatgaagatcgtttttgtcttattccactccattatcgtcctcctccttccccagcagatctttcgtaatcgggacgatcttcccgttgatcttcatactccagacgggttccagttcaacgagatcattcgttgaagaagagaccatttgataggacaggaagatctggtcgattttgttcacgtcgtatttatcctgctgctccagcagagacacaacctcattgccgttcatcatttttacgtcttttgttttaatcggattcggcccgagaacatagttcggccgcttgtagctgagaacctcgtcattggcccattgcagggtcaaaacaggtccggatccgaaaggcttagacgtgctgttgatcacaggcatttggtctttaaacatgtagaaactcagctgctggttatcactcacattgaaaaattgataatgatccgtccagcttcccgtatcctctaaatatttatagcttttcttaatcagctcacccgtttggtaagaagcgctttgtgccaaattccgatgctggaattgaatctgccgctgtgtcgaattgatttccagacggctgattccgtcagtcagcacattccgattgtaattcgggtcctctctgaccgtgctcggatcattaaaaagcgtctgcttaaacaggttcgtcttaatggtttcagtgataaattctttttccttcatattaaaccgcgcattcggcatgagaaattctttgctttttccgaccgaatagaggtggtataacggcatactcgactttttgctgtacagctcattcatcagattgcggtaattcgccgattccacagtcacttccaaaatcagctgcttgctgtacgagaccatgtaaatcttcttattcgtcttattctcattaaacggaataacaatatggtcaaatgagctgtattccattgacggatttgaccatttaaacatcgattggaagaaatcaatcggaatggtgtcattgaattgcagatcgagctttgccgaattgccgtttctgccgtaaagccaatttttaaaaccgagcttgtcgtattgatcggaaatatccttcatcccttttacttcccattgcggcaaatccgcccacaggtcattaaagagcgtctcatcatccactttataatgagagccgtttgtatgaataaacatatcccggggttttaccgtttgcgacactttttggctcgttttatcaattttatgcttttcccggacagtcgatttggttgaggccgtgccttctgaaaaattgggctggaatgtccaaattccccatgttaaaacaagactaatgacgaccagcactgacagtatgactgtttttatattttcacgcctcatcccaatcatcctcttgctcttctttatatggaagagtaaatgtaatcttcgttcctttgccttctacactgtcggcccaaatgtctccgccgtgcgcctgaaccatctcttttgcaatcgcaaggccgagcccggtgccgccgagttttctcgtgcgcgctttatccactctgtagaaacggtcaaagactttttccacatcttttttcggaatgccgataccttcatcttttacgctgatataaagcagctcttctttctcgttcacatcgactgagaaagtgacatgcccgccttccggtgagtatttcagtgcgttagaaatgatattatcgagaacctgcgtcactttatcctgatcaatctccacgtacagatttctgtccggaagctcgcggataaattcaacatgctgttctttcgtcatttcaaaacgatcgataatcagtgacataaagcggatcatatgaatccactcccgattaaactgataatctttgctgtcgaatttagaaagctgaagcaggtcgttcaccaatctgatcatgcgctcagtctcattttgggtcaccattaagaaacgcggagcgatatctttgttttcccacgcgccctctgcaagcgcctctaaatagcttcgcatggtcgtcagcggtgtccgcagctcatgagacacgttggcaacgaactctctgcgttcccgatcgagtttttcctgttcggtgacatcataaagaaccgcgattaaaccgtcgatttttccgtgctctctctgaataacggaaaaattcacccgcagtacagtcgtttcatcgtcacgttcgatctccagcagcattgaatcctgctgttctactaaatcctcaaatgtaaagttctcttttatgcccaataaagacgtaatcggcatctctaaagccgtttcacgtgaaacattcagcagctcaagcgcagggctgtttaaaagaataatagccccgttgcgattcgtagcgatgacaccgtccgtcatatacgcgataacggaagaaagctttcttctctccccttccgtcatggcttgggcatcttcaagctctctcgtcagatggttgaatgtcgttgcgagctgaccgatttcatcatgcccgtatttccgcacctttctggagaaattcccttttgccagttccatcgcctgcttacgcatatccgatagcggatgggtgatggtgcgggcgagaaatataccgagaagagccgtcagaacaagggctaagcctgttcctgaagcaagaatcgagttgacggttttcatctggttaaaggtatcttccatactggccacgacataaatcgcgccgacaacttcctgattctctgtgacgacaggttttgctgaaatcagcactctgtttttgcttttaggatcataatatttttttgaataggcctgttttgttgagaaaatccgtttaaaaatcgggtcagtcgtctgtttccccgctatttcctcgccataaggcctcgaagaaccgacgacctcatagcttttatcaacaaatgtaatctcccgtatttcattgtttttcgtaaaatcattcaaaatccgtttgacgtcatctttaatgacggtgctgtcattatctcctttatattcctgctcaatataataggatagattgtcaatccgctgatttaacgataattcataggacttgagaagagaattctccacctgtttcacaaagtacacgccgataatctgcatggcgatgataatgagaagcacatagatcagcgtgatcttaaactgaatcgaccgaaaaaaaccaaccttattcatcgccggttagtcctgttcaggatttctcaagtaataaccgacaccccgtcttgtgacgatccagttcggatggctcggattatcctcgattttctcacggagacggcgcactgttacatccaccgttctcacgtcaccgaaatagtcatagccccacacagtctgcaacagatgctcacgggtcatgacctgtccgatatgtttggctaagtaatgaagcaattcaaactcacgatgagtcagctcgatcgtttcttctctttttgatacgacataagcgtcagggaaaatgacgagagaaccgatatgaatgtcattagaagctgattcttcctcagccggcgcaaccgtaagctggcggcgcaggttcgctttgacgcgggccagaagctcacgcgtgctgaaaggcttcgtgacatagtcatccgctccgatttcaagcccgatgaccttgtcaatctccgagtcttttgccgtcagcataataatcggcatatcatattttttccggacttcccggcacacttcaactccgtctttattcggaagcataatatctaaaagaattaaatcaggctgaagctcctccaccatttccacggcttcgtttccatcgtacgcacaatgcacgtcatagccttcttttcttaaattaaactctaatatatctgcaatcggtttttcatcatcgactacaaggattttcttatccatcatcttgattttcctcctgccagaatgacttcatttcatctattgatgtttcatgatgatcacaattcgtatcgtgaaaaacgttccccgtctattataacggtttcaggtcaaaagataaaaaaattaaagagaacagcgcaaaaacgtattgaactgccatccttttgtcatgttttttattttcttttaaaaaataatatttttttgaaaccttaagaaaaaaaacgccgtctagtgtttgacgtcttcttctgggccggctgaaaagccggctctcccttttttataacaaaagaaaaaacgcacctactattgcagatgcgtttgggtaagtggctcgggacggaatcgaaccgccgacacacggattttcagtccgttgctctaccaactgagctaccgagccagatgtttcttttctatactataaagtaaagtaaaatggcggtccggacgggactcgaacccgcgacctcctgcgtgacaggcaggcattctaaccaactgaactaccggaccttacagtaatttgtccggagaaccgtatcgtggcggccctccgaggacaaataaggagttagcaataacgctaaagtaaatcaatgacccgtacgggattcgaacccgtgttaccgccgtgaaagggcggtgtcttaaccgcttgaccaacgggccataaaaagtggtgagccatgaaggactcgaaccttcgaccctctgattaaaagtcagatgctctaccaactgagctaatggctcttgatgtgtcggattatgtatcatagagcattgagacaaaagctttcttgcagtactctattgaagctgttccgtaacaacgagatttataatatcatagaacattcgaaagtggcaactacttttttgaaaaaaaatctattatttttttcctacataaaaaaacaagcctccgtgaccggaggcttgtttgctgcaaattcttagttagcgcggtatacactgcggatgacgttcgtttgtgaacggtcaggaccgacagagaaaatagaaagcggaatacctgtcagctgagatacgcgttccagataatggcgcgcattttcaggaagatcgcttaatgtttttgcgcctgtgatatcttccgtccagccaggcatttcttcatataccggttcacactctgcgagagctttcagacttgccgggaattcttcaatcacttcacctttgtagcggtaagcgacacagattttcaatgtttcaatgccagtcagcacatcgattgagttcagagaaagatctgtgattccgctgacacggcgggcatggcggacaacaacgctgtcaaaccagccgacacggcgcggacggcctgttgttgtgccgtattcgcgtccgacttcacggatttgatccccgatttcatctttcagctcagtcgggaaaggaccgtcaccgacacgggttgtgtacgctttagatacaccgacgacgtgctggatttttgtcggacctacgcctgaaccgatcgtcacccctccggcgaccgggttggatgaagtgacaaacgggtatgtcccttggtcaatatcaagcataaccccttgagcgccttcaaataaaacgcggcggccttcatccagcgcgtcattcagaacgacggatgtatcgcatacatactttttaatctgctggccgtattcataatactcatccagaatatcttcaattttgaagccttccgtttcatacattttttccagcagacggtttttctcttcaaggttccgttcaagcttttctgcaaacacgtcacgatctagcaggtctgcgatccggatgccgatccgcgccgctttgtccatataagcaggtccgatgccttttttcgttgtgccgatcttgttggcccctttgcgttcttcctctacttcatccagtttcagatggtatggaagaatgacgtgggctctgttgctgattctcaagttatccgtgctcacattgcgttcatgaagatacgcaagctccgttacgagcgctttcggatcaacaaccattccgttcccgatgacacacgctttttctttataaaaaattcctgatgggattaaatgaagcttgtacgtgacgccatcaaacttgatggtatgtcctgcattgtttccgccttgataacgtgcgatcacttctgcattttctgataggaaatctgtaattttaccttttccttcatcgccccactgcgtacctactacgactactgaagacatatatccgtgcacctccgttaacctttcaaaacgatatctcattcaaacaaattaagtgtatcagtgccgaaacagaaagtcaatcgtaaatccgaacattaaaatcttattattctatatttgttcgccttaaacctgattaaaagcgttttctctttcatttgctatctattactcccgaaactttcatactttaacacgaaaaagaacccatatcccgggttcttcagacagtcatttatattccgcttgtattcatcaggacgatccgccagccgtcaggatcttcgatggtcacgcctttttcttcccagtacgggttttcgggttctttctcctcatatcccatctgctttaatttcgtgctgatgcgaatgacctcctgctgatcagggatgtaaaagacaagcaggctgtcgccgtgcggaacgggcgccggctgagacgagccggtttcttcggtgaattctaagtgatattgcgtatgcggcaggccgaacatgacgccgctgtagccctcatgtccggaaaaactgccgaccctcttcaatccgaggccttcttcataaaacctgatgatttctttgagctgtccggtcggccgggcaatccggatttgcgccgcttgaaattgcggaaattcaattgtcatcatcatccctcccttaatgccattatataaaagcgctttctttttatcgactgccgaacagacggcattctctcattctttcggatgaaaaaaagcctcaagacattgcttgaggctttacgcacctgccggaacaccgccgtcatcaaagcgcctttccagatttacgaacttattgtattctttcacaaaagccagtgagacggtgcccaccgggccgttacgctgtttggcgataatgatttcgatgatgtttttgttttcggattctttatcatagtaatcatcacgatacaggaaggcgacgatgtcggcatcctgctcaatacttcccgactcacggatatctgacatcatcggacgtttatcctgccgctgctcaacaccccgggagagctgagacagggcgatgaccgggacttcgagctcccgcgccagcgcttttagcgcccgtgaaatttccgatacctcttgctgacggttgtcgctcgaacggccgcttccctgaatgagctgcaggtagtcaattaaaatcatgcccaatccgttctcctgcttcagccggcggcattttgaacggatttcgctgacgcggatgccgggggtgtcatctataaagataccgctgtttgacaggcttcccatcgccatcgtcagcttgccccaatcttcttccgtcagattacccgttctgagattttgggcgttaatattcccttcggcgcagagcatacgcatgacaagctgctcggcacccatctcaagactgaatatcgccacgctctcatccgttttggtggccacgttttgcgcaatatttaaggcaaacgccgttttccccacagacggacgggctgcgacaatgatcaaatcattccgctgaaaacccgccgtcatccggtcaagctcgataaagccggtcggaatcccggtaatatcgcctttccggttgtgaagctgctcaatgttgtcatatgtttgaacaagcacgtctttaatattttggaaggcgcccgaattttttcgctgcgcgacctccataatcgttttttccgcatcgcttaataaatcttcaacttcatcctcgcgcgtatacccgtcttgagcgatcgaggtcgccgttctgattaaacggcggagaatggatttttcctcaacgattttcgcgtaatattctatattagccgctgtcggaacggaattcgcgatgtccgtcaggtaagagacgcctcccacctcttctaacaaatcggtattcgcaagctctgacgttaccgtgaccaaatcaaccggttcaccgcggtctccgagcacgagcatggcattgtaaattttttgatgtgacattctgtagaaatcatccggaatcaacacttcagaagccagtgtcaacgcagacggctgtaaaaaaacagcacctaacacggcctgctcagcttctatgttttgcggcggcagccgatcattcagaaggtctgtcatgctaagcaccgtcctttccttaaaaaatatccaaatttcattttaccatttctcatgaaaaagaatagaaaaatatcactttccctgtatttgtcaggagagggttatgtgttttaccgttccgaatgccgggaaacaaataaataaatcgaaaccgggaggtaagaaggatgaaaacatatgcagtaacacccagtgttgatgcggacggatggtttgtgaaggtggaaaatgtggcgccgacggctctttgtacatcaaaggacgcggcgattgaaaaagcggagcagatggcgaaagagaacagcccggctaagcttgtcatttatgatcagcataaaaacattgaagaggaacgttccttttaagaaaagccttcgcccgtgcgagggcttttcttattcgatgaaacggatgtgcagcaccgtctgcgccatgagatcggccgttttttgatacagctcccattcttcaaaggcggcgaatactttcatcatgtcctgcaatgtctgtttcagtatgataaattcgtcaattgtccgcagttctgcggcttttttctgataatcagccagcttcagctgtaataacatcaatggcgattgcataaaaaacctcccccattctgttataaagccccgcttttcaaacctccattcctttgtcatatcctcttacgatagatttctgattttagtacaataaagaaacggaaggagtgatcacatgaaaccgctgcaaatttccgccgaaacggcgcaaaagctcgcagaatcactgaatatgccgcttgagagaatcatgcacatgcctcagcacattctgcttgccaaattagctgaaatccaaaaagagaacgatcacaaataaaggctgctctctcatatatatgtgcgggaggcggaagcgatggctttccgcctcttttttccatgaagaaaatttcggtaaaaccgtctcacagctgaaaaaacttgttgacgaaggaaaagtgaactatttcttattatccggaaacaattcaggcaacacaaagcttgtctcatggattaaaaagaacggcacaaaaatctcagctgaccgatacagcaccggaaaaacaggctcagcccgatgaggaatgacaggcggcccgggcggacaaagtcagcagactctgtatgagatgaaaaaacagctcggaaagaggctggatagttaaacaccggcctctttattttgctcttgaagcacctgccatgcggcgccggtatcattcagaaaaatgattgataaatcctttctatttttgaaaccatcagttcctgacgcagatgccggccggcataggagcgcgcttcttttccaagccgttccctgagagactgatccgtaatcagctttacgagggcatcagcaagttcgcggctgttgccgggctgacagataagccctgtgtcctcgtgccggatcatctcagggattcctccgcagtcagttgcgacaatggcttgacctgagaacatcgcttcgatgatcgctatggggaaattatcattcaatgtcggcaggacaaatatagatgattcagccaaaagcgccggcacatcatgtcgttttccgaggaaaaacacgtttgagaggcccagtttccgtctcttctcttccagaaaccctctcatgtttccgtccccgatgatccatatatccactccggataaatggtgccggatgcgggcgagagcgtccagcagcacatcatgtccttttcgctcggtcagacgggaaacgcacgcaatcacgaccttttcagcacgttttggctcgggtgcaacccggatgtcaatgccggtatgaacagtcgtcagctgagcctccttcgctccgtactccagcaagggctcgtgaaaggagtcgctgattgtaatgattttatccgaagcccgaataccctgcctttctatttcactgaaatatgcctcttctattgaacccttttggattttatgaaacttcatccggcttttcgtgaaatgtccgtgcggcgtaaaaaaaagcggatgccgatacgtttgattaaggtatcccagcaaaaatgccgcaaataaatcctgcgcgtgaaacaggtcatattgttctaagtccttctccttcaaaaatctttgaaagacatgtaaatagctgagattcttcacaaacttttcgtttgcggccccgtatctgccaacaagaaacgctctgatctcgtcagcggcccgcgggatatcttcctgaaaaaaagttggcggcatttggagcggcgagatgacatccgcctggtgaccgatgcgctcaaaacccgtcttaattgacgtgatataactcgccagtcctccgacattcgggtaacggagaaaggttgcgtacagaatacgcaatggcttttttcgtttgggggagctttttccttccgcacagaacgaatacagcatctccggctcactttgatgttcgatcccgtaaaattgatccatgacgcgcaataaggttagaggcaccagaccgttcggcttgccgatctctcctttcaaatccgctccccctctcttaaacttataatcctaattcccgtccccattttgacactttgtcaacatgatacggcagcagttctcctccccgattgtcgaagattctccgcaattgggtatgaagccctttctcaagtgttctctgcaaataagccattttataaagcgtcataggaggggtctgaaaatgaatgccccgctttttcatttctttcgtatacacttttacgcaatacgtccgaatatcttctgcgtgccggctccagtcttttctgaagccgagcagaatttcgaccagcaccgtcatatcaaaccaaaccggcgcgtactttgcggattcccaatcgatgaattgaatatcccacggttcatgtccggacgcatcgtgggtgcagatattctgcatatgaagatcaccgtgtgtgatggctgagccgttttggaccaattcagggaaaaaacccggctcctcctgctccagcaagtttgtgatttgccgataatgaggcttcacgatatcctttgtgcgctcatctttaagagctctatccaataattccgctgtctttttgatctgctttttacgcccttttctcatggtttccgattcgtatagcggcagccacgaccgccatttaccgtcagaaacagccttgttttcaaaggtgcggctgtgcagttctgcgacagacggaataatatacttgaaatgcttcggatgaaatgtaagctgtcctctgatctggctgacaaactccataaatatccacgtttcatggtcactttcctctataagatagatgtccggcagcaaatcccctaaaacagaacgggctttcccgtatatattaatctcgaccttgtttttttcacgtgaagatttatacaccttcaatatcagcggaacaattccggattttttctttacaaacagtttataaatggcgcttctgtctgttgatttcaggcatgtgatgtcatccggattcaccgcggccctttcaccgaacgaatacgacagtttttcgtcaattctcagtttttgaaatgcgtcatacaaaagatccttttcatacatgccgatcttccttccgcttccgtttccagctgtttttgagatgagaccaagtgtttctgataaatggcatcgggtcattccaagcaaacagagcgtactctttttttcctttaaatcctttccaaaaatcccggaacgtcatttctcctctttttcgtttcttcaaaaacgttaagaagtaacgcacctcataaatccagttgattccgtctttttgttcgagctggggcttcacatgttgtccggtcaaatacagatagtacatgtaaacgaaatgaatgcctgccggttctgtcaggctatggctgagccaaaagcgcggattaatttcgataaacttataaacattgtcccgggggtcctttttaaattctgccatgcctactcccttcagctgaatcgcttcaaaaaacggcagggtcttctcgattaaatcaggaagccgtttgctgacgacgtgggccccgcgccaaaatcagcagggaattgatggttcttttgcagagagaataagcccattaatttcatttggtcatcataaaaagtggcgactttataaaaacactggttgtctccggggatgatctcctgcacgagcagttctccattttctctgtaggagctgaactccttgcgcaattgtgcggcatccttcattacaattgcttttttgtttactttttttctgtattcatggccggccaccggttttaaaatacacgggaagtcaatattggcgatggcctcttccagctcatcccggttgttcggaaaaaaggttttcgggcaggggatgttatgcttgaccgctaattcatatgctttgcttttatctaagaccgtttctaacagagagcggctcgggagcaaaaataaaaaaaaaccggctaatgtctcgcggaatttagatataaatcccgcataatcatcagaacctgcatacagaaccggctttgcttggaatcgcttcccgaaatcagtcaggaatgtcagcagttcttcctcttgtgttaaagggctgggacatatcccgcaatctgccaatcttgattttccgatacgataaggtccctccgtgtcaaatgcgtaaacatcgattcctcttcgggccaggctgcgaatgatcccaatcccgtttgcactgaaatctagtacaacggctgcatgttcatgtttcatgatctccctccgagctgttggtattttgataaatcgattcgatattttttatcatcgtctcactgctcaaatatttctccgcgtaggcctttgcgtttgaagcagctatcttccgcgcagatttgttagtgataaaaaacgctaaagcccgggcaagaacctttgcatttcccggctcgacaataagccccgttttgttatggcggatcagatccggaatacccccgcaatcggtcgcgatgatagccgagccgctgaacatcgcttcaataatcgaaataggcagactgtcattaacggtcggcagtacgaatatgtccgtcatattcaaaatagcgggaacatcatctctttttcctaaaaaggaaaccatagatagattcagttttcgagcctgttcctctaaggcgctcctcatctctccgtcgcccgcgatcagcacttcaacatgctcaagtacatcagacggaattcgtgaaagtgcgtcaagcaaatgattatgtccttttctcgggcctaatcttgcaatacacgagatgatgatcttatttttcggcagcgggatttttcttttcccgcctgtttttgcatcgtaatcgattcctgtgatcaccgttgtcatgtcttcctgttcggctccgagcttcatgagcgggctgcggaacgtatcgctgataataatcaggcgatctgcgtattcaatggctttcatctctagttttttataataaaactcttctatcgatccttttttaaagatgtgaaatttaagtctgttgaaagtaaacatgccatgcggtgtgaaaaataaaggtttcttatagatttgattgaatctgcctaatatattggctgtaaataaatcttgagcatgaaacacatcatatctttccaaatgaatcttttgaagcatttgctcgtatataaacatcagccgattatttttcaaaatatgattgttataatccccatatctgtccttaaagaaatcttttaacttcggaacaacagccgcccgcagttcttttacctgtgcggacggaaacagattaggggagatgacatccaccttatgacccctcttcttcaggccttcactaagcgttttaatatagtttgataaaccgcccgtgtgcgggtagtcccaaaacgtggcaatcaaaatggataacttcttttttttcctgtataaccgcggaatatgatgttcatgtttcaactgtgtctttactgccgcctttttttgagggcgcgttttgaccccgtagtagcggtcaagcgtctggaccatatacggatacgggacggaaaatgtcttgatcatttccagatcctccgcacgacttcaaaagcttcggcgtattccacacccgccgtcatccctctgacttttcctaaatgtttaacgccttcatatgaacggggatgagggtaatccctcatttctacgtcatagtggtgaagcgccgcgagtttagcatccattgtgtctgtgatgttaacgaagtaattaggtttgaagagtttatcagccgtattcctctcccactcgcttgaagatagcgtttcgaacgtaagcagttcgataggtttttgattcggaagcggtctggcggctgttaaaactgcttggaatgttctctggtggtccatattgatatcgccgtaatgatgtgtaaagattttatcaggctgatagacgcgaatgagctgctctaattctttgacaagcttatgaagagggatacattccagctctaaattcgtatgctccaaaaagatgactttctcaattccaagctcttgattcgcgcgttcgcctaattgtttaatatgatgagcttcttcttttcttcctaatgccgtaataatggaaatcactttatatccttcattgatcagccgttttatggtgcccgctgctcccaatagttcatcatcgggatgagcgccgataaccataatgtattctgccattttttccacactccaccaaacaaatgttacaaatatcatatgacgaccctaaaaaaaggaaacttacatgtgcggattttcagaaacttacatgtgcggctgccattccaggtaacgtgacggatttaatttttttatagtattcaaaaactcatccgccaagccgtatttgtccagtccttttaatagttttacgggaaaccgggtaatagcggaaaaagctcttttatggtcgatgactttaagatttccgtgttcattgatcagaatgtgcctgatttcggcatcccatctggtaaaaccgattctttttaattcatccagcatatttaaaatatcagcagtcattttgacggacagggatttttcttttctgatatggcgggcaagagaggtgccttggacgtattccatcacaatataacgatctccgtattcatacagtcttggaatcaccggggaaccttgtccggtctttaaagccgccaattccttcttgcatgtccctttttcaaagaagtattttatgcatttgttgtgtgttaagcggtagacttccccgtcttttccgtctccgatcagcggataatgctccagcgcctttttattctccggattattaaaatatgtttcagaaaaaaatcgtttcataccgacacatccttcgttatgatgtaatataatatgcaatctggtaacgatcggaaatgaaacaatctcatcattttcttgcgctgcgccgtctgctgacatgaaaaaaacccgccggatcggcgggtttttcattgtgtattacgcttcttcttttacgtgaaccttcagcacagcctgaacttcagggtgcagctttacaggaacgtttgtatatcccagtgtgcggataccgtcttggagctccagtttccgtttatccactttaatcttatgcgttttttgcagcgcttctgcaatctgcttgcttgtgacagacccgaaaaggcggccgccttcaccggatttggcactcagctcaacagtcagctgttcaagcgtttctttcaaatctttcgctctttcaagctcggcaatcgcttcttttttctctttttctttctgtcctttcaatgcgctgatgtttgtcgcatttgcttcgacagcgaggccttttttaatgagaaagttatgtgcataaccgtctgctacgtttttcatttcgcctttttttcctttaccttttacatcttgtaagaaaataaccttcatctctgaacgcctccctcaaaatattcatcaatggcttccttcagccggacgagcgcttctgagacagaaatgcccgataactgggttgccgcattggttaaatgccctccgccatccagcgcctccataataatctgcacattgacctcgcccagcgatctcgcactgatgcacaccgtatgctcatcccgtctggctaccgcaaatgaagcttccacttcactcatcgataagagggaatcagccgcctgcgcaatcagcacctggtcaaagtactcctcttcgttctcaggaagagaagcaatcgcgatatgttctttataaagagctgtatgctggatcagtttcgcccgcttgatataagaaccgacggattctttgagaactttctgcaccagaaccgtatctgcgcctttcgctctcaaataagaagcggcgtcgaacgtccgcgagcccgtgcgaagggaaaaactcttcgtatccactattataccagctaacagggccgtcgcttcaatcatattgattttgagccgcttcggctggtattcaagcagctccgtcacgagttctgcggtggatgaagcgtatggctccatataaacgagcagcgggtctttaataaattcctcgcctctgcggtggtggtcaatcacaacgatgtgctcgattttgttcatgagacgctcttccatcacaagggacggtttatgtgtatcaacgacgacaagcagcgtgtcgtcatttgaaatctccatcgcctcttccggtgtgatgaaccgcgaccacagctcttcatattttttaatttcttcaatcaggcgctgaacgcttgatccgatctggttcggatcaatgacgatgtagccttctttgccgttggcctgcgccaccttcaatattccgattgcggctccgactgcgtccatatcaggaaatttgtgccccatgataatgacattgctgctttctgagacaatctccttgagcgcgtgagaaatcacccgggcgcgcacccttgtgcgtttctccatcggatttgttttgccgccgtaaaatttcaccttgccgttcggcattttgatggccacttggtcgcctccgcggccgagagccaaatcgaggctggactgcgccagatctccaagctccttcaaggaagaaaccgatgcgccgatcccgatgctgagggtcaaagatacagtgtgaacggatgttttttcacggatttcatccaaaatcgaaaatttcgcgttttcaagctccgttaaaatgtgttcatttaacaccgcgataaaccgctccgaggacgtccgtttcaggaaaatgccgtactcctgcgcccacgcatttaataatgaggtgacctggctgttcatcgtgcttctcgtttggtcatccagcccctgtgtgacgtcatcatagttatctaaaaagatatatgccagcacggttctctcattttcatactgcttttcaatctgaatctgttctgtcacatcaaagaaatagagcagccgctcatctcttttaatcactactttaaacttccgctcattcaaggtgatcgtttccgaatcgacctcctgcttgatcagcggcacgacggcctcgcatgtgtcatacagcgagcgcccgacgagcgtactttcattaaaacaggaagacaaaaacggattcgcccactcaatgtaatattgatcattaaacagcataatcccgataggcatttccattaatgcctcttcgcctacttttttcaatctatacgataacgtggagatataatcgtcaatttcttttctgatcagagaatccgcacgcttaatgaaaaacaggatcacggcgagcagcacaacgccgatggctcctatcagccagttaaagtaaatgctgatgaggattatgatgattgacaatgcaatcaatgcatagatgggataccgaaacaacggtttttcataaaaactaggcatttctatcaactccccacctgtaagtcacactcaatttcgcgtcaccttatttcttatgttaaagcctatgtcaatgatgcctaagaggagatacacggacaagatgagcggaaaaagcacacccagcacaattgctaaaacaggaacggctttcggcatctccatttcgcggcaatagaaaaaaataaacgctaacccttgaatacaaatcagcaagctgagaataaatcccccattcaatgaaaccgaatacagcatatgccctttttctaaaggcagaaaccctaatatcgtcacaataaaatacagaatgacaacgctttgcgggagtttgagctctctaaaaggcttcatcttcggaagatcaggggaaaatcgccgtaaaagcggccttgccatagcataactgaggaaagaaaaaacgatgccggtcaatacgagcactgtcggaaaaagatattgaaccgtgctcagctgactttccatcagcttgatctgcttcccgaactgatctccgtaaccgagctgctttgacatggtttctgctaaagacatcgactcccgaagctgggacatggtggtatcgatcacattcatattaagaaacacgatgctgaccacaaaaaaaacgacgccgcacagcacatacgccatagcgccggcagcaaccgcatagccgggctgtttctttttaaaataatatcccatggcgattcccgtacaggccgccgtaaaagcgcctgtaagcccggtaaacgaacctacaataaagctgacaggaaggctggcaagccccatccataccccgggcttcagaccgtgccgaatggtgtaaagaatgatcggcagcggcaaagcaaagagaagaattgcccccagtaaagggaggtacacgaccaaaagggaaatgattgcaaaaatactgatcaaaatggcgccttctattagagcccttgtatttttcacttactcacctcaaaccttgtatcattcgaacatacgaatagaaaagagcagcttagacgactgctcttttgacgccgcaatgtctctttcaagacctgaattttccataaactctccaaaatacacgtatatattttaacataagtcgaaatcgcaagtaaaatgagcgcggacagccgcaatgttccatgtgaaacatgaaaacagacaaacggacatccccgtgaaagaatgcccgttgtatcagtgatcctgatcatccataaaaccagaagtttctctgtttttctttttggtttttcgtacatataacaagacgataacgataagtaagagagtggtcgcctgtaaaaccccgctgctgaaaaggaagaagttctttatcatgtcccacatatagtttcacctctatttcgtatttcctttacattgagtttccctttctggaaacttcaaaacatcaggaacaacatcgggaccggggcatatgctgaaagtgaaaatgaaggataaaggagattcttacactatgaccgagcggagaacattagcatggcatgaaacgttagaactgcatgagttagtggctttccaggcaaacggacttgtgaaattaaaaagaacagagcgggacgtaagcgatgccagattaaaacagctttaccgattttccatccattcgctggaacaaaatctgcgtgaactgcttcctttcttccctgaagctcccgcttttcgtgaggatgaaacagaagagcgcgctgattccgcgttttacagcggcggtctgctgagcatggccaaaacgtctgtgcgcaattacgccggagccattacagagacggccacaccccaattgagacacgttttcgtcaagcacttaaacgcggccatcaagtggcatcaaatggtctttgagtatatggaagaacgcggtcaatatccggcttacaacctgagcgaattgctgaagaatgatgtgcgcaacgccagaaaagccatcgcgatgaaataaaaaaaagcagcaaggaatttaatcctttgctgcttcttatttttgagcggactgatcttgaggcgacgttttttcccggtatgtctcgagaaactcccggttggcatctccccatttcttcatttgcaaaacgatcggttccagcgacctgccgaattcggtaagagaatactccacctttggaggcacctgctgatatacctcgcgatgcacgatgccgtccgcctcaagctcgcgaagctgaagcgtcagcatacgctgcgtaatgctggggcaaatgcgccgaaactcattaaaccgcttttttccgccgatcatatgataaaacaaaatacccttccactttccgccgataacggaaagcgtcagttcaaccggacaaccttctttattcggatatatgttcatttttcatcctccatagtaccttttttgatactatatgctgattagcatctgacttacccagtattttactcgcaatcctcctcaccgctcaacaaaaatgcttctttttcacatcaatttttaaggttttgaagattacaccctccgcaagacgtgttaaactataaaaagattgtttacactacaaaaaaggacaaggagttattatggaaaaaattcttattttcggacatcaaaacccagacacagataccatttgctctgccattgcctacgctgatctaaaaaataaactcggcttcaatgctgagcccgtccgccttggacaagtcaacggcgaaacacaatacgcgcttgattatttcaagcaggaaagcccgcgtttggtggaaacagccgcaaacgaagtaaacggcgtcatccttgttgaccacaatgaacgccagcaaagcatcaaagatatcgaagacgttcaggttcttgaagtgatcgaccaccaccgtatcgccaacttcgaaacagcggaacctctttactaccgtgctgagccggtcggctgtacggctacgatcttaaacaaaatgtacaaagaaaataacgtgaaaatcgagaaagaaattgcgggcctcatgctgtcagcaatcatttccgactctctgttatttaaatctccgacttgcacggagcaagatatcgcagcggcaaaagagcttgctgaaattgccggcgtagatgcggaagagtacggcttaaacatgctgaaagcgggcgccgacttaagcaaaaaaactgtggaagaactgatttctcttgatgcgaaagagttcacgctcggcagcaaaaaagtcgaaatcgcccaagtcaacacagttgatattgaagatgtcaaaaagcggcagccggaattagaagcggctctttcaaaagtaattgccgagaagaaccttgacctgttccttctcgtgattacggatattctggaaaatgattcccttgcgcttgccatcggtgatcaagcgtcaaaagtggaaaaagcattcaacgtgacgttagaaaacaacacggcccttttaaaaggcgtcgtatccagaaagaaacaagtcgttcctgttttaacagacgcgattgcagaataaccaaaacaccccggcaaccagccggggtgttttttttacagctcgttcatcagacggccgtttcgtaagcgcttactctaaaattattttgacgcctattaatatacaatatataatatatcacatgtaaggcgttcatttttctaattattgtaagttgctgtcgcaacatcagaatcgggggtgtctatcctggaaaaacacgctgctctttcttattcacgaacaacaggcatttggcttgtgcttacaggagctatcttatggggggtctcgggaacggttgcccagtatctgttccagcaccgccattttaatacagaatggctgacttcggtgcgccttctggtgtcaggggcgcttctgctcggaatcgcgtaccgcaaagaaaaaggacggatatgggctgtttggaaagacagacgggacagaattccccttcttttattcgggattttcggaatgttaggtgttcaatacacctacttcgcggcaattgagcatggcaacgcggcaacagctaccgttcttcagtatttaggaccggcgatcattacatgctttttagcgattcgcgcaaagagaattccttcaggaaaagagctgctcgccgtcttattggcggttgccggcacattcattttggtcacgcacgggaatgtcggaagcctgtccatatccggtctggccgtcttttggggaatcagttcggcgtttgcactggcgttttacacccttcagccgcatcgtctgctgaagaaatggggatccgccattgttgtaggatggggcatgctgatcggcggagccgccctcagcttgatccgcccgccctggacatttgaaggcgagtggtcctttcctgcatatgccgcgattgtgtttatcatcattttcggaacgctcatcgctttttattgctacttggaaagcctgaaatatctgagtgcctctgaaaccagcctgctcgcctgtgcagagccgctgtcggcagcttttttaactgttatctggctgcatgttcccttcggaatatcagaatggctgggtactttgctgattttaaccaccatcgctttattatctatcaagaaaaaataacctctcttttttagagaggttttttcctagggccagagcacccttaggctcaattacccatatattaaaaggccttttttcattttactatcatccaaaagaggaaaatagaccagttgtcaatagaatcagagtctaatagaatgatgtcgacaagtaaatcatgcaggattgttactgataaagcaggcaagacctaaaatgtgttaagggcaaagtgtattctttggcgtcaccccatacatattttaggtctttttttctgtaacaaacctgtcatccatgaatgcaggaggatcgaatcggcagatcgcaaaaaaaggtacatacaaaaggagacatgaacatgaacatcaaaaaatttgcaaaacgagccacagttctaacttttacgactgcacttctggcagggggagcgactcaagccttcgcgaaagaaaatacccaaaaaccttacaaagaaacgtacggcgtctctcatatcacacgccatgatatgctgcagatccctaaacagcagcaaagtgaaaaataccaagtgcctcaattcgacccatcaacaattaaaaatatcgagtccgcgaaaggactggatgtgtgggacagctggccgctccaaaacgctgacggaacagtagctgaatacaacggctatcacgtcgtgtttgctcttgccggaagcccgaaagacgctgatgacacatccatctacatgttttatcaaaaagtcggcgacaactcgatcgacagctggaaaaacgcgggccgtgtctttaaagacagcgataagttcgacgccaacgatgaaatcctgaaagaacagacacaagaatggtccggttctgcaacctttacatctgacggaaaaatccgtttattctacactgacttttccggtaaacattacggcaaacaaagcctgacaacggcgcaggtaaatgtgtcaaaatctgatgacacgctcaagatcaacggagttgaagatcataaaacgatttttgacggcgacggaaaaacatatcaaaacgttcagcagtttatcgatgaagggaactatacatccggcgacaaccatacgctgagagaccctcactacgttgaagacaaaggacataaataccttgtattcgaagccaacacgggaacagaaaacggataccaaggcgaagaatctttatttaacaaagcgtactacggcggcagcacaaacttcttccgtaaagaaagtcagaagcttcagcaaagcgctaaaaaacgcgatgctgaattagcgaacggcgccctcggtatggtagagttaaacgatgattacacattgaaaaaagtcatgaagccgctgatcacttcaaacacggtaactgatgaaatcgagcgcgcgaatgttttcaaaatgaacggcaaatggtacctgttcactgattcacgcggttcaaaaatgacgatcgacggtattaactcaaacgatatttacatgcttggttatgtatcaaactctttaacaggtccttacaagccgctgaacaaaactggtcttgtcctgcaaatgggtcttgatcctaacgacgtaacgttcacttactctcacttcgcagtgccgcaagccaaaggcaacaatgtcgtgatcacaagctacatgacaaacagaggcttctttgaggataaaaaggcgacatttgcgccaagcttcttaatgaacatcaaaggcaagaaaacatccgttgttaaaaacagcatccttgaacaaggacagcttacggttaacaactaataacaacaaaaagaaaatgccgatacttcattggcattttcttttatttctcaataagatggtgaattcaatcatggcacgaaaatggcccgttgtaatattgatctttttgggtgcgttcctgtttgtcggcttactgccgaacaaaaaccacaattcctctgacacaaacaacacggagcataagaaggattaccgggcggcgtatcattttacgactccggacaaatggaaaaacgaccctcaaaagcctatttttttcgaggggaaatatcattactactatctttataatcgggattacccgaacggcaacggcacagaatggcggcacgccgtatcaaaggacttggtgcactggacggacgaaggcacggctattccgaaatacaccaacgaaaacggcgatatctggtccggttctgtcgtcattgataaacacaacaccgcgggcttcggcaaaaacgcgctggtcgccgtcacaacgcagccgacagccaaaacaaaagcccaggaacaatatttatggtacagcacggataaaggaaaaacgtttacttcctatagtgatcagcccgttatgaaaaacccgggaactaaggatttccgggacccgaaagtgatctgggatgaacaggatgacaaatgggtgatggccatggccgaaggagaaaaaatcggtttttatgaatcacccgatttaaaaaattggaaatacacgggcggttttatcactcagcagatcggcctcatcgaatgccccgacctttatatgatgcgtgcagatgacggcacagccaagtgggttctgggcgcaagcgcaaacggcaaacccgcaggcaaaccgaatacgtacgcgtattggaccggaaactttgacgggaaggaatttaccgccgatcaagaagaaccgcaatggcttgattacggctttgactggtacggcggcgtcacatttgaagacggtaatagcgaagatccgctgacaaaacgctatgcgctggcatggatgaacaattgggattatccgaatgaaacaccgacactaaaaaacggctttaacggcacggattctatcgtccgtgaaatccgtcttcagcagcaggacggcggcacatacagccttgtgtcagagccggttgaagcattgaaccaattaacttcttcaactgacagcatagaacacaaacaggtgaacggttcagagacactgccgatcaaaggtgatacatatcagcttgatatggatatcgcttggtcagatatcaaaaatgcaggcgtcagactcagagaatcagcagaccaaagccggcatattgatgtcggtatttcagcagaagacggttgtgcctatgtgaacagatcgtttacagaccagcctgataaaaccggtgcatacaccgaaagcaaagccccatttgacggaaacaaagggcgcgttcatctgaaaattctcgtggataaaacaagtattgaagtatttgcagacgacggaaaaaccgttttgacaaatgaagtgttcccaaaacacgaagatcagggaatcacgctcttttctgaaggcggctccgctgactttcagcatattgagatgaagcatctcggttcgattcattcttagacgtccctcttcatttctaaccggcgcccggactgtggtaaaatgcaaatatgtatactacgattcatgaggtgttccattggataatcaaaacaaagaacctgtgctgaaaagaaccatcatgcgggacgaagtgtatcgcacactcagaaactggatcataacgggcaagctcaaaccggaaacaaagttaaaggacaaggatttgtcggaaacattgggaatcagccgcaccccgatacgggaagccttattgcggctggaagatgacggcttggtgataacaaaagcgaacagatggacacttgtcgctccgattgagttaaaagaagcggaaaacttgtattccatcgtctggacgcttgagaaactcgcattgcagcaagccctcccgcgtatggacgatgccgtgattcaagaattgaaacagctgaatgaaaatcttcttcaaacgatgaaagacggcgataaaatggccgttctggaagcggataatgcatttcaccatcgcatcattctgcttgcggacaacgctgaacttcacaaattgctagtaagcctgaaagtcaaaattcagagactggaaatccgctatttcagtgaaaacggcgctttaaacagatcatataatgaacactctgatatcattcacgcattagaacagcaagatgccgccgctgcttttacagcgcttgaagcgaattggaaaaacagtttagaacggctgcaaaacatggcatagcaaacgaaaaagccaaatcactcatatgatttggcttttttacggatatcacaagacagccgcgttgcctgtcttgtttactttttgtttatatataaataaataccgtaatccgtcggcacagaagcataccccatctgtctgagcatggctgttatattcccgcgatgatacgttccgtggttcacaacatggaggatcatatcggccgctgcggttttcatgatgtcacctgacggatgctctatttcaagggggaggctgatattttcctccttctgcaaaaatagttgataccggtctgataatttcaaaaatagatcttccagctcttctatctctttagacaagatgtcctctttttgctgttcagctgatttcagcgtatcctccagacgctctccggagaacacatcaaaccaccccttatccgacagatacacatgagtcaatacaccggctatcgacggaaagacactttgaatctccttacggtacacatcctccggaagctctttaagccgggtgaatatttgctgatttgcccaaagatgataatcatacaattgcagtgccagatgtcccacattaccctctcctctctcgatatagaacgtacgttcctaattatactacactacatgccgctctgtaccattttcttcattcgcagctgagaaaatccgataaaagccgaaattaataagagaaggcctgcgccaatataaataaaccgcacgccgaatacatccgagataatccccgttccgataatggaaaacataaaaatgaactgaactaaagctgatctcgccgctaatatattgacccgtgtcttttcggtcgtgatattttgaagtaatgtttcctgcgtgagatctcgtaatacacaagccggccccatacacagcaccagaaaaagggccgtaacggcgcttgtgatcagcccgtaaataaacgtgaacattccatatgccaaggctcccgtcagcataagcggaatgagatgatgctgaagcttaccggataacttatagatgatcagtccgccgatcatcgtccctgcataatagactccgttgacatacccccaccaagcctctcctttatgaaggacgtcatgcacataagttaaggacacagacccgatccatatcatgcctgcccacgattcgatcacatccatcacaatgagaaccttgagctgtttttgctgaaataaatacacccagccgcttgccgcatctgcaaaaagggaacgttccctgactgctgccggcgcacacatgcgtacttgaagaaacagaatgatgcccaacaccgaagaaaccaataacatgacagtgacgatcattgtatcgctctctcccaggaacgctatgatgacgccgcccagagaccaccccgcaaactgaacggtctgatccgccgccgataataaactgttcgctttcgcccttcgatcaggaggaatgatttccccaatcagcgcgctttttatcggagcaaaccatccgttgcaaaaagaaatgcctccgatcagacaaaacagcagaaaaaagaatgcggatgaaccggtttggatgacaaaaaacaaacagactaacagtgtgatctgtatcaattgagaactgattaacaaagaacgaagcgtgaaccgaccggtgaccagcggcaaaacggcgctgcccaatacgcggcatacaatgctgacgagcgtcataagagaggccatcgccgtcgaaccggtttttgtaaacaaaaacaagatgacggccatcgtataaagtgaaaaccccaagttgatagcggtctggctgtataaaatagcgtaatacgctctcttcatattcatcctctgcaaccccactccctgattatgtaaatcataccatatttaccgatcagctttttttaaaaaaacagattgacatggagtccactccatctattaggctttattagcagatagaagactttcagcaaataacaattaagaaggggtgacagctgatttgacatccccaatctatagtgatgtatataagaaatgattttcaaaacagaataaaaaaagagggcttcctttccggaagccctcactcactccgtctgctacgccaataaaagaaaaataagcgctaaaacagccggaagtccttgttttacgataattgatttgtttgaagtaaagcctccgaaaatggccgcgatgaccacacagatgacgaaaaacatttgaatcatatggccaatcggatcagctccgaggatcagtccccaaatgaggccggcagccagaaatccattatacagaccttgatttgcaaacatgaccgccacattccgatcgccttctaaatgcttcggcaatttgaaagaccgcttggcagccttcgaattgataaaaaacatttcaagtatcatgataaatatatgttctaaagctacaattccgacgaaaacagccgcaattatgtccactgtccctctcctctcagcttcacttcaaccttatttccattgtgcgattgtttcgataggaagacggtaggaagcatatccttcgtctgccgcttttccgattgataacagcatgaccggtacataacgctctttatccattccgaaaacctcggcaatcttttctttatcatagccgccgatcgggtttgtatcatagccgtgcgcgcgtgccgtaagcatcagctgcatggaaacaagacctccgtcgatcagaatcgtttcacggttcacttgctccggcagtttttcaaaatgcgccgtcaacgcagcgatttgtctgtcttttacttcctgcggcatgtagcccagctcgaccgcttttgaataaatttcttctaaatagtcatcactgttcatatctgcgaaaaccgcgatcaccgcagatgatgtgctgacctgtgtttggttaaagctggcaagcggcgcgagtttttcttttccttcagggctgtcaatgacgaggaaacgccatggctgcgcgttaactgaagacggcgctgtcgttgcttcttccaatatttgagtcatttcttctttgctgatttttacagccggatcgtaattccgaatggaacggcggcctttcataatgtccataaaatcgtttgttttcagttctgttttcatgtgtaatacactcctatgctttcatattttctatattattctgcatctgcgacaatacgttttttaacatactgcgttcttcctcgctgacaccggcaagcatttcctttatgaaacgctccttctcctttttggaagcctcaattctctcccgcccctgatcagtaagccggacaagtataattcggttgtcctcaggcttccgccttcttgtgaccatttctttggcttcaagctgtttcaagtgtcttgtcacagctgcgccgtcaatattcacctttttctgaagatcgctttggctgatctcatcgacgtaaaaaagcacggcgagaagctcaaggcgggattggctgattccggtgcacgcttcaaacttcgtgccgatcactttgtgcagtgattggagctgatacaaaatctcgccttcctctgaacaacatgctgtcaaaacccatccctactttcttttgcgcaattaattgactagtcaatgtttgatatatcaataatatacatccgttattctttttttgcaagtgttttctcctttttaaaaaaagctgccggtgaacggcagctccttcttaatgattatggatttttctgaaattactgccttttacttcagcgacatcatataccgtcacaaaggcttgattatcaatgtcattaataatttccttcagtttggtttcttccaaacggttgatgacacatgtgatttctttgaatttttcatgagaaaaaccgccgtatgcttctttatacgtagcgctccggcccaattcttcacgaatggtctctaccattaatgcaggctcgttggtgataatctgaaatgttttagaaccgcttaagccttcctcaaccacatggatcaccttggatgcgatgtagtaagcaatgacggaaagcaatgcgccttgcagcccgaatacaaaagaaacaaaaataaacacaaaaatgtttaaaaataaaatgagatcgctcgtgccaaacggcaatttccgtgacagaagcacagccagcatatcaattccatctaaggcgccgccgttgcgcaatgccaatcccattcccaagccgagaataatcccgccgacaacggtgattaacagggtatctccctcaatgatagccggcgtgtggtggaaaaaactcgtgcccgcggcaagtgagacaataccgataattgatagaaacgcaaaacctttcccgatttgcttatatcctaaccagacaaacggtatattgatcaccgcaatcaagatcccaagaggcaaatgaaacagctgtgaaccgacaatgctgagcccggttacaccgccgtcagatacactattcggaatcagtacggtttccagtccatacgcggcaataattccgccgatgatgaccatgatgacccgtacgattgatttggctctgaatttcttacgtctttgtttttcgattgtactcatatcattccccgcttcaattattttgtcttatttaaatataccataattgatacttttcgttaaaaataagcctatcggctagttgaagcaggaaccgaggaaggagatttcacagataacgtatccatttatgactttaatcattcacaacgcaatcattcagtaaaaggaattatcatccattaatagtctcttttgtttcccttcttcacatattcccaatcatgctctatattttttctcacccgctgaagaaggctgaaaatggtttctttttcctcagacgtaaagccggacagtgctacttccgcagagtgctctccttctctttgcaataacggataaacctttctccctttttcggtcgggaacagtttttttatttttttattttgatcatcaggacgcttttcaacaaatccttgtatttccagttttttgatcgctctcgccgctgttgttcggtcaactttaatcatttccgccagtttttcctgtatcactcccgggttttcacatatacgcacaagatagagatactgcccttttgttaagtctaattctttaaattcaatattgctgatggaatccaatgcccgtgcgatcatgccgatttcacgcaaaatatcagtcatatcttttcaaacccttcatatttttgttgcacttgcaatataaatgtttcgtcgttacttctataagaccacaagcaagccgtgcagtccagactaatatgtgaaaagggttggttgatcatgaggatacaacagaaattgatttacaagcagcgcttgagattagaaaagcagtattcattgaggaacagcaagtacctgaatccgatgaatttgatcagttcgatacgcttggggaacagtgcgggcatgtcttggtttatcatgagaatcagcctgccggcacaggacggatccgcatcgtaaaccaaacaggcaagctcgaacgaatctgcatcctgaagccttaccgcaaatacgggttgggcaaagtaatcataagcgaatgagaaaacatggtaaaagaaaaaggcatcacccaatgtaaactgaatggacaaacacatccggaaggcttttatcacatcttaaatagtccgattaaaatctattaataattaacagttgaagagatggtgaaaaaagctgattctctctattatggactcctgccgcgttacattttttctatcttcacatatctttactattaagtacgtttaaattgatttcaggaggagatatgaagtggaagaaacgagtatggagccatcacgactctgcaaagaatttgcaagaattctcaattcaacgcccagtgtcgtaaatggcgtatgtacggcgacaagatttcgaagcaacattcacccggtggtactcggaagaagagccgaggcatttccttttattcctcaggccttttcatttgagagcatggactcggaaggcagagccttatgtttaggtgagactgttttactgcaagaagaagtgaacccattaatgagtgaactgcgcaaattcggtatcatcgtaactgccgttcataaccattggctgtttgataaaccgcgtctgatgtttatgcattttgaatcaattgacaaacctctcaattttgcaagaaaagtaagagaggccctaagagttctgactactaaaactgtgcgtgcggtaccaaaaactgacggggaaatgattgaacggcatggtctttgtgacgaattcaacgatattctgggcggaaccatgcatacgtttgaaaatggaatttgtacagtaatgagatcacgaacgaatataaaaccggttgtactgggacggcccggaagatcatttttgctcattccgcaaatgttttcatttgaatcaatgacaaaagacggccgtgctctttgcagcggagaaactgtaattctgcaaaaagaaatcaatccatttatcagcgctcttcggaaacatgatctgattgtaacgtctctacacaatcactggctgtttgacaaaccgagactgatgtatattcatttcgaagcgattgataaacctgtcaacttcgccttaaaagtaagaaatgctttaaaagtgcttactgataaagaggtcgaaggttagcatgtttctaagtatcaaaaagcgattcatataatcgcttttacatatgatcagccgaaaacaaaaaagaggtcagacatttgtgttaaaaacagccttataggctgtcgttttgtgtatattctattgatgagtttatactacttcatcccgcattccatacaagctctttatttctcaatggctttctacatgccgctgtgcaaacaccttcttagctactgaaagagcattaagtacacgcgggaagcctgtataaggaaccaattgggtgatactctctacaatctcagtcggtgttaatccggatgtaagccctgtattgatatgaagttcaagctgcggctcggttccttgcgttacaagggatgaaatggtaacaagcgcacgttgttgattggttaatcccggtcgtgaatatatatctccgtaagcaaattctataatgtacttacttacatctggagcgatatctttcaagtcttcagaaatctttaaatgcgtagaaattttatcatcgtttgttaaagtgtactccattaatttgtctaaaccttgctggtaacggctttgatccatttgaaattcctcctgaaaggtacttatttcctgacataagataatatatcgcagccctctctaaccgtaaaatacataaaaactataaaaaccattcatttttttcatgagtgatcttagtctacgtaattactcttacaaaaagatgaaatataccggataaattcgcgtactgcgtgtgaaacgtattttcctttttttaaaataatcgccactttccaaggaatggatggattgacaatggagattgccttaactaaactttgatcagtctttttcactatcgactgagggaaaatggaaatacctagttcttctccaatcatttcgctgataaaatcccattgagaactttcataaacaatatttggacgaaaaccggctctaatacactcctgaataatccgatcgtgaagagaaaagtcttcactaaacaggatgaaaggttcatttttcaagtcttgcatttccacaatctctttatgaacaagcgggtgagcggaatgaacgaagagcatcagttcttcattaagcaatggaatgatatcaaactgctctttgtccactggttcaataaccacgccaagatccagtactccatcttcaacctcctttttcaccttgtttcctccatgttctatcagcttgatgttcacatcaggatacaattgtttaaaccctctaatgattttaggaaaaaacaagacaccgatcagcggcggtattccaattttcacttttcctttttttaaatgcaaaagatcgtataagttcgtcgacaagtcatctaatgacttcataatcatttggccttgctcaaatacaatttcgcccgcatctgtcaaagcgatttgtctagcggatcgatcaatgagatcaacctttaattcctcttccaaacttttaaccatcttacttaaggcaggctgtgacaaatgcagattttctgatgccttagtaaaactgttggatttagcaacttcaagaaagtatgtgatttggcgtatatccatcgtatgatctccatttcatgagtttaacgaatacattatattctttttattcattttacttatacaactgccgggtgtaaacttttaggagaccaaaatgtttcctggaggggttactatgagtaaattattagaaagtaaagttgctcttgtgacaggcgcggctagcggaattggtttagaaattgcacgtgaattcgctaaagaaggcgcaaaagtggtaatttccgatttgaacgaaaaagccgtgcatcatgcagctgaggaacttaagggacaaggatatgaagtcctgcctgcggtttgtgatgtaacaaacgaagaacaagttgaaaaaagtttctctaagacacttgaaacctttgggcgaatggatattctggtaaacaatgcggggattcagcatgtgtctgatatagaaaacttcccgactgataaatttgaatttatgctgaaattaatgattactgctccttttagtgcgacaaaaagagcgttccctttgatgaaaaaacaaaaatttggccgcatcatcaatatggcttccataaatggtttaattggttttgcagggaaagcagcttattgcagcgctaaacacggtttgatcggtttaactaaagtatcagcattagaaggagcggaatacggaattactgtcaatgccttgtgtccgggatatatcgacactccattggtacaaaaccagttacaagatattgcagagactagaggcatttctatagaaaaggtgtttgaagaagtcatttaccccttggttcctcaaaaacgtttgttagccgtgcaagaaatcgctgattacgcagtattcctcgccagtgacaaagctaatggagttacagggcaggccgtcgtaatggatggcggctatacagcccaataatctaaatttcatctgcaggagtaatagtgctttgggttaaatgatttactcttcaagaaccaagccgatggttttttaggaaagacatagctatacagattgaagtttgatatatatttggtatattaacttaagaaaagccgccctgttggcggcttttttatcctgaatcctgtaatgtgaaaatgttaaaaagcaacggaatagttgttgtcttgcagaatgcgaagaagctgttggagctttcacaaagtatgtgggtgaagctgcagataagtgtgtaagattcccctctccccataatgcgcccgcactttttagaattaatactattctgcttcaatttatcttcaattgttggtattctggcaacgaaatcttcataacgctgaaattggtcaaacggtatacttaattttccggatacatatataatcaacttgaaagaacattagaaatagtcgaagaaaaatctgcagctgtaaaaataccatctaaatggacattgatggagtatgcgtcaacaatataacaattaaattaaattaattcggttcctctttccctaaggagcctaaaaatcagtcacatcatccatcttcagccttcaaacattatcaagccttgatgaggcaagaaacacggggtatcatagacacacaaaaaagatctcattatccaaagtcagattgagtatttttagttgtataagataaaggaggaaatagattgactttacatcattttattggggcggataaagaacttcctattggtgagtatggcagtaatcctacacttaagcccatttctgaactaaaaataaaaggagatgtcaacaaacgctctcaatttaaaaacaatcgaaagaacagtgaaaattcacttgtaaaggtttatgacacagaagaagatgcatacggaattgatattgttcatttagatcctggatatgaagcagtcagaaacaaattcacacatccttatatatatgaattacaagggtacttacatgccaacaatacacctggccaacgtaaatctattaaatcactttttcttttcattgaaaaacacttgtcaaaaggtgaatcaattgaaatatattcctgcttagatggatatgaagatgaagataaagatgaaagcatgggtgtagttatcaatttaaatactttacaatttggaaaacatataaagtttaaagatataaatcaccttagtcatatattctatttggaagataaacaatatgtattagtcaagaaataaacaagaaaaatcccaattgagtaatgttggtttaataagtaaggaaaccattctatacggtttccttacttatatatattattcactaaaatcattcaatttttttataaaaaattgaatgattttaatcccatctttcaaaatgcacttttaatcctggtatactcaatattctttgtatttctttatcatcttcagtatcgatataactttcttcttcatgagagcatgttaccaaccactcctttccatctttaaaaaaagacaagtcttctggtaaatgtggctgctcccaagaatataaagaatttgcggattctttcagaatgttttttgcgttttcatctgtataatagtaataaacttttgctttttgattgtctcctagaatggtactggcccattctgattgctctttcattacttttaacgaactttcaagtttttttaacagaggatcgaatgattttaaagatcccatatcttttcttaaaactaaatgaaattcgtcgcaaatctcgaaagccaaatcaattaactctgaatacagctgatcctttgggttgtgatcaataattaacatagttacctccttctcctattataatttcctatcttttaattactttaaagttaggtgtttataaattaatctaaattatcttgctgccccatagaaagcatgagctttcatacggacaccttttccatgtttatacctagagatcgagtgataatgataatgtttacctttaccctttttatctatctccggaccaacaatttttttaatcggacttgcggctttagcaatagatttggcattgttcttcgacgtagaccaagtgtcatcaccccttttaaggcgtgcaattgcagcaggtcttttcaaaccattaccgataaataatcctttagactttcttactgccatataatgagaataggttcttttacgcttcttaaactcagaataggcaacataagtcactcctgaaatagtcacagctaatccaattgaaattaaatgcgctaaaagtgcctctccaataactattcctataggtataaaccaaacaaaagaagctgttacctcatctgaattaatctcatactttttatttgtttccgtatcagtaaaagttgcttctatcttctcatttgtagcattttcaatatcaactttatattctttacctttttctccagtcttctgagaagtttcatcggttattaatgaaagtttcatattttctttatctaaagtcattaaacctttaactccgcctttttctgctgtgattactaatttctcttcatcatttgttacaatttggtaatacctattgtttatagcctcagcttttgattcattatgtaaaataaaagtaaaagttaatattagacttaaaaaaacagcaatactctttttaaaacatttcattgaaattagcccctttacttaaaagataaaaatccttttccataaatttcatctctccctttctttccaagatcgatggacaatttggacaatacacggttaacttgattataaatatcctcttttgaatcaattccgaatttatctctattttgtaaaattaatgatattactccggtaacatgtgcagctgctaaagatgtaccactttcagttttatatccattattgagggatagtatcggtatatctacaccaggtgcagaaaagtcaatctttcctttaggtgaaaagttagctagtttattatttctatctacagcattaatagagagaactttttcataagctgctggataatcaacatccccgccataattgttacctgcggctgcaacgattatgatcccactgtttactgctttatcaattgcacctcttaacaacggtttatctttggttaatccaaaactcaaatttattacctgaatattattatcaatacaccactctatacctttaacaagggtatctagcgaaccttttccttctgaatttagtactttaactgaatatatctcagtgtctggagcaattccaactaatccaaagctattatctttagctgctataatgcctgcaatagcagttccatgccccacatcatcatctgaggttaaagtcatgtttattggattaaattcccctttaattttcccttttaaatctttatgctctttatcaataccactgtctaatatagcaactttcactttctgtttctctcttaaagtccatattgaagcagcattgatttttttcactccccatggtacttcttgtacacggttatgattaattttttctgtttcatttctctctatatgcttaaaaatgaataaaaagcacgcaaaaaaacctaatgtaaaaattaatataaataataaaatatgaggttttttaattgctaacaccactttttgaagatttgtaaatattctcatccttggccaagaataacaaacctattatatcaatctgcaattaaaaatcaaagtttttcaggaaatatttcattaataaattacggttataaagtagtgtaattcttagttcttagtcatcataaaattgaccttcaaatgcatatttaaaacaaatctcaataaagaccggtatattaacttaaataattttgaagacttctgctagtgacggttttaaagataatctctctcttacagctctttgaatatcaagttctcctaagtattttttaaccagcaccccaaccgtagtcagcgaacaatccgcgtgtcattggtgtcatgtctctttctattaaagtaattatgataaatttatctgcttgccaattccttaatcatcaaacccaattcataaattcccttttgaaggtcttcaagagatgcataagcatatgataagcgaatataactccctttttcctcagcatagatcctgccgagattgagcagaatcccttttgataaggctttggtataaagtaatttcacggatatggaaggcaatatttttacccagacaaagaatcctccctttgggatattccatgtcgccacatctttcaaatgagtttctaaaacactcaaggccaattctcttctcacctttaattgacttctcacctgttctagatgctgctggtattcaccggatataaaccactctgccgctactctctgggataacgaactggagccgtaatctgtttgcatttttatgtcggataaacgttcaatcactggttccggcccgacaatccagccaatcctcaagcccggacttaatgttttcgataaactgcctatgtaaagcacatgcccatttttatctattgttttaataggatccgggggaatctcatctatccataactcacgataaatgtcatcttcaataatgggaagctgtgtattctcacttgccgcaaggatttcttctcgtctcttttttgacattaaaatacctgtcggattatgaaaacaaggatttgtatataagatagccctccccgttctccccttgccatgcggatatgttccggcaaaagtccatcatgatccataggaactccagtcagcttcataccggctgattgaaatacgtgtaatgaataaagataggaaggctgatcaagataaacggtcgatcccctttgtaaaagccccattgatataagctgtaaggcttgcagtgcgcccgaaacaataagaatggaagaaggagaagcttgaatgccgattgttcttaaatagccgcttaatgcctctctcaaaggcaaatatccttttggttcctcatatccgaatgcctctatgttttgggatacctttcccatgatctctttcataacagctaaaggaaaaatctcatgtgaaagttctcctttactgagctgtataagatcagaatttgattctgatttattgatctcttgaacgattttttggcttggctgctgaattccggaggttacatactgatcccaatcgggagcggaattcttagccaaaagtgtccatgtattgttcgtaacaactgtccctttgcccattctgccttcgattaatccatccgccgtcaattcctctaaagctgtaatgactgtgctcctgttcacctcaaagtgtttggcaagcgtgcgctggcttggaatcttacttccgatcggccattctccatttcctattttctcttttataaattgaatgatttgtatgtacttaggaagctttctcatctttttttcttctggagcgctcattaaaagggtcctccttaaagtggttgggtcaaaatctatttaactggttgaagtcatctcatcaaatctttattaatatagaaaaacattaaataactggttggtttttgtaaagaggagtgagaaagatgagaaagaaaacagttcgaatcggcatagcttacagtctgatgattgggttgtgggcatcagctttcccgggaattcgcgcgagtttggagagttacacgccggaacacctcgctttgtttcgcttgttgattgggtcaatggcattggtggtttttgctgttttgactcatatgcgtttgcctgacatgaaggatatccctgctattttatcgttaggatttttaggttttgcactatatcacattttgctgaatatcggagaaaaaaacgtcagcgcaggggtagcaagcttactcgtgaccatgacacctattttttctgcaatgttatcccgtctgttttttggtgaacatttcggtttttataaatgggtcggctctatcattagtttattgggtgtatcgatcatttcatttggggcaggaaactatacaaattcagtgaacggcattttgttaatcttgctggcagctttttcggagagtatttatttcgtttttcaagcccgctatataaaaaaatatggatttatcccattcgttacattcactatttggggcgggacattgccaatgctggtatttcttccggggttatggggagaagttgttcacgcatcgatgaattccacatggtctgtcgtttacttaggcttattaccaacggttgtgccttactttgcacttgcgtatgtcacttcactcgtcggtgcttcagaagcagccatttcactttatttaacaccagccgtagccttggctatttcttgggtgtggttaggtgaagtacctgcgtttattgcactgacaggcgggatggttacagtcgccggggtgtgtttcacctatctaacagtaaataaaaagataaagattttaaatccttatttcttatctaaaaagcaataaagcagatgacatttaaccctgaaaatagagtcataagcagttctcctttttaatacttgggtttcgaaggcttcttctccccaagggtgccagtttacggggttgtgggcgttacctttgttcaagaaaacttgttgcaagcaaattcccccactcccgtaaagaattttgaaaatttacatggcagattgaacatttattgacaaagttaaaatgtaaaaaggtacaaagtgtctattgattaaattattcttttcgtttttattgcgattattgtatgtcttttgtttcttgacaggtttttcattttcacaaataaaaaaacacgctggaaagatgctctaacgtgtcatgatttacttcaaatgagatattgttcaacccattttcttgcaatgttttaatgttgtttactaaatcgggtaattcagcaactgctgattctaatgatgccactccaattacatttattttccttggatttggtgcgtcgagatctaaagggacgtcttcattggcaggtattaatccgggttcataagcaaaagaaagactttgagcaattatcctcttcactccaatttcatgacacgcatcaacagtatttcgcgcacctataattctgattctcgctttttcttcaagattgtaacctgttaaagaggtaaactgatggacaacaacctcaggttaaattttcctaaaagcattaagaacagcatctcgatccattgcatctgcttttacaggagttacccctattcttttgaggaacgtgttcgaccggttacctcgggtcaatgcaaatacttgatggccgttttgtattaatttaggaagaagggaccgaccaattactgcagtccccccagcaacaatgatcttcatgctataccttatttacctgccaatcttgaagcagcttcttcaacttctttatttgctttttgtaaaacatcctccggactcagtaaagctgttccttgcactcggataatttgataatcctcaataccgaggaaattgaacattgatttcagatatttatttgagtattcaacttcttcataccagtcatcatttgtataaattgatccgctagcttgtatgacaagcattcttcgtccatctttaagcagacctactgacccagtgtcagtatatctaaatgtttcacgtgcgatcataatattgtccatatagtcttttaattttgatggaatattgaaattatgcaaaggcaaaacaatgacatacgtttttgcacttttgaattgtttcaatacttctgtcatgcgtcctgttactttttgttcatcgcttgtcagttcttcgcatttttctgccttatcccatgcacttaaaactgttttatcaatcataggcacatcatcactatataagttaatttgctcaagctcttcactctctggaattaattctttgtaagcctctaaaaagtggttcattacccgtagactgtatgatgacgtatcatctacttttggatgtgcgttaatgataagtgttttgctcatttgaaactctcctttcattttatattaaagactatattaatcgacgattaacttggtcactaatataaaccttgtattttattttgtcaaacggaacaaatagtatctgaagaagggttttaagattgactatcatcaaaaatactcctaagatacaatgtgataaaccttaaaatcaaaagcaggtgagtttatatgcagtacagtgttggggttgaatatgctttacattgtctggtttatttaatagatgttccctccaaggaaagtgtcgggattcgggaccttgcagagttccaaggactttcagaaacatttctttcaaaagttttcggtaaattatctaaagctggtattgtaaattctgtccctggtgtaaagggaggatataggttagcaaaatccccggaggatatttccttttgggatgtaatagaggctgttgaaggaccaaaacccattttccaatgtaaaaatattgtaagcaatggtctactttatcgagacaaatgcaactcttgtgaatccagcaattcttcttgtacaattaacttggtaatgcttgaagcagaagaacagatgcgtaattatcttcgtaataaaacgctcgcatggttaaataaagaattggacgtagtattgcctaaaaaaacaaggacagatactcgggaatacttcataaaaaaaagctctgactaaattaattagtcagagcttttttgtgcttcaagatgccttcggagaatttttacgaaagtatggacgagacaacaaaatgaataaaactacagattaagtttaaccctccgattcggagagtcaaaggttaatgttcgcctttttgttctactttatgaaagggtcagcaattgctgatattataataattaatcaactctttgtggaatggatgataacaaatgacattaggccaaagattaaaatgggctcgaaaaaaatccggttactctaatcaagacgtgccagcagagaaaattggattaacagggtagacattgtctaattacgaaagggattatagatcgcccgatccggagacattaaagaaactcgctgatttatatgatgtatccactgattttttggtcggtagagaagaaaaggacagacccaaatctaaattggatcaaacagtcaatgaagcaattgaacaacttaaaaacgaagagactttacttttcatgaaagatgatgacattcaaatattatatgactataaataaaaaagtgaggttttatagacttcactatcaaacagttcactactcaattattttttcattgtttgttgttgcgcttgcgttttcaacactatgtgcttcaccatgaccaggtccaaaaagatttaatattacaactcctacaagtatcaaaacaatcccagtaacactggcaatgttaattttttctttccaaatcaaaatcgaaattattgtagtagcaatagtccctacaccagaccaaactgcataggcggtattcaaaggtatggacttcattgcaagtgataagaagaaaaaggaacctataaaagcaataattgcaccaatagtagggtaaagtttcgtgaagccttctgcggccttgagcatagaggaaccaataagttcaccaaaaattgcgagcaataaatataaatatgccattgttaattctctcctcctgtataaataatcaacgtcttataaatttgtactaaacctctatcgtttgtttcattatttctttattagttaccactttacaagaaacagcaaatgtttataagtctttattttgcaaaaaaattgtgcgcaaaatgactggtgttccttagacgagtagataaaatctaatctagttaatctaataaggtataaactaaactccattatggtaaagtaaaaatagcaaccaatttaaaagtgaaagaaggtgatccaatgccaaataacagtacacccaatagattaatcgctgagaaatctccatatttacttcaacacgcccacaaccccgtaaactggcacccttggggagaagaagccttcgaaaaagcaaaacgcgaaaacaagccggttcttgtcagcatcggctattcgacttgtcattggtgccatgtaatggctcacgagtcctttgaggacgaagagatcgccggtatgttaaacgataaattcatagccatcaaggttgatcgtgaagagcggcctgatgtggattccgtgtatatgagaatctgccagctgatgacggggcagggcgggtggccgctgaacgtgttcgtcacaccagatcagaagccgttttatgcggggacgtattttccgaagacgagcaaatttaaccgtccgggctttattgatgtgcttgaacatctgtccgaaacgtttgcgaatgaccggcagcatgtcgaggatatcgccgaaaacgccgccgctcatcttgaagtcaagattcacccggctgagggcatgcttggcgaacaggcggttcatgacacgtatcgccagctggccggcgggtttgacacggtgtacggcgggttcggccaggctccgaaatttccgatgccgcatatgctcatgtttctgcttcgctactacagctatacgggcaaggaacaggctttggccggcgtaaccaagacactcgacggcatggcgaacggcggaatttttgatcacatcgggttcggattcgcccgctactcgactgataatgaatggctcgtgccgcattttgagaaaatgctgtatgacaacgcccttctcctgaccgcctatacggaagcctatcaagtcacgggtaatgagcgctacaaacagattgcgatgcagatcgtaacgtttattcagcgggaaatgatgcatgaagacggcagctttttctcagctttagatgctgataccgaaggccgtgaggggaaatattacatatggtccaaaaaagaaatcatgaatcttctcggtgatgaactcggcccgctttattgcaaggtgtataacatcacagatcaaggcaattttgaaggcgaaaacatcccgcacctcattttcacgcggcgtgaggccatcctcgaagagaccggcctcaccggacatgagctggccgaacgccttgaagaggcaagaacaaaattgctggaagcgcgtgaaaacagaagctatccgcatacagatgacaaagtgctgacctcatggaacgcgctcatgattgccgggctggcaaaagccgcaaaggtatttcacgagcctgactttctcagcatggcggaaacagcgatccgctttctcgaacgtcacctcatgccggacgggcgcgtcatggtccgataccgcgagggcgaagtgaaaaacaaagggtttatcgatgattacgcttttctcatctgggcttaccttgaattgtatgaagcgggttttcatccgtcttatctgcagaaagcgaaaacgttatgtacaagcatgctggagctgttctgggatgaacggcacggaggttttttctttacggggaatgatgccgagactcttcttgtcagggaaaaagaggtttatgacggagccgtgccttccggaaacagcgcggctgccgtacagttgcttcgtctcggccgcctgacgggtgatgtatcactgattgaaaaagccgaagcgatgttttccgtgttcaaacgggaaatagaggcctatccgagcagcagcgctttcttcatgcaaagcgtactggcacacacaatgccccaaaaagaaatcgttgtgttcggaaggaaagatgacccggacagaaaacgtttcattgaggcgcttcaggagcatttcactcccgcctatacgattctcgccgcagaacatccggatgagcttgccggcatttctgactttgccgcgggttatcaaatgatcgatgggaagacaacggtctacatttgtgagaatttcgcctgccggaggccgacgacggatattgatgaagcgatgaacaccttacaaatcagcagcagagcctaggcggcctgctgcttttcttttttcacaaaacggaatgcgagccatgcgaagatgatgttgatcaccagagtcgatatgcaatcgtatatttcatagccgccggctgctgttgtaaatatcgacggaatgccgccgtataccgaatgatcctctgtgagaaagataaataaaaacatattattggcagcgtgaccgccaagggacatctccagactgcccgttttaatcgtgataaaggtccagatcatgccgatggtaacatatccgattcccgcccagagagctccattttccatctccggatttccgaaatgaagtgcgccgaataatccgccgataatgaccgtcagaaccaccgcgtttgccgtcaattttccggcaaactgaagcagaaaaccgcgaaagagaaattcctccgcagaggtttgaatcggcaccaacaagacggccgccgctaacagcagcagaaaacgtgaagcatggaattcctgaagcgtgaaacgatccggatgaattaaaaaatcaatcagccccgcgacaaacatcagcacaacatatgtgccgaatccaaagaaaattctcttccagttcagcgactgattcggtgtaatgatggataaaaaccgccgcttcataatgaaacgaaccgctatccaaatgcccggaatcgctatgaaatagacgatatgctgtaaataaatatccgccagcgggtcacttaatgccgcctcatcccaatttatcgtcagtgaaggattgaaagcggacgtgagaaacatataaaacacggtcagtatgcttccgaaaaagaacaaacccacaatgagcaacagagaaagaagatatctcgatacactatttcttccctctgcgggccgtacaaatgtattcatatttatgcatcaacttcctttccttcaacattttacaatataaacagaaacagatataggaaatgttatatattttaagaagaaagcgctatgccgtttcctttggctctggttatttacactctgtttttgccaaaaaaagacctttataatgtattcgtcagataaatttacagtattttctgattacaattgctaagtcagggggttttttatgaaacatcagacattctcaaatgtagcgaaccgattagaccgtctccccatttcgcgtgtgcactatcaagtattaaccgctctcggaatcatctattttttcgatctcgctgatctgtttacgctcagcaacgtggctccggcgctgattgagcattggggcgtgaagctgtccgtcattgccgacgtcacagccgcatccttcctgggcatgtttttaggcgcctccatcggcggaagactgtccgatcggatcggcaggaaaaaagcgctgaattgttttgtccttgtcttttcgatctcatcttttctgaatgcgctggcatgggacattccgtccttaatgattttccgcttcttgaccgggctcggcgtcgcggccgccatgattgtgacgaacagctatttggcggaattttttccatcatccgtacgaggaaaatacatctccttttgcgccatgatcggactgatcggcgttcccgtcacaaacgttgtttccgcttttgtcattcctttaggctcatgggggtggcggctcgtattcgtatggggggcggccggtctcatttatttcttttttatccgccggcttgaggaatcgccgcgctggcacgaaaatcggggcgcatatgatcaggcaaacgccattatgaaccgtcttgaagcacgtatagagaaagaaaaaggcccgcttcccgcgccaaaagaggcggcagaagtacatacagtgaagcacgcaggctacttagggctgtttcagggcaggaatttaaagatcaccatcatcctgtcagcggtatggattcttgaaacctttggcttttacggctttgcttcatgggtgcccagcctgctgaaaagcaacggcatcaccatggaaaaaacgctgtggtacaatgtgcttcactctgtcggcgcaccgcttggcgcattgctcggttccatgatatccgagacgttccaaagaaaatggattctggccgcaagcgcttttctgactgccattgccggactgttatacggcatgacgtttattcccgtcatgattattgtgtttggatttgtcgtcaatgtcacggaacgggttttcacctcaaacttatacgcatatacatcggagccgtatcctacggaatatcgctcggccgggagcgggctggcatacgggctcggccgtttttccaatatattcggatccctgctcgtcggatttattgccgttaagctcggctacatcagcgtctttttgttcatcggcggctgctggcttctatgttccgttttgttaattctattcggtccgaaaactaatgctcagcaaatttaatcaataaaacagtgcgggttccccgcactgttacactgtgatttctatcaaattgccttccccatcctctatcacgctctcataatatccgtcacccgtcacgcgcgggccgcttacaacctgaaatccgtcatttttaaacgtctccgtcaattcattcacccgctccttgctgcctgtagaaaatgcgagatgcgcccatccggtcatattctgtgacggagcttcatcaatgccgccttttttcataagttccagcctgcatccggagtcaaacgaaagaaaatacgatttgaaatcttttttctcattatgataaaggtcattggccttggcgccgaagtatttctcataaaattctttcatccgttctaaatctttcacccatatggccgcatgttcaattcgcatatgtccgcctcctttttttttctcaatctagttataaagcatgaaacccatttcagctcaagactttttccgctgaaattgatgcataatttgttttttagccgtttctccgtgcaaaaacagcaaaaatgcttcccttccgacccgttccaaatgaagttccagagatgggatattcaatgcccggctgacgctcaggtttccctcgccgatgatctccgcgtcccatttctgttctttcgcaaactggtacaagccggcagccacatcatcactgtgcgcatagatggccgtcggcgccttgtggaaaccccagaagtgttcacctgcccgctttccgtcgtccatatcatggcatccgatcagaatgcgggtttcatcaagagagccgaaaaccgccttatatgcggttaccttgtcggccgtactcgggcttttttccgcttcccgcacacatgtaaaagcaacatcttgatgcccgcggtttttcaaatacaaaaagctttctctgtaagctgcctgcctgtcattataagcgcagggaatctcttgatgctgcgtatattcacaagcgacaatgggaccgtactccagataaggcacagcggtttcccattcattcgcgcgggacgtgacaatcagtccgtcaatctttttcattttcagcagttcgaaataggtcatctctatagcggggtcatagttggtggggagaagggttgtcacgtaatcatgggcaaacgcttccttcgtgataccgtttacaattttgtcaaagcagggatggtcgctgtacggcaaaatcacgccgattgtattggtctttcctcgaatcagatcaatggcggttcgattaggggtataatccatctccttcatcacttgattcacaagacgccttttctcctcagatacgtacgggtgtcggtttaatacgcgtgatacggtagccaccgacacattcgccagtttcgcaatctcttttatatttgccatgtgctcctccatttttggtgataaaaaagcagcaagagtggatttctcttactgctatctcatcataaatccactgtcatttcaacagggcaatggtcagaacccatgatatcggcgcaaatggccgcttcgctgatccgcggcttcagtctgtctgaaacaatgacgtaatcaagccgccagccgatgtttttctcacgtgcgttcgtcctgtaagaccaccaggaataggcgccttcccgatcaggatataaatagcggaatgagtcggtaaatccggtgttcagcagggcgctgaacgcttcccgctcctgatccgagaaaccggcgttcttccggttggctttcggattttttaaatctatctccctgtgtgcgacattcagatcgccgcataatatcacgggcttcttccggtcaagcttctgcagatactccttaaaatcggcttcccattgaagacggtaatcaattcgctctaatccgcgtttggcattcggcgtataacagttgacgacgaacaggttctcaaattcaagtgtgatcacccgtccttcttgatcatgatcgtcaattcccagtccataaaacacgtgaagcggcttttctttcgaaaaaacagccgtgcctgagtagccttttttcaccgcgtagttccaatagtcatgatacccttcaagctgtaatgatacttgtccgtcctgtactttcgtttcttgcagacataaaatatcggctttcgtttcctgaacgtaagtattgatatctatctttttcatcacggcacgtaagccgtttacattccaagaaatcagtttcatgtgttccccctgtccggctcagccggcattccagtgtttcaatgtttccgccctctaatgccagcatctgctttttcatttctaaaccgcctctgaatccggtcagttttccgttttttccgatgacgcgatggcacggaaccgtaatcaataccggatttttcccgattgcggcgcccacggctcttacggctgccggtttctgaatcatttctgctatatccgaataggagtatgtctcgccgtacggtatgtccataagcgctttccatacagcaagctgaaattctgtcccgtaaagatccaccggcactgaaaaagctgatctgccattttcgatgtactcggacagctctgccgtgtaagacgccagcttctcatcatcacgtgccaatcggtattgcggcagtgatttttttgcccactgctcaagctcttcaaagcttccatgatttgaacctataaagcaaagccctttagatgtggcggctgtatacaggctccaatcattccgtgtgaaaagtgtccaatagaccattgtctctttactcatattgaacctccctgtcccattccggcagtttttcggtattctgtgggcgaattcccggttctctttttaaaaagagtggcaaaatgcgctgtgtttggaattccgaccgtcagagcaatctccatgactgtcatatcagtatgctttaaaaggtgttccgccttcgccaatcttatgttctgtatatactcaatcggggatattcccctgatttttttaaatgtccgctgtaaatgataagggctgccgtgacacatttcggccagtacactcagagtcagagattcgtgataatggcggtcaatgtactcaatgatttgagcaatccattcttcatcaggaagacgaagaccgttcggccggcaccttttacagggacgaaaatgtttatcaagcgctgcatcagccgtatcaaacaccagcacgttttctttattcggagctctcgatttacaagaaggccggcagaaaatccccgtcgtctttactgcataataaaatgccccgtcataagaagcatcattgcgtatgattgcgctccacttttcatcagtcaggatatttctgtctgtctccatctcagccaccccctgttcttcagtataaacaaattcattgcataagtacgcgtatttgaatagaggagcaagataacaaagatagatgtcaggagcacttccatgtttcatgtgaaacatttcggcaggatggaggaggactgatataaaaaaagagcaggagcccgcaggctcttgctcttttctttcggcttactcgccagttacgtatggaagtaaagccatttgacgtgcgcgtttgatcgcgatagtcaatttacgttggtatttcgcgtttgttccagttacacggcgaggtaagattttaccacgctcagaaacaaactttctaagaagatctacatctttgtaatcgatgtgcgtaatgccgttagaagtgaagtaacaaaccttacggcgtttcgcacgaccgcctctgcgtcctcctgccattgtcatttcccacctttctcgttatgaatatagcgataatctattagaacggaagatcatcatccgagatgtcaatcggcttgccgtcgttggcaaatggatcatcattaaagctgttcccttgatttcgtctctggttgttctgatttccgccgaacggattatcattttggcctccgccaaagtattggcctccgccgctgtttccttcgttgtatccgcctgatccagaaccgccgctgtttttaggctcaagaaattgaacactttcagcttggacttctgtcacgaagacacgctgtccctgctgattttcataatttcttgtctggagtcggccgtctacgccggcaaggcttccttttttaagaaagtttgcaacgttttcggcttgtcttctccaagtgacacaattaatgaaatcggcttcacgttctccggactggttcgtgaatgtacgattcacagcaagagtaaacgtggcgacagccgcaccgcttggcgtataacgaagctctgggtcttttgtcagtcttccgactaatacaactcggttaagcatatgaaagaccaccttttaacattatatatttcaaattgcttattcttcttctttaacaacgatgtggcgaatgatatcgtcactgatcttagctaaacggtcgaattcagcaaccgctgcagcttcagactgaacgtttaagatttggtagaaaccgtcacggaaatcgttgatttcgtaagcaagacgacgtttaccccaatcttttgttccagtgatctccgctccgttagaagtcaatacgttgttgaaacgctcgataactgccttctttgactcttcgtcaatgttcggacggataatgtacataacttcgtactttttcatctgtttgcacctccttttggtctaagcggccctataatgggcaaggagcaataattctattactcacaagtttatattataccaaagctcttgtccctttacaactgtgtcctatacattaaatcggaaatgaatgacatctccgtcttggactacatattccttaccttccagacgcacttttccggcttctttcgctccggacattccgccgcctgccaaaaggtcttcataagcaaccgtttcagcgcggataaagccgcgttcaaagtcagtgtggatgatacccgcacactcaggagctttcatgccttttctgaatgtccatgcgcgcacttcctgttcgcccgccgtaaagtatgtcgcaaggccgagaagagagtatgacgctttaatcagctgatcaagacctgattcttcgatgccgagctcctcaaggaacatttgcttttcttcgccttccaattcagcaatttcagactcaattttcgcacagacgacgataacttcggcattttcacccgcggcgtactcacggattttcgcaacgtattcattgtctgaaggatcagccacttcatcttcgcttacattcgccacataaagcacgggttttgacgtaagcaaatgaagctgcttcacaagcttttgctgttcttccgtaaattcaacggaacgggcaggcttttcttgttcgaaagcttctttcaatttagacagaatgtcaaattcaaaaaccgcttctttgtctttttgcttcgcaagcttgcttacacgcgtgatgcgtttttcgactgtctccatgtcggcaagaatcaattcaagattgatcgtttcaatatcgtcaatcggatcgactttccctgacacgtgcgtaatattgtcatcagcgaatgcacgtacaacgtggcagatcgcatcaacctgacggatatgagaaagaaacttatttccgagtccttcacctttagatgcgccttttacgatccccgcgatatcagtgaattcaaacgcagtcggcactgtttttttcgggttcaccaattcagtcagcttttgcagacgttcatccggcacttccacgattcccacgttcggatcaattgtacagaacgggtagttggctgattcggcaccagcctgggtaattgcattaaataacgtcgattttccgacattcggcaaaccgacaattccagcagttaaagccattctttcatctcctctatatcaaaccatcatcgtataaacgtattgtaaacctagagcaattataaggaggttcataggaaaagacaagctgagaaaaaagcatttcccgccctctctctccttagattacccttttttaaccgctaccagacagtcaaaaagcgtacttcccattccattatcggaatttgaatcctttgtgagcatgttgacggagcctccgaatgccgcccacatgccttcatctatattcaccgtcttcgggtgagcctgcttcatgattttcaccctgccgcgcagacggccgcggtcattgtatacctctgccgtatctccgtcttgaagtgaaagctcctcggcgatatccggcgacaggtccacctgaatctgctggagcttttcaataaacggcacgtgctgtgaatgattggagcgctgcgggtgaatggacagcagcgtatacggatatttcccggccagtccggcgtcgtgataaacggactcctccggcacttccaattgagggaggccgctgtatcctttctcttctgccagtgacgagacgaattcaaattttccgctcggggttaaaaattgaaaatcactccacggaacctgtttaaccggaagcggcatatgtcctttttcctttaattgctcaagggtgattccttctttctccaaagaagagagccccatttttaagaaatcttccgcactgtaatcaaacagctccccgaatccgagacgctttgcgagttccgtccagatccagcggtctgattttgcctctccctgcggttccgcaagcttcttaccatattgaacatagtgatgatacatgctggaataataaatatcttcctcttcgaaaacaacggccgtcggcagcacatagtcacagagcttcgccgtatcggtcatgaccgaatcaatggccactgtgaccggcgttttttcaaacgcttccttcactttttttgtattcggcacctgtgtcagcggattgccgcacgtcacgatgatcatctcaatcggcgggtcggctgcattcagcgcctcttcagcttgagtcatcatcgaaaacgttctcgaacttttcttcaaatcaggacgagtgagctcggcctttgcaaagctttcaccgacttgcacatttccgaagttggcgccgccgcctttgataccgacatttccgctcgccgcagctaaagcgtcaatccaccgtatcgtcccgcccccgtttttatatctctgcatcccaagacccataaaagtggaggcgggaccgtcagcatataaatcggcaagatattcaagcgcttctaaagacgtttctgttttctcaatgatctcctcaaaagaaatcgtctgcagaagcttgtctatttcctcaaaaccgaccgaatgcttttgaataaaatcagaatcggttctgccggtttggcataatatttttaaaacacccgccgcaagccagccatccatgccgggtttgacggatatataccggtcggcaagctttgcagtcgggttaaaaatagggtcaatgaccgtcagtgtcgctccttttttcttcacctgctgcagatgatgatagaggtgcatattcgtccgggacacgtttctgccccatacgatcacatgcttgctgtgataaatatcaagcggtccatgcccgtaagaacgcccgaaatcccagcgctgcgcttcaatgccggaaccccagcaaatgctgcccgcaatctcggttacaccgccgtatccattgaaaaaacgctggtcgagcgccttcaaaagaccgttattggcgtagtcatgactgtgcagcactgcggcagtgcccaacgtctccttaatcaccgtcattttttcagcaatttcatctaacgcctgctcccaggaaatgcggacaaattcgccgtctttcttttttaaaggaaaacgaagccgttccggcgcattcgttttcgtctccagcattctgccccggccgcaaattttcccttccgtaatgggatgattcgggtctccgtctactttcgtcacctttccatcctcaactgtcaccaaaaagccgcagctgtcccagcaattcagcgggcacgctgactgatgcactttgctcatcgggcctcttcctctcctctatatgaaaaagcatgagcgccagcccttatgatgtaggctcctcatgcttgacgagtacttttttcagctttctctcaaaatctcttctcggaatcatgacactgtgggaacaacccgtgcatttgatccgaatatccattcccatccgaatgattttccacctgttttcaccgcaaggatgcggtttcttcatttcaacaatatcattcaggccaaagtctttatccgccaagacccttcacctctctccatagactgctttatttattgtacaaaaaaagacaggataagagcaacggccgcactcaaaatgagcattatacttttttccatctccctaaaatagggtaaagaagaagacataccagcaaataaagacttaaaagcccgtaaatgggatataaaatggcgatcaaatctgaaaaaccgattgtcgtaaaaggcaccatcacagctaaaagaagagatacgagcgtccatctcggcaatttcacaaatgcaagcatgcggctggacagcccgaaaagaccggtcaccgttgtcgtatagatggctaaaaaaagcacggcggccatacaaagaaataacggataaggagcgccttcaaggacggcgaaaagaggaatctcatattgtgtaagactgcctgaaagctgtacaagcgtttcattgtaaacaaatgaaatcataccgaaaatcagcccgcttgcaacgcttgcgattttggcttctcccagtcccttcatatctttcccgattgaagaaagaacagcgacaacagaaagaatgtttaaggacgtgaaggtaatgcttgccggccaattatactggcgggtcaagtctatcgtccacgtgtaatgatgcgttgtctgaaaaaagaccaatgcatataacagccccgctacaagaatcggtatcaaaatactattcagagataatatcccttttatatcccaaaagaataaacccacggtcacaatgcaaagaagaaaaataccgatccaaaacggcagcttgtacatttgcagcgtcacaccgccgccggcaatcataaccatcgtcattgaaaacaaataaaacataataagcacatcatagactttagcaagagccggtcccatcagatgctcaagcacaggtaaaaagtgcgttgattgaacccgatagctgatcttcaacacaatataagccgaaatcgtaaacatgactgtaaacaatacaatagccagtccgctttcgacaccgaaaaactgccatatttcctgcccgcttgcatacccggccccaatctggctgcttaatatgagcagcatccacttcatcccggctctccacaccctcatcacctcataaaatttctgatcatctccgcatattgctactatattgagtgacagcagcaaacattcatacaaatgggacaaatatggtatgataacgacgattgactattcagaaaatttatttatgttaggcgctcaaatcatggacatcaggcgtttaaccgcaagtgatacccagccttactccgattcaggctcaaagctttaaaagatcacccggacgcaatcgccgtcagctatgaggccgtccgaaaaatgcaaagccaggcttgaagccggcaatgccatcttgcttggcgcctttgaacaagacagcctgataggaatcctcaagatctccaagcatctgctgtttaaactaagacacattgcggttatcggttctatgtatatttcccccaaacacctagggtcaggcgcgggaaaagctttaatgacggaagccatcagccgggcaaaaaagatgaaagacacagaacagctccatctctctgttacttcaacaaatggaacccgcaaaaaaactctgcgctcagttaggattatcctcttctctgcagaaaaaagagcgctggaattagatcatcagcaatatgttgatgtagatcatatggtcttatttctttcatgaacttagagaataactgctctgagttcttttttctatccgctcttttcaaacaaccggcatgctcatcatgacataagcataaaaaaaggcagcgctggatatactgtaaacaaccatacatcaccaaaaacaacaatgtaatactcgtatgacatgacaaggaagtgaaccttatgaatcgaaaaggcgggcttttttctcaagaacgggcaaaacaatatgtatcccatacggattcttctgctgcgaatcaaatacaagcaatccttacttcatctttacgtaaagcagccggcagaccgttagtcaccgtgtgtatcggtacagatcggtcgaccggagattcattaggtccgctcgtaggaacaaagttagaaaaaatgaatttaggcagattgcacgtttacggcacgctgtcagatcctgttcacgccgtcaatatgaaagacaagctgaaagatattcaacatctacataaaaatccgtttattatagcggttgatgcttgtttaggccgcgtcaaaagcgtaggctcatttcaaatcggcgatgggccgctgaagcccggagcaggtgttcaaaaagaccttcctgaaatcggtgacgtccatatcaatggaatcgtcaatgtcagcgggtttatggagtattttgtcctgcagaatacgaggcttcatcttgttatgagcatggcaaatgttttagcagaggggttacagctgacagataaatcagaaggccggcaggaacggctcagtccgtttcataagctgacaagacgtatataaaaaaccatcttttttaaaaaagatggtttttacgcttctctttcggacaatagttccaggatacgttcaagatcttcatttgagaaaaactcaatctcaatcttcccttttttcttttgtctcttaatattgactgttgttccgaagtaattttgcaaatacgattcccgctcttttaacacaacatcttgaacaggttcttttttctttgtttcacgtggaacattgttgtttaactgctgaatcagctgctcaagctggcggacgttcagctgttcttcaaccactttcttcacaagcggttcaagcttgtttttatttttcaagccaagcaaggttctgccgtgtcccatggataacgtaccttctgcaatgaggttctggatgctttccggcagcgtcagcagtcttaaatggttggcaatatgaggcctgcttttcccgagccgtttagcgagctgttcctgggttaaatccaaatgcttcagcagtgagtcatatgccagagcttcttcaagcggtgataagtcttcacgctgaaggttttccaaaagagcgatttcccgcatcagcgattcagataaatcccgcacgatagccggcactgtctctttaccggcaagttttgcggcgcggtaacggcgttcgccggctacaatatcatagcccttcaatgattttctcacgataatgggctgaagaatgccatgctgaatgatggattccttcagttcagctaatgactcatcatcaaattgttttcttggctgataaggattggggcgtaaatcactgattttaatttcttccactgtctcttcagacaaatcaacctgattaaacaacgcgttaatcccttttccgagcccgcctttagccattcgctgccacttcctttgctaaatctaaatatacttccgcacctctcgaacgcggatcgtataatatgatcggcttgccgtgactcggcgcctcacttaaacggacattgcgaggaataatggtttgatacactttatctctaaagtatttctttacctcttctatcacttgaatgccgagattcgttctggcatcaagcatcgtcagaagcactccttctatcattaagtcggtatttaaatgtttttgcacaagccgaactgtatttaataattgactcaatccttcaagagcgtagtattcgcactgaaccgggataacgactgaatctgaagcggtaagcgcattaatcgttaataacccgagagacggaggacaatcaataatcatgtaatcgtaattttgtttcacagattctaatgctcttttcagcctgacctcccgtgagatcgtcggaaccaattcgatttccgctcccgcaagctggatcgtggccggaatgacatctaagttctctactgaagtcggtttaataatatctgtaacatctgcatcatctactaaaatgtcgtacacacaatgatccacatcggctttttcaatccctaatccgctcgttgcattgccctgcggatcaatatcaacaagaagaacccttttacctatgtaagccaagcaagcccccagattgacagaagtcgtcgtcttcccgactccgcctttttggttcgtaattgctatgatttttcccacgatgtcacctaccttcacatgaacatgtactgtcttgtttctatcttatcaaaaaaagagtaaagcgttttatttttttcataatttgtttatcagcaagtgaaaaaaatgtaaacgaaaaagacactttctaatataagttctccgataaagtgacttttttgactgtaaaaagacaattcacgacacaaaaagataaaattttacatatataatgtatagtgcacaataaatctatcattatctcaaaatagttttttgattaaaataaaaactcccctgctgatcaggagagtttttatttaggtatccgaatggtaagctggatgtactcttcgaattcttcttcttcagtgttcagcctgacgccgctgtcttccaccatggacagtgactgacgaatcgtattcatcgcaattcttgtatccctgctgaacgctttgcgtctcggctttggtttctgcttattctgttcaagcattttcaccactctgtcttctgtctgcttgacgtttaagcttttctcaatgatttccgcaagcaatgtgacctgaaactccggctgtttgagcggaatcagtgctcttgcatgacgttccgtaatttttttctccataatcgcatcctggacgggttccgggagctttaacaatcggagcttgttcgcaatcgttgactggccttttcctaagcgctgcgccaaggcttcctgtgttaaatcatgaagttctaacagccttgcgtacgcatgagcttcctcaatggaggacaattcttccctttgcaggttttcaatcaaagcgacagatgctgtttccgtatcagaaaaatctttaataattgcgggaatcttctcccattcaagcgtctgtaccgctctccagcgcctttcacccgcaatgagctcatattgtccttcatcttctgtatgtctgacaacaatcggctgaatgatgccgtgtgtatggatagtcattgctaactctttgattttttcatctgagaaaatggtgcgtggctgaaaacggttgggaacgatagcatgtaccggtatttcgagtatctcttctttgtttgtatcatgctcagctatctccggttcctcttccttctcaccaaacccgaagaaacgagagaatgaatgcttcatgtacctacaccacctttaaaaactgccatttttataattctattttctcatggtttttcctgctgtatcttcatcaattttgcagaaaatatgatggaattgtcacatcaggctgtctaaattacccttcaattggcgatttatttggagtacccggttttctcggatattttttcggagtgcttttcgtcttgcgaatgatcataatgttccgttcactttcttcaacgggaagtgtaaaggaatgaacttgttcaagctctcctcccaatactttaatcgccttttgccccgctttcagctcttcatcagcggctgcagcttttaatgccgcaaaaataccgtttttcttggccagcggcagacaaagctcactcaggaccgacagacgcgccaccgcacgggccgtcacgagatcgaagctttcccggacgtctttccgctgtccgaatgtctccgctctgtcatggacaaatgtcgtatgctctaattgtaaagcatcagagagagtttccaaaaacgtaatccgcttattcagtgaatcgacgatggtgacatgcagatgcgggaagcagattttgacgggcaggcttggaaaaccggcgccggcgccgacgtcacaaagagtggtgaccttttcaaaatcaatataaaatgccgccgttatcgaatcataaaaatgcttgagataaacttcctttttctcagtgatggatgtcagattcattttttcgttccattccacgagcatccggtaatacaactcgaattgctccagctggcggtcagaaagggaaatccctttctccgctaaactggatgtaaattgctctatattcatgccgtcatcctttctattcagctaccttggcaatacggccctgctccaggtataccagcaggattgaaatgtctgccggattgacgccggaaatacgggacgcttgagcaactgataaaggacgcacttctttcagcttttgacgcgcttcagtagcaattcctttaatggcgtcataatcaatccgatcagggatttttttgttttccattttcttcagcttttccacttgctgcaaggatttttcgatatatccttcatatttcacctgaatttccacttgttccgccacatcttgcggaaccggagaatctgcaggcgcaagttttgtcactgtttcatagttcatttccggacgtttcattaaatctgtgccgcgcactccgtctttcagctcgcttccgccgagtgaacggatatattcctgattctcaggagacggcttgataataacagaccagagacgttttttctctgcctcgatcgccgcttttttcttctcaaacgcttcatagcgctcatcagaaattaagccgatctcatggccgatttccgtcaggcgaagatccgcgttgtcgtgacggagcagcagtctgtattccgcccgtgaagtcagcagacgatacggttcattggttcctttcgttaccaaatcatcaatcaatacaccgatataagcatcggaacggctgaggatcacttcttcttttccaagcgctttgcggcctgcgttgatccctgccataattccttgcccggctgcttcctcataacctgatgtaccgttaatttgaccggctgtgtacaggttagggatttttttcgtctccagtgtaggccagagctgcgtcggtacaatcgcgtcatactcaatcgcgtatccggctctcatcatctgcaccttttccagtcccggaatggtcgccagcatccgctgctgcacgtcctcaggaagactcgtggatagaccctgaacgtatacttcctgcgtatttctgccttccggctcaaggaaaatctgatggcgcggtttatcattaaaccgaacgactttatcttcaatcgaagggcagtatctcggtcccgttcctttaatcataccggaatacatcggcgaacgatgcaggttgctgtcgatgatctcatgagtctcaggactcgtgtaagtcagccagcaaggcagctgatcggtaatgtattcaaccgtttcatatgagaaagcgcgcggaaccgggtcccccggctggatttctgttttgctgtaatcaatggaatcgcttgagacacgaggaggcgtgcccgttttaaaacggacgagatcaaaaccgagctcctctaagtgctcagaaagtttaatagacggctgctggttattcggaccgcttgagtaagacagatccccgagaatgatccgccctcttaaatacgttccggttgtcagcacgaccgtttttgccttgtattcagcaccggtttgcgtaatgacaccgcggcactctccgtcttcaatgattaaacgctcggcaatcccttgaagaagtgtcaaattcggtgttttttccagcgtatgcttcatttcgtgctgatattggaatttatccgcctgcgcacgcagcgcccgtacggccggaccttttcctgtattcagcattctcatttgaatatgagttttatctatatttctagccatttctccgccgagcgcgtcaatttcgcggacgacaatccctttcgcggggccgccgacagacggattacatggcataaacgcaaccatatcaagattaatcgtcaaaacaagcgttttggctccctggcgcgcggatgcgagggcagcctcaacaccggcatgcccggcgccgatgacaatcacgtcgtattggcctgcttcataccccatggttttttcctcccttttatttacctaaacaaaattgtgaaaagagctgatcaattaagctttcgtgaacggcatcaccgatgatttcgcccagcagttcccagcaccttgtcaaatcaatttgcaccatatcaatcggaacatcctgttcaatcccgttcagcgcatcatcaatcgcttgctttgcctgatgcagaatcgaaatatgacgggtgttgctgacataggtgagatctccgctttcgatcgctcctgtataaaatagcgactgaatcgcttcctctaaatcttgaatgccttcttctttcagcaatgaggtcgtgacgacaggccggcctttcgccagttccttgacgcgctcagcgtcaatcttagcctcaaggtccgtcttattcataatgacaatgacgtccattccctcaaccgcttcaaacaatttcacatcttcttcagaaagcgcttcgctgtggttaagcacaagcaaaatgagatccgcttccttcagaacctgccgtgaccgttccacaccgattctttcgacgatgtcttctgtctcacggattccggcggtatcgacaagccgaagcggcacgcctcgcacgttgacatattcctcaatcacatcacgcgtcgttcccggaatatcggttacgatcgccttcgtttcatggacaaggctgttaagcagagaggatttcccgacgttcggacggccgatgatcacggtagacagtccctcacgcaaaattttcccctgctcagacgtacggagcagcgcctcgatttctttcttcacgccgcttgccttctccactaaaagctgatgcgtcatttcttcgacgtcatcatattccggataatctatatttacctcaacatgggcaagtgtttctaacaactcatcacgcagacggcggacaagcgcggaaagccgtccttccatctggttcatggcgacattcatggcacggtccgttttggctctgatcagatccatcaccgcttccgcctgtgaaaggtcaatccgtccgtttaaaaatgcgcgcttcgtaaactcaccgggttctgccagtctcgcaccttctcttaaagcaagctggagcacctgattaaccgtcacaatacccccgtgacagttgatttcaatgacatcttcccttgtgaatgttctgggcgctcttaaaacagacaccatgacttcctcaataatccgtcccgtcgtactgtccgcgatatgcccgtaatgaatggtatgcgattctgccgaactgagcgttttgcctttcggacccttgtacattttgtcggcgatctttacggcttccgggccgctcagccgaacgatcgcaatcgcgccttcacccatcggagttgaaatcgctgcaattgtatccatactgttcacctctctttatctctgtttccatctatataaaaaattttatttacgccaaaattaaaagataacatagtttggtttgaagtggaagatacgttatccacaaaggcagaaattcatcccttattactttaacttatccacatgtgaataacaattaattttatttcctaaaaccttttttatcaacagcatagacctaaaaagaaaaaacttaaacgcaaaaaatgcgattctgctcaggaatagagccatttttaccaataaaaaaaccgaagttccgattttacccggacttcggttttctgctatctttatgggaaataacgagatggcggtaccggccttcaccggtagaaaacgttttgatatttggatgctttgacagcgcgtcatggatgatttttctttcacctgacggcatcggttctaaatgcacctcttttttcgttttcgacacttgcttggccagcctgtttgccagctgatccagaatttctcttcttttccgccgataattttcagcgtcgacaacggcttggcgatactggccggagccgcggttcaaaacaagctgcgtcaatgtttccaaggcattgagtgtttgtcctcttttgccaataagcagcgccgctttttcacctttaatatgaaaacagactgttttcttgttttcttccgtaacaatctcagaaggcccggcaatggaatggatgatttcttctaaatacgctttcgcttcctgaacaggatttcttttctcttccagttctacaatcgcattcttttttccgaaaatacccaaaaaccctttatattcttcttgcaccaccgttatttctacttgatctttcgtcagttgaagttcctgaaggcctgattgaactgcttcttcgacattccgtcccgcagcagtcaccttcttcactttttctttcctccggctttctgcgtttccggatcgtgtttaatgtcaggtcctttaataaggaatgtctgagcaatcataaacaggtttccgactacccaatacagagaaagcgcgctcgggaagttgatcgcaaatacgatgatcatgatcggcataatccataccatcattgccatttgaggattctgagtcggatttcccgccatcatcagcttctgctggacaaaagtggccacaccggcaacgataggaagaatatagtaaggatccttctctcctaaatcaaaccataaaaagctgtgctgtgaaatggcttgcgtacgcataatggcgtggtagaatccgatcaaaatcggcatttgaatcaggatcgggaaacatcccgccagcgggtttaccccgtgctttgaaaacagggccattgtttcctgctgaagcttctgctgcgttttttgatctttagagctgtatttttctctgagcttctgcatttcaggctgcagcgcctgcatcgcttttgagcttcgaagctgcttgatcatcagcggcagaatcagcagacgaattaaaatcgtaacgatgatgatcgacaaaccatagttatcgcccgtcagtttcgctacgtacgtaatgacttctgacaatggatacacaacatatttgtcccagaaatgcggactattcgccgtaatcggctctttcacactcgagcacccggccagcagcacgagcataccgaccatactcagtagtaaccatattctccttttcaagaacgtttcctcctataccaatctttataaaccttgtatgtattttagcatctttcagtttcaaatggcgttcatttttcgccaaataaaaggaagcgcttttaaaaacgtgaagaaaacaaaatatgagctattttgacgaagatttcttatataatgaggtttttctgaataagtgctgcagactctttttcgtttcttcaaaactgaggtcgccggcgggttttcttgcgataataataaaatctttcggcttgagcagctctttttcctcctgaaccgcctgcctgattaaccgcttcacccgattgcgcacgacggcattgccgatttttttactgacagaaagccctacccggagctcttcctgtttcggctgatcaagcgtatacagcacgaactggcggtttgccatagacgttccgcgtttaaacactttttgaaaatcttcatttttctttaaccgatttcgcttcttcactttaattcactccgatattcactcgcagaaacttttatttctatctaaaaaaaacgggccgccggaatactgaagaaatttctccagtaccgggcgacgcatgacatctcttttctcttaatgtgaaaaaagaccactgacattattcagtggcctaagctgataatacttttctgcctttgcggcgacggcgtgctaatactagacgaccgttttttgaactcatacggcttctgaagccatgaactttactgcgtttacggttattcggttggaatgttcttttcatttatgacacctccctcgaggaatagctgttaaagacagtcttacttattatatttgtgctgcctattcattgtcaacttcagcagtgcttttatttcttacaaccataataggataacataccttaaccagattagaaaccttatttttcatattcctttttttaacgcacaaaaaaagccgcgctcccccgaaaaaacgacatgtggataatttttcggtctttttttaatatccacaatcgttatcgacaacattttcacattgctaacccctgtggacaaagatttttcaacaagttgtcaggtttgtggataagattacgagaaccattgcaagtcctcgcttaatttgatattatatttgtgttttaactcttaattacttatccagtccattctctttatccacaaattgtggataagttgtggattgttttcacacagcttgtgtagattgttgtccacaacttgtggaatttgtcgaaaagctatttttctactatactatatgttttcaacatttcgtgtgtacgaatggtcagagccatatgctctttttttgtgttctataacaggggaagggcgctgatttttaaagaaaaggagggctgtgccggataatggagaatatattggatctttggaatcaagctctagctcaaattgagaaaaagctaagcaaaccgagtttcgaaacttggatgaagtcgacgaaagcccattcgctgcaaggagataccttaaccatcaccgctcccaatgaatttgccagagactggctggagtccaggtacttacatctcattgcagataccatatatgaattaaccggggaagaattgagcgtcaaatttgtcattcctcaaaatcaggacgaagaagactttttgccgaaaccgcaagtgaaaaaagcggcaaaagaggaaccgtctgattttccccaaagcatgctcaacccgaaatatacattcgacacattcgtcatcggatcgggaaaccgattcgcccatgcagcatcactggctgtggcggaagcacccgctaaagcgtacaaccctttatttatatacgggggagtcggtttaggaaaaacccacttaatgcacgcgatcggccattatgtcattgatcataatccttcagccaaagtggtgtacctgtcttctgaaaaattcacaaatgaattcatcaactcaatccgcgataataaagccgttgatttccgcaaccgctaccggaacgttgatgtacttttgatagatgatattcaatttttagccggaaaagaacaaacacaggaagagtttttccatacattcaacacacttcatgaagaaagcaaacaaatcgtgatttccagtgacagaccgccgaaagagatcccgacccttgaagaccgcctgcgttcgcggttcgaatggggattgattacagacatcacaccgccggatctggaaacgcggattgccattctgagaaagaaagcgaaggcggagggccttgatattccgaacgaggtcatgctttacatcgccaatcagattgacagcaacatccgcgaactggaaggggcattaatccgggttgtcgcctattcatccttaatcaataaagacattaacgcagacctggctgcagaagcattgaaagatattattccgtcttctaagccgaaggtcattacgataaaagagattcagcggattgtcggacagcagttcaacattaagcttgaagatttcaaagcgaaaaagcgtacgaaatcagtggctttcccaagacaaattgcgatgtatctttcaagagaaatgacggattcttctttgcctaaaatcggggaagaatttggcgggagagaccatacaaccgtcattcacgcccacgaaaagatttcaaaactgctgattgatgacgagcagcttcagcagcaggtgaaagaaataaaagaactgcttaaataatagtgtcctcggatgaatcggggaaagtgtgaataactttttcatagccatacacagtctgtccacatgtggataggctgtgtttcctgtctttttcacaacttatccacaaatccacaggccctactattactactgctatttttaaaaatatattaattatattatccgttaggaggataaacatgaaatttacgattcaaaaagatcggttagtcgaaagtgtacaagacgttctaaaagccgtttcatccagaaccacaattcccattctcaccggtattaagatcgtcgcctcagatgaaggagtatctttcacaggaagtgactctgatatttcaattgagtcattcattccgaaagaagatgatgataaagaaatcgtgacgatcgatcagccgggaagtatcgtgctgcaagcgcgtttcttcagcgaaatcgttaaaaaactgccgatggcgactgttgaaatcgaagttcaaaatcaatatttaacgattatccgttccggaaaagccgaatttaatttaaacggccttgatgcagatgaatatccgcatctaccgcaaatcgaagagcatcacgccattcagattccgacggatcttttgaaaaacctgatccgccaaaccgtgttcgctgtgtccgcctcagaaacacgccccatcttgacaggtgtaaactggaaagttgaaaacggtgaattattatgcactgccacggatagccaccgactcgctttaagaaaggcgaagcttgatattccggaagacagtacttataacgtggtcattcccgggaaaagcttaaccgagctaagcaaaattcttgatgacagccaagagctggtggatatcgtcattacagaaacccaagttctgttcaaagcgaaaaacgtattgttcttctcaagattgcttgacggaaactatccggacacgaccagcttaattccgcaggaaagcaaaacggaaatcgtcgtgaacacgaaggaatttttacaggcgatagaccgtgcttctttattggcgagagaaggccgcaacaacgttgtaaaactttctgccaaaccggcggattcgcttgagatttcatcaaattctccggaaatcgggaaagtggtcgaagctgtgctggcagacaagattgacggcgaggaattaaatatttcattcagtccaaaatatatgatggacgcactgaaagtacttgaaggagcggacatccgtatcagctttacgggagcgatgagaccgtttcttatccgtacgccgaatgatgagaccatcgttcagctcatccttccggtcagaacgtattaatcaaacagaatgtgctgccggcttagttcggcagcttttctattcatcagccgctccctcaagttttccctttccttatttcaggattttttagtacaattagatattagtgatatttgaaagaggtcgatattatggcaaatccgatttcgattgatacagaaatgattacgcttggccagtttttaaaattagctgatgtgattcagtccggcggcatggcgaagtggtttctgagcgagcatgaggtgactgtcaacaatgaacctgacaatcgccgcggcagaaagctttacgttggagacgtggtcgcgattgaaggatttggttcatttcaagtcgtcaattaaagcgggtgacagcggttgtatatccaaaatttagaattaacatcctaccgtaattatgagcgcgctgagcttcaattcgaaaacaaggtgaatgtgatcatcggggaaaatgcccagggcaaaaccaatctgatggaagccatctatgtcctttcgatggcaaaatcacaccgcacctcaaatgacaaagaacttatacggtgggacgaagactatgctaaaatagaaggaagagtgatgaagcgcaacggggacatcccgatgcagcttgtcatctccaaaaaaggtaaaaagggcaaggtcaatcatatagagcagcaaaaactcagtcagtatgtcggagcgctgaacaccattatgtttgcccctgaggatttaaatctcgtcaaaggaagccctcaggtgaggagaagatttctcgatatggagatcgggcaggtttctgccgtttatctgtatgatttatctctttatcaaaaaatcctttcacagcggaatcattttctgaaacagctgcaaagccggaaacagactgaccggaccatgcttgacgttctcactgatcagctgattgaagcagccgcaaaagttgtcgccagacgtctgcagtttacggcgcagcttgaaaaatgggcgcagccgatccattccggcatttcccggggacttgaagaactgacgcttaagtatcacacggcgcttgatgtatcagatcccaaagatttgtcgaaaataggtaacagctaccaggagtctttttcgaaattaaaagaaaaagaaatagaacgaggcgtcacattattcggaccgcatcgggatgatgtccttttttatgtgaacggacgcgatgtgcagacttacggttcgcagggacagcagcgtacgacggctttgtctctaaagctggctgaaatagatttgattcatgaagaaatcggagaataccccattttacttttggatgatgtactaagcgagctggatgattaccgacagtcccatttgcttcatacgatccaaggccgtgtgcagacatttgtcaccacgacgagcgtggatggcattgaccacgataccttacatcaagcaggaatgttccgtgtggaaaacggtgcgttagtgaagtgaagaaatgaggtgagcgattgtatattcatttaggtgacgactttgtcgtttcaacccgcgatatcgtcggcatttttgactgcaaggtcaatgtatcgccgatcgttgaagaatttctggacagacagaaagaaaaagtagtgccgtccgtaaacggcacgccaaagtctatcgtagtcacgactgagaatatatattactctcccttatcttccggcacactgaagaaacgtgcgcaatttatgttagaaatagattcttagcggatctttacaatgaatatattatcgtttaagaaaagtgtaggtgaatgtgcatggctatggaacagcagcaaaatagttatgatgagaatcagatacaggtattagaaggtttggaagctgttcgaaagagaccggggatgtacatcggatcaactaacagcaaaggccttcaccatttggtgtgggaaatcgtcgacaacagtattgacgaagccctggccggttattgtacagatattaacatcgagattgaaaaagataacagcattaccgttaaggacaacgggcgcggaattccggtcggtatccaggagaagatgggccgccctgcggttgaagtcatcatgaccgttctccacgccggcggtaaatttgacggaagcggatataaagtatccggcggtcttcacggtgtaggggcatccgtcgtaaacgccttgtcgaccactcttgacgttacggttcatcgtgacggaaaaatccattatcaggcgtacgagcgcggtgtacctgtggccgatcttgaagtgatcggcgaaactgataagaccggaacgattacgcacttcgttccggacccggaaattttcaaagaaacaactgtatatgactatgatctgctttcaaaccgtgtccgggaattggccttcctgacaaaaggcgtaaacatcacgattgaagacaaacgtgaaggacaagaacggaaaaacgagtaccactacgaaggcggaatcaaaagctatgttgagtacttaaaccgttccaaagaagtcgttcatgaagagccgatttatatcgaaggcgagaaagacggcataacggttgaagttgcattgcaatacaacgacagctatacaagcaatatttattctttcacaaataatatcaacacatacgaaggcggcacgcacgaggccggatttaaaaccggtctgacccgtgtcataaacgactatgcaagaagaaaagggattttcaaagaaaatgatccgaatttaagcggggatgatgtgagagaagggctgactgccattatttcaattaagcaccctgatccgcaattcgaagggcagacgaaaaccaagctcggcaactccgaagcgagaacgatcactgatacgctgttttcttctgcgctggaaacattccttcttgaaaatccggactcagcccgcaaaatcgttgaaaaaggtttaatggccgcaagagcgcggatggcggcgaaaaaagcccgggaattgacccggcgcaaaagtgcgcttgagatttccaatctgccgggcaaactggcggactgttcttctaaagatccgagcatttccgagctgtatatcgtagagggtgactctgcgggcggatcagcgaaacagggacgggaccgtcatttccaagccattctgccgctgcgcggtaagattctgaacgttgagaaagccagacttgataagattctctcaaacaatgaggtcagatcaatgatcacggccctcggaacaggaatcggagaagattttaatcttgaaaaagcgcgttatcataaagtggtcatcatgacggatgccgatgttgacggcgcccatatcagaacgcttttattaacgttcttctacagatacatgcgggaaatcatcgaaaacggctatgtctacattgcccagccgccgctttataaagtgcagcagggaaaacgggtggaatacgcttataacgataagcagcttgatgagctgttaaaagagcttccgcaatcacctaagcccggcctccagcgttataaaggtcttggagaaatgaacgcgactcagctttgggaaacgacaatggaccctgcgaccagaacgcttctgcaagtcaatcttgaagatgcaatggacgctgacgagacttttgaaatgctgatgggtgacaaagtagaaccgcggagaaacttcatagaagcaaacgccagatacgtgaaaaatcttgatatttaaccaagaaagccttattttcgttaagaaataaggcttttttctcaaagcggcttctaaagcctctgaaaacccgcaaaacccgtatattctactaaattaatgtgtataaacacaagtttattgatataatggagaatagtgaaatcgtattgaagatcataatggacaatctactcccacattatttcatgtgatacttcagggaggtttttttaatgagtgaacaaaacacaccacaagtacgtgaagtcaatatcagtcaggaaatgcggacatccttcctggactatgcaatgagcgttatcgtatcccgggcgcttccggatgtgcgtgacggtctgaagccggttcacagacggattttgtacgcaatgaatgatttaggcatgaccagtgacaaaccatataaaaaatctgcccgtatcgtcggtgaagttatcggtaagtaccacccgcacggtgactcagcggtttacgaatcaatggtcagaatggcgcaggattttaactaccgctacatgcttgttgacggacacggcaacttcggttcggttgacggcgactcagcggccgcgatgcgttacacagaagcgagaatgtcaaaaatcgcaatggaaattctgcgtgacattacgaaagacacgattgactatcaagataactatgacggttcagaaagagagcctgccgtcatgccttcgagatttccgaatctgctcgtaaacggggctgccggtattgcggtcggaatggcgacaaacattcccccgcatcagcttggggaagtcattgaaggcgtgcttgccgtaagtgagaatcctgagattacaaaccaggagctgatggaatacatcccgggcccggattttccgactgcaggtcagattttgggccggagcggcatccgcaaggcatatgaatccggacggggatcaatcacgatccgggctaaggctgaaatcgaagagacttcatcgggaaaagaaagaattattgtcacggaacttccttatcaggtgaacaaagcgagattaattgaaaaaatcgcggatcttgtccgagacaaaaaaatcgaaggaattaccgatctgcgagacgaatccgaccgtaacggaatgagaatcgtcattgagatccgccgtgacgccaatgctcacgtcattttgaataacctgtacaaacaaacggccctgcagacgtctttcggaatcaatctgctggcgctcgttgacggacagccgaaggtactaagcctgaaacaatgtctggagcattatcttgatcaccaaaaggttgtgatccggcgcagaacggcttacgaactccgcaaagcggaagcaagagctcacattctggaaggtttaagaattgctctcgatcatttagatgccgttatttctcttatccgcaattcccagacggctgaaattgcgagaacgggtttgatcgaacaattctcactgactgaaaaacaagcgcaagctattctggatatgcgccttcagcgattaaccggtctggagcgcgaaaagattgaagaggaatatcaatcacttgttgcgcttatcgctgagctgaaagatattttagccaatgaagaaagagttcttgagatcatccgtgaagaacttaatgaaatcaaagagcgtttcaatgatgagagacgcactgaaatcgtgacgtccggtcttgaaacaattgaagatgaagatcttatcgagagagaaaatatcgtcatcacactgacccataacggctatgttaaacgtctcccggcgtccacataccgcagccaaaaacggggcggaaaaggcgtacagggaatgggaacgaatgaagatgactttgtggaacacttaatttccacatcaacgcacgatacgattctgttcttctctaataaagggaaggtataccgttctaaaggatatgaaatccctgaatacggccgtacggcaaaaggcattccgattattaaccttctggaagttgaaaaaggcgaatggattaatgccattattccggtcagcacgtttgatgaggagcaatacctcttctttacgaccaaacaaggggtgtcgaaacgtacggcactgtcccagtttgcgaatatacggaataacggtctgatcgccctaggtctccgggaagacgatgaactgatggccgtccgcctgactgacggcaagaaacaaatcatcatcggaacgaagaacggtttgctgatccgtttccctgaagaagatgtaagacaaatgggacgcacagctgcgggtgttaaaggtatcacgctgacagacgatgatgtcgttgtaggcatggagattcttgaagaagactcccatgtcctcatagtgacagaaaacggctacggcaaacgcacaccggcttcagaatacagagttcaaagccggggcggaaaaggccttaaaacatgtaaaatcactgacagcaacggtccgttagtaactgtgaaagcaacaaaaggcgaagaggacttaatgattattacggcaagcggcgtgttaatcagaatggatattaatgatatctccactacgggacgcgtaacacaaggcgtccgtctgatccgcatgtctgatcaagagcatgtagccactgtggcgcttgtcgaaaagaatgaagaagagccggaagaaacggaagaagtataaacgaaaaagcgcagctgcaacaggctgcgcttttactatataaagaaataaaaaaaagctttgacacatggtgatgatgctgatataattctttttgttgtctttttaatagaaaggcaagcctagcgaaaatattttttaaaaaagtattgacctagcaaactgaaaatgttatgattaagaggtcgcttcgagaggggcggaaaagttctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtcccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggaactttgattctttcatatggtagatgggcctgtagctcagctggttagagcgcacgcctgataagcgtgaggtcggtggttcgagtccactcaggcccaccatctttacccaatacggggccttagctcagctgggagagcgcctgctttgcacgcaggaggtcagcggttcgatcccgctaggctccaccaacgtgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatacttattgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctatcattacggtaaaggcagctcatcatgagctgccttttttgtttacaagtattgcttcaggaatttagaaacgtaatacggaaatttgcgttccgtgacctctaagaaccgtcggatcatcacataatcatcactgacatgctgtgtcagcagttcataccaccactccgtttcatatctcgcaatcatcccaatattgtagagaaccaaataatgaataatcatttccggaagatgcaggaagtgatcacgctgagagggaatgtaatattgatttttctccaagtgaaacaataaatttggagaagaccaaggttccctgtctatcgggtcagcctcaaaaaacaagtggttatggtctttcctcagaaaagaccacttcaaatgatggctgatatattcagcaaagcgggaatcagacatattgtaatgaatcaccgcatgctcaggcactgaaataaggtcatcgttcagctctacttgggtcatccaattctttttctcttggaagtaaaagacagtatgcaattcaggtatggctgtcagtaatttcttcattgtgtaccgttcttcctcaagaccagctatcccgaataagtgcttcattacatgaatacataagccattgcgctgcaccttcacttcatcatccctaaaggagtaattttgctttttgcgtttccgggcagtcacgccatgcgcgagtactgaagcgtggcttgggtagcttggatctgtggtcagaaggcaggctttcagcaattgtgacatcccgtaaaacaacagaataggcttaatttctaaaggagaaagagatgcctgcttataaaaggactcggcgtgtttgataaagaatatgaagcgctcactgttcttaaacgcatatcgttttggttcttccatgccgctttctgtatagactttgtttagaaatttctgggaagattctacggaataaaataatgataactctttccactcatgatctctcatatgtatttttaaaccctttcctttatctaaatatttcaactctttttcgcttccttgacatgctgttttctagttgataatctacatataatattttgccgaaaagagggggatttactaatgtgggaaagtaaattttcaaaagaaggcttaacgttcgatgatgtactgctcgtaccggctcaatcagacgtacttccgcgtgatgtggatttatctgttgaactgacaaaaacgttaaagcttaatattcctgtcatcagtgcgggaatggatacagtaacagaatcagcaatggcgattgcgatggccagacagggcggcttgggcattatccataaaaacatgtccatcgaacagcaggctgaacatgttgacaaagtcaaacgttctgaacggggcgttattacaaatcccttctttttaacacctgatcatcaagtattcgatgcggagcatttgatggggaaatacagaatttccggtgttccgatcgtagataataaagacgatcaaaagcttgtcggtatcattacaaaccgtgatcttcgctttatctctgattattcaatgaaaatcagtgatgtcatgacaaaagaagagctggttacggctcctgtgggaaccacattagacgaagcagaaaaaatcttacagaaacataaaattgaaaaacttccgttagtggatgaccaaaacaaattaaaaggtcttatcacgatcaaagatattgaaaaggttatcgaattccctaattcatctaaagatgaacacggacgccttattgtcggcgctgcggtaggcgtgacaggcgatacaatgacacgcgtcagcaagcttgttgaagcgaatgtcgacgttatcgtggttgatacggctcacggacattccagaggcgtactgaacacagttgcgaaaatccgtgaaacatatcctgaactgaacattatcgcaggaaatgttgcaacggctgaagcgacaaaagctctgattgaagccggagcaaatattgtcaaagtgggaatcgggcctggttctatctgtacgacacgcgtcgttgcaggtgtaggcgtaccgcagatcactgccatttatgattgtgccactgaagcgagaaaacacggcgcgacaattatcgcagacggcggtattaaattctccggagatattacgaaagcgttggcttcaggcggacatgccgtaatgctcggaagcctgcttgccggtacttcagaaagcccgggagagactgaaatctatcagggcagaagatttaaagtgtatcgcggtatgggttctgttgctgccatggaaaaaggcagtaaagaccgatatttccaagaagaaaataagaaattcgtccctgaaggtatcgaaggacggactccgtacaaaggtcctgtagaagaaacagtgtatcagcttgtcggcggtcttcgttcaggtatgggatattgcggttcaaaagacttgcgcgctttaagagaagaggctcaattcatccgtatgacaggtgccggtcttcgcgaaagtcatccgcatgatgtccaaattacgaaagaatcaccaaactacacaatctcataattgttacaaataaaaaacatttgacagggtcgctgactctgtctattttttttatatcgagtgtgataaaatttatactgttgtgttttgaatttgaatatgtccttaacggcttaattatagatttaaaatgaatgacggaggtcgtaagattgaacatcacgaaatggaaacagctgttggtgtcattagtggtactggcactggccgcaacttgctttgttccgatgtctaaagcggaggcagccggcaatgacccgattgatgtcaacgcatcagctgcgataatgattgaggcttcatcgggaaaaattttatacagtaaaaatgcagacaaaagactgccgattgccagcatgacaaaaatgatgactgaatatctgcttctggaagccattaaagaaggaaaagtgaaatgggatcaaacgtatactcctgatgattatgtctatgaaatttctcaagacaacagtttatcaaacgtcccccttcgaaaagacggcaaatacacggttaaagaactgtatcaggccatggcgatttactctgctaacggagccgcgattgcagttgccgaaattcttgccggaactgaaacgaaatttgtcgctgaaatgaatgcgaaagccaaagaattaggcatgacaaactatgattttaaaaatgccacagggcttgtgaatgaagatcttcacggcaaacagccgcaaggagaaggcgttaaagaagagagtgaagtttctgctaaagacatggcgcttcttgcagaccgcctgatcactgattatccggaagttctcaaaacaacaagcatcgctaaaacgaaattcagagccggcactgatgatgaaatggacatgccgaactggaacttcatgttaaaaggtcttgtttctgaataccctggcgttgacggcttaaaaacgggttctactgattctgcgggatcttgttttacaagcacagcacagcggaacggaatgcgggtcatcaccgttgtattaaacgcaaaaggcaacctgcataccggacgttttgatgaaacgaaaaaaatgctcgattacgcatttaacagcaatttctcaatgaaagatctttaccctgaaggctctcaagtaaaagggcacaaaacggttgacgttgaaaaagggaaagacaagcaagtcgatattgttactgacaaggcgctttctattcctgtgaaaagcggggatgaaaagaactataaagccgaagggactatagataaaaaagaaatcacggctcctgtgaaaaagggaacgaaagtcggaacgctgacagttacatacaaaggcagtgacaaagactatggcttcctcaaatccaaagagttcagcgtgaatcttgtaacgaaaaatgatgtagataaagcaaactggtttgttcagatgatgcgcggcatcggcggatttttctccggtatctggaacagcgccgttgacacggtaacaggctggttttaagaaataagaaagagctctgatgaaagttagggctcttttgcttaatatactgaaaaaaccaaattattagtaaaaaaatgatatctatcttattcatctcgctgtaaaataagaatacccatatgaaatattgtatttctgggatacaataagagatagacattatctaactatacattgactagggggaccaaataatggctcaaacaggtactgatcgtgtaaaacgcggcatggcggaaatgcaaaaaggcggcgtcatcatggacgtagtaaatgctgaacaagcgaagattgcggaagaggcgggagctgttgccgtaatggcgttagaacgcgttccggctgatattcgcgctgccggcggtgttgcccgcatggctgatccgacaatcgttgaagaagtaatgaatgctgtatccattcccgtaatggcaaaagcgcgtatcggacatatcgttgaagcgcgtgtccttgaagcaatgggagtagattacatcgatgaaagtgaagttctgactccggctgacgaagaatttcatttaaataaaaatgaatatacagtcccgttcgtatgcggctgccgtgatctcggcgaagcaacgcgccgtatcgccgaaggagcttccatgcttcgtacaaaaggcgaaccgggaacaggaaacattgtggaagctgtccgccatatgagaaaagtaaacgcgcaagtgcgcaaagttgttgcgatgagcgatgatgagctgatgactgaagctaaaaacctcggcgctccttatgaactgcttcttcagatcaaacgtgacggcaaactgcctgtagtgaactttgctgccggcggagtagcgacgcctgctgacgcggcattgatgatgcagcttggcgctgacggcgtatttgtcggttcaggtattttcaaatcagacaaccctgctaaattcgccaaagcaattgttgaagcaacgactcattatacagactacaaactgatcgctgagctttctaaagaattaggcacagcaatgaaaggcatcgaaatctcaaatctattgccggaacagcgtatgcaagaacgcggctggtaaaaccataggagagctgtaagcatgttaacaattggtgtacttggacttcaaggagcagtaagagaacatattcgttcaattgaagcatgtggttcaaaaggtgtcgtcattaagcgtcctgaacagctgaatgacatcgacggcttaatcctgccgggcggggaaagcacgacgatgcggcgtttaatggatacgtatcattttatggagccgcttcgcgagtttgccgctcaaggcaagccgatgttcggcacatgcgccggtctgattatcttagccaaagagatagcgggaacggataacgctcatttagggctgttgaacgtagttgtcgagcgtaattcctttggccgtcaggtcgacagctttgaagctgatctgacgattaaaggccttgatgagccgtttacgggtgtatttattcgcgcaccgcatattttaaaagccggagaagatgttgaagtgctttgtgagcataacggacgcatcgtggctgcaaagcagggaaatttcctcggctgctcgttccatcctgaactgacggatgatcaccgggtgacagagctgtttgtgaagatggcggaaaagcataagcaggaaacagctgtataaaacagttgaaaaccgctgatacttatagtacattataatcacaaataaagatcgaaaagcgttgacaggaagcagtaggaagcccctctttcaaagagagccgatgggtggtgcgaatcggtgaaagatgctgtccgaatccgtccttgagcgaaatgctgaaaacaagtaggcatttacgggaaaaccgttatgtgttaaagcggaaagcaagtgtgagcttgttttcaatcagggtggcaacgcgagagctctcgtcccttttaggggatgagggctcttttttattttcgataaaaacagataggagttgttaggcatgattgatacgaaggtgctgagagccaattttcaagaggtaaaagcgaagctcattccaaaaggcgaagacttatctgactttgacaagtttgaagagctggatgaaaagagaagagagcttatcggtaaagtagaagaactgaagggaaaacgcaatgaggtgtctcagcaggtcgccgttttgaaacgggagaaaaaagacgctgatcatattattaaagagatgcgtgaagtaggcgaagaaattaagaagcttgatgaagagcttcgtactgtcgaaacgacgctcgaaaccatccttctgtctattccgaacatcccgcacgattcagttcccgtcggagaaacggaagatgataacattgaaattcgcaagtggggagaggcgccggcattttcatatgagccgaaaccgcattgggatatcgcagaccgcttaaacattcttgatttcgaacgcgcttcaaaagtaacaggcagccggtttgtgttttataaaggattaggcgcccgcctcgaacgcgcgctctacaactttatgctggatcttcacgtggatgaatatgattacacggaagtcattcctccttatatggtaaaccgtacgagcatgacaggtacgggacagcttcctaaatttgaagaggatgcttttaaaatcagagaagaggattatttcttaattccgacggcggaagtgccgattacaaatatgcaccgcgatgaaatcttatccggtgagaacctgccgatcaattatgccgcgttcagcgcctgcttccgttcagaagcgggatccgccggccgtgatacacgcggtttgatccgtcagcatcagttcaacaaggttgagcttgtaaagttcgtgaagccggaagattcttatgaggagcttgaaaaactgacaaatcaagctgagcgggtgcttcagctgcttgaactgccgtatcgcgtcatgagcatgtgtaccggtgatctcggctttacagctgcgaaaaagtacgatattgaggtatggattccaagccaagacacataccgtgaaatttcttcttgcagcaactttgaggccttccaggcaagacgtgcgaacattcgtttcagacgcgaagcgaaaggcaagcctgagcatgtgcatacattaaacggttcaggtcttgcagtcggcagaactgtagctgccatcttggaaaactaccagcaggaagacggaagtgtcatcattcctaaagtgcttcgtccttatatgggaaataaagaagtcatcaaaccataaaaaggtgcgccctagaggcgcgccttttttgctgcccggtatagagcggcggcattccgggctgtactttccaggttaaaacggccggatgctaaggcgtcttcaagacttacagcgccgggcacgatagaaaatacagctgttattcctgcgctgtaaacatgctcaaaatttttgcctaaggagcccgccaatgcgataacgggaatttcttgagcggctgcgcgtgcggcgatcccggcgggggttttgccgaatatcgtttgtccgtcaatctggccctctccggtaatgacaaggtcagcatctcttatctgatctgagaaggacagtgtatctaatacaacgtcaatcccgctttgaatttctgcctgtaagaaagcgatcagtccagcgcccagcccccctgcggcgcccgcgccttttacggtatccgcttcgatatcgtgctgacgtctcaatacgtcagcgaaatggtataaattgcgatccaatacaactttagtcttctcggacgcccctttttgcgggccgaagacatatgacgcgccgttttcaccggtcaggggattttcgacatcacatgcggcacgaaaacggatatgtttcagatcaggggagagcccgcttatatcaatagaagctagggtgtgcagagcgcctcctccgtcatgtatctcctgaccttcctcatttaagaaacgcacaccgagcgcgctcgccattcctgttccgccgtcattggttgcactcccgccaagcccgatgatgatctcactcgccccgcgggaggctgcatccgctatcagttcacccgttcctcttgtcgttgtgttcaacggatctctgagatggcggggaacgagatggagtcccgatgcttccgccatttcaatgactgccgtgcgtccgtctcccagaagtccatatgcggcgtttaccggcgttcccagcggaccggtcacagtttttttgatgatgcttccgccagtggcatccgtcaaagcctgaacggttccttctccgccgtcggccgcgggtatcttggtatattccgcgtcagggaagaccgctttgaatcctttttctatgctgtcagcggcttcttttgatgtcatgctttctttgaaagaatcgggtgcgatgatgattttcattatgttctccacctttatgagcaggttatctgtttgaatctattcttgatttttactttgttttcctgcccgtatggcatactgaggttgaattggacgcaagacttttgtatgatagtaaagctgacggaaaagctgtttaagaaatgaaataaaaaatatgaaaaagcgcttgactgaaatttgggtcatgtggtatattattaaatgtcgatacggaggaatacccaagtctggctgaagggatcggtcttgaaaaccgacaggggtgtcaaagcccgcgggggttcgaatccctcttcctccgccatattgattttaaacctaatgaaactcgagcatatattggagattgttttgtccgctgcatctgatgcagcggattttttatatgcaaaaaaagcgattttctctgttcggggaaaatcgctttgctatttttatttgtttctgttttcgctgatcacgtgactgattttttcgatcaaaggttccagtgactgttcatcagcttcaaggtcataatcttcaatgcgtactttcagtacagggcaggcgttaaaaccgctgatccagtcttcgtaccgtgtatacatctcttcccaataagagcggtttgtctgcagctccatctcgcggccccgcttttcaatccggcttataatgtattcaaggtcgccttctaagtagatcaaaacatcaggatgcgggaaatacggcgtcatgaccatcgcctcaaataggcttgtgtatgttgtgtaatctgtcagcgacatggttcctttatcggcatgcatttttgcgaatatgcctgtatcttcataaatcgaacggtcctgcacgaatccgccgcctgattcaaacatgtttttttgctctttgaaccgctcagccagaaaataaatttgcaaatggaagctccagcgttcaaaatcgtgataaaacttctctaaataagggttttcatccacttcctcaagtgaggtatgaaacccgagccgttttgctaaagctttggtcaaagtcgattttccgactcctaccgttcccgctactgttataatggcgttgtttggaatatgaatgtctttcatttaataagctcctttacctgacgggcaattctttcatagtctgtcttattcaaaacaaagtcttcagtatcaccgtcaatggtcagtacagatatatccggatcttcttcctgaagctgtctgatggctgtgtcgtaatctgcaatgagatgttccagatattgatgttcgatatttttctcaaacgggcgcccgcgtttttcaatgcgttgaagcaatgtcggcaggcttgcctttatgtatacaatgatattcggcttcggcaggtcgtgagtgagcagatgatagatctgcttatacttctcaagcttttggccgtgcaatgtacgctctgcgaaaataacatttttataaatatgataatcggacaaaacgggctgtccttgttttaaataatctcgatcggtgtcttcaagctgtttatacctgtgacatagaaaaaacatttcaagctggaaactccactcctcgatattgtcataaaacttatcgagataagggttgtcttccacaatctcattaatcataggaaaaccgagctcttcagaaagcatcgtagcgagtgtcgtttttcctgccccgataggaccttctaccgcgataaaaggggctctgttcattgaaaatcctccttaattctgcaaacatccgtcagctgccggcctttatattgtatcacactcacagaaaagcccatgaaaaaagacgctcccaattaacgaaacgtctcttttacaatatgaaattgatcgccgagcaaaagccagttttgcgggaaagaaaggccgagtttccaatagctgattcctcttaaatgaagttctttaattaaattgaatttcgcttgaatggatcgtgcgtcttcaaaccatacttcatgccgtctctgatttgcatccgtgtatcggaagaagggagcctgggcggtttcgtcatattgaatgtcgactttatagcgtgctgccagagcgattgcctgctgaggactgacggctttcgctgtcgttccctgtttgaaaggcagtgtccaatcatagccgtacatattctggcccatgacgatttttgaagaaggcatttccgtcagcgcgtactcaatgacatttcttacagggccgataggtgatacggcctcagccgggcctccgctgtacccccactcatatgtcataatcacgacgaaatcgacgatttctccatgtgccctatagtcatgagcttcgtaccatttgccggcctgagtcgcgctcgttttcggagcaagcgccgttgaaatcttccagccttcccgatgaaaaatcgttctcgcttcacgtaaaaaacgattgtaggcttccctgtcctgtggacgtaaatattcgaaatcaaagtgaatatcgcgaaagccgtactttttagccgtggagacgatttcctgaaagagttttgttttcactgtattgtcgttcaagatgagccgcccgagttcatcgctgaatgcgtcattttcaaggttggtgatgatcatcatcagtgtggtgttgtgcctgtcactgatgctttttaaattggtcagaggcggttcctttaaagtcccgttccgctgcacttgaaaactgaatgcgccgaggtatgttaaataaggagaggcctcccttgccgcctgctgaagattagcgcttacgctcgttccccgcggttctatatatgcgtttgattcgatatcgggcttattcgcctgctgcggaatgtaaaggcgggttccgactctcaatgtggtgccgggctgaattccgttcaccctcgcaagctccgcggccgatatatgaaaacggccggcgattgacgcgagagtatcaccttgttttacttcgtaatattgaccctcaatcgggatgacaagggtttgtccgacaaccaatgtattgggattaggcagtttatttgcttccgcaatgacatttgcggctgtccggtagcgcgccgcaatagcggaaagcgtgtcgccccgtttcactatatagatctgaatgaaaaacgcctcctttcatatccgctatcaaatatatgaaaaaaggaggctgatcatgtttatttttcgccggtaatttgtttttccgtggttatttctgcgaagagaacattctccatcatggtcaaagcgaaatcattgtcttcgtcgttattggaagcggtgcagtctttcggaatggcaatgctgtattctctcatataagcgtcgttggccgtgaacagcacacaaatgttcccggcaatccccgtgatgattaatcggttcacttgtaattcggtcagaagggtgtgaagcgccgtttcgtaaaaagcggaatgcttcggtttaatgagaaaataatcatccggctgaggcgaaatatcttttataatggaggcgcttctgtcgttgctgcattcctccctgatggcatcaatatcagccttccagagcccgtaatgatcattaatataaataatcggccagttgctttgttttgcatgcttctttaatgataaaatacgggggacaatttgtttggttttttcagcaagacgttcgcccatatcaaattgaaaattgttgatcatatcgacaatcagaagggctgtgttgttaggttcagacaataccggcaactcctttctgctggggtattcctattttaacctttatgagacatgaaaaaacttaagaagagagctcgaaccgatgaatgatgaatattatatgagagaagccataaaagaagcgaagaaagccgaagagaaaggtgaagtgccgatcggagcagttcttgttctgcacgatgagatcgtggcgcgggcgcataatctgcgggagactgaacagaggtcgcttgcccacgccgaaatgctggcgatagacgaagcgtgccgtaagctggggacatggagacttgaggatgccgttctctatgtcactttggagccgtgtccgatgtgcgcgggagccgtcgtgctttcgagagtcgataaggtcgtattcggcgcatttgatcccaagggggctgtacaggaacgctgatgaacctcttgcaggaagagcggttcaaccaccaagcggaagtggtgagcggcgtgctcggagaagagtgcggagaaatgctcagcgcttttttcagaaagctgcgccggcaaaagaaagacatgaggaaaaagttgtctgagtagtacggttgcattttctgcctgaagcagatatacttatgtgtgcatcatgaatggtgcgcatatcaaaatttgatatttattttgccgtgctaagcggggaggtagcggtgccctgtacccgcaatccgctctagcggggccgaatcccttctcgaggttcgtttactgtaaggtctgccttaagtaagtggcgttgacgtctgggtcctgcgcaatgggaattcatgaaccatgtcaggtccggaaggaagcagcattaagtgaaacctctcatgtgccgcagggttgcctgggctgagctaactgcttaagtaacgcttagggtagcgaatcgacagaaggtgcacggtaaatcaatcatcaaatttcagactcacctgttatggcaggtgagttttttcgtatatgaaaaacgggttttggcgttaaaagcacgttcatgtataataaacatgatgaataacagaggagggcgcatcctgtgggttaccaagctttatatcgagtatttaggcctcagcagtttgaagatgtggtcggacaggaacacattacgaaaacgctgcaaaatgcccttttgcaaaagaaattttctcatgcatatctgttttctggaccgcggggaacgggaaaaaccagtgcagctaaaatatttgcgaaagcagtcaactgtgagcacgcccctgtagaagaaccgtgcaatgagtgcgcggcatgcaaggggatcacaaatggctctatatcagatgtgattgaaatagatgcggcgtcgaataacggcgtagacgaaatccgcgacatccgtgacaaagtaaaatttgccccgtcggccgttacttacaaggtatatattatagatgaggtgcatatgctctctatcggcgcattcaatgcgcttctgaaaacgctggaagaaccgccggcacattgcattttcatattagctacgactgagcctcataagattcctttaaccattatctccagatgtcagcgttttgacttcaaacggattacatccaaagcaattgtcggacgaatgaagacaatcgtcgatgcagagcagctgaaggtggaagaaggagcccttgatatcatagcgagtgctgcggacggaggaatgagggacgcgctgagcctgctcgatcaagctgtatcattcagcggcgaggagctgtcggtggatgacgctttgctcattaccggagccgtttctcagcactatattggaaaactggcatctgctcttcaccgcaaacaggtttccgaggcattggaaacactgaatgaattgctccagcaggggaaagatgcggccaaactgattgaagatatgattttctatttcagggatatgctcttgtaccaggccgctcccggtttagaaggagtcctggagaaggtgaaggtcgatgaaacgtttcggaatctgagcggtgacataccggcccccgctttatatgagatgattgatatcctgaataaaagccatcaggaaatgaagtggacgaaccacccaagaatcttttttgaagtggctgtcgtgaaaatatgccaaacggcacagcaatccgccggagacatccctgaggtcggcatgctgatgaataagatccagcagcttgagcaggaagtagaaaggctgaaaacctccggtgtgaaggttcagatggaaagcgctccgaaagaagctccgcgtcctcaaaaaggcggaaaaagccattataaagccccggtcggaagaattcatgagatattgaaggaagccacaagacctgatcttgaacagcttaaaagcagctggggcaagctgctggcacacctgaaacagcagaataaggtgtctcatgcggctcttttgaatgacagtgaaccggtggccgctgctcaaaaggcatttgtgcttaaatttaaatacgaaatccattgtaaaatggttgcagaagacaataacggagtccgtacgaatcttgaacagattctcgaatcaatgctcgggaaaagaatggatttgattggcgttccggaagcacaatggggtaaaataagagaagaatttttaaatgatcaccagcaggaaagtgaaggatcaaacgaaccggctgaagaagatccgctgattgcagaggcgaaaaaacttgtcggagcggatttaatcgaaataaaagactaataagatgaaagagagtgattgaatatgcgtggcggaatgggaaacatgcaaaaaatgatgaaacaaatgcaaaaaatgcaaaaggatatggcgaaggctcaggaggaacttgctgaaaaagtgcttgaaggcactgcgggcggcggtatggtgactgtaaaagtcaacggccaaaaagaagttgtagacgttgccattaaagaagaagttgttgatccggaagatatcgaaatgcttcaggacctggttcttgctgcgacaaacgacgccctcaaaaaagtggatgacatgacgaatgagacaatgggacaatttacaaaaggaatgaacataccgggtttattctaggggataaataaacatgcagtatcctgaaccaatatcaaagctgattgacagctttatgaaattgccagggatcggaccgaaaacagcggttcgtctggctttttttgttctaggtatgaaagaagacacagtattggattttgctaaggcgcttgtcaatgcgaagcggaatctgacatattgctcgatttgcggacatattacagatcaggacccttgttatatatgtgaggacacaagaagagataagtctgttatttgtgtcgtgcaggaccctaaggatgtgatcgcgatggagaaaatgaaggaatataacggccagtatcatgttcttcacggcgcgatttcaccaatggacggcatcggtccggaggatattaagattccggagctgctgaaacgtcttcaggatgatcaagtgacagaagttattctcgcaaccaaccctaatattgaaggggaagcaacagcgatgtatatatcaaggctgttaaagccctcaggcatcaagctctcccgtattgcccacggtctgcccgtcggcggtgatttggaatatgctgatgaggtcactctttcaaaagctcttgaaggaagacgtgaattgtaagggaggaaaaggcaaggcatgggttttcttcgcagaaatacattaagaaaagagtttgacgagaagctgatagaacagctctttaaacaaaaagaagaatggaacagacagaagagtctggtcgagaaaagtctagagccctccgctgaggtgttgtttgagctgaaagtcgctgaatctaagtactttttttatttgaaagaagcgaagcagcggaatttgaaaatgagcagatggaagtaagaggtctattctccggaatcttctcataagcttgtactaaacaagcgagggggaagattcatggagccttttttcattatcggtttgattgtcggtctggttgctttgctttttttatggggagtatcttcaaaaccgttaaggtggattggtgtgactgccattaagtttattgccggcgcgattctgttggtgggtgtgaacttgttcgggggcagtctgggtattcatatccctgttaacctgattacaacgggcatcagcggaattcttgggattcccggtatcgcggctttgatagtcattaaacgcttcatcatttaatttgtcgattattgttgacatgttggatcaagggtggtattctaatatacgtcgctgatgacgaaacgaattcttgaaaaagaaattttaaaaagttattgacgacaatgacactgagatgttataataattaagtcgcttcaagagcgatggacaaagttctttgaaaactaaacaagacaaaacgtacctgttaattcaaagttttaaataaatcgcacagcgatgtgcgtagtcagtcaaacactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaaggctgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggaattttgattctttcatatggtagatgggcctgtagctcagctggttagagcgcacgcctgataagcgtgaggtcggtggttcgagtccactcaggcccaccatctttacccaatacggggccttagctcagctgggagagcgcctgctttgcacgcaggaggtcagcggttcgatcccgctaggctccaccaacgtgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactagggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctatcattacggtaaaggcagctcatcatgagctgccttttttgtttttgaataaaaacgaaacaaacaccgaaatacgggaacgcccatatactaattgcaaacttcaaaaagatccaaattgtgtatacaatcaacagtttaagggaaggctattcatacggaggtgggcaaaatgaatgaaacgtccggccatgaagaaacatgtattgtgtgtgaaaccaagaaaagcaggggaatccatatttatacgaaatttatatgtttagagtgtgagaagaaagtagtttccactccgacctctgatccgaattatgaatttttcgttcgtaaattgaaaagccttcatacaccgacgttatattcttaaccctgaaaagggtcttttttttgcctgaaatcagaggagttttttcactttttataaaagaactgatacgataagaagaggaacttgtttagacatggaatgtaatagataatactgataaaagtgaataaataggagtcgatcaagtatgaaaccgtttattcaatatatgaaatggacattttgcggcagcacagtttttgtattagcggggataaccttctttacgatagggcaccagccttttctgtattcgcttttatacggggcggccggcggagccgcagtcagtgcgtccggcttgtggaatgcgaagcgtctctttttaaaaaaacaccggctgacaagaaaagaatatgcttatatcaaggaaaatctcgaggaagcaaagggtaaaatcatccgattacgcagggcgcttttccgctctaaaagtatacaaatgctgaagcagaatgcagagatactgcggataacccgacgaatatatctgctcacaaagcaggagccgaagcgtttttatcaggcagagcgtttctattatcaaacgcttgattctgttgtggaactgacggaaaagtatgctttgctctcatcacagccgcgaaaaaataaagatttatcaatgtccttgagtgagacgaggatgactctggcggagctttccagaaggctggaagaagatcttcatgaactgatgaaggaggacatcgacgacctgcactttgaattagatatggcaaagcattcactgagaaaataagaaaggaagaaggaaatggccaaagaccgttccgacgacagtatgggcgcccaaaatgaccagactcatctaaagcttgcagatacgctgccggaagaaaaaagagaagcggcacttcagctcgctgaaaaactggaccctggaaacatgcaaagcattgttctgtttggttcacaggcgcaggcgaatcttctggaattttcccacacgatgatagagcacgtgcaaagaaaagatgcaggagagatgggacagatattggctgatctgatgctgaagcttgaccaggtaaaccccgatgatctgcaggtaaagaacaaagggtttttcgcccggctgtttaaaagggtatccggatctgtgcaggaagtgctttcgaaatatcaaaagacaagtgtgcagattgaccgtatcagcagaaggctggaacattctaaaaatgtgctgttgagtgacaataaatggttagatcagctgtacgtccaaaataaacaatacttttctgatttaactatgtatatagcagcgggtgaattaaaattagatgagctgaaaacaaagcttattcccgaagtggcaagaaaagccgaattacgaaaacacaatcaaatggccgcacaggaagtgaatgatcttcgccagtttgccgaccgtctggataagagggtgcatgatctgctgctgagcaggcagattacgcttcagagtgcgccgcaaatccgtctgattcaaaacacgaatcaggcactggcagagaaaattcagtcctccattgttacggctattcctttatggaagaatcaagtcgccatcgcgctgacgcttatgaggcagcggagtgcggcagatgtgcagaagaaggcggcggatacgacaaatcaattgctgctgaaaaacgccgaacttctgaaaacaagcacagtcgagacggccaaagccaatgagcgcggacttgttgaggcagacaccctcaaaaaagtgcaggaaagcttagtcagcacacttgaagaaatcatgtctattcaagaagaaggcaggatgaaacgcaggcgtgccgaggaggagcttgttatcatggaaggcgatttaaaaaagaagctgcttgatatgagttccggccgggataacggctagatggcaaaaagtcttagctttaagttggctcgcaggcacgatataataagaaagacaggcaaaggatttgtttaaaaatggacacacctttatatacagcgctgatgaagcatgcgcaccgaaatacgtattcttttcatgttccgggacatcacaatggagatgtcttttttgatgaagcgaaatctgtatatcaatctcttttatctattgatatgactgagatcacgggtcttgatgacttgcatcacccgacaggggtcattaaggaagcgcaggatttggtgagcagattgtacggctctcaggaaagcttctttctcgtcaacggaacgaccgccggcaatctggcgatgattttagctgtttgtgaaccgggtgaacccattctgatccagcgtaattgtcacaagtctgttttccatgcggtggcattggccggagccaagccggtttatttggcgccggaaatcgatgaaaatatgcatgtgccggcacatgtatctctttcagtcatcgaaaaagcgctggcgtcatatccgaacgcgaaaggacttgttttgaccaatccgacttattacggacacgccgccgatttgactgcggcagttaaaaaagcccattcatacggtgttcctgtgctggtggatgaggctcatggagctcactttgtgttagggcagcctttcccgccttcatcattggctatgggggcggacgccgttgttcaatcggctcacaaaacgcttccggctatgacgatgggatcttactttcatttaaacagcacccgaattgacagagatcgattaacttattatgtaagcagtttgcaaagcagcagcccgtcatacccgattatggcatctttagatacggcgcgtgcttatgtgcaggatattgctgaaaaagggacacttcccgtccatatggagcacattgagaaaatcaaacgaaggttcgcatcaatttcttctattgaaataatcgagccttccggatatgggctgcgggcggacccgttaaaattaatacttcggtcaaagctcggacattccggctattcattacaacgcattttggagagtgagggcattgttgccgagctggctgacgagtaccaagtattgctcgtactgtcgataggcggccggcggatgatagaacaggcagccgtaagaaacatacagcagaaactggagaatacaccgcccgataaattgccggatgccgtgaattggacatttccgtccatttcgacacttgaatatccgcaaaatgagatgcggaagtttacaaaagagcctgcagatataaataaggcggccgggcgcttgcatgcggggaacattattccttatccgccgggaattccgctgatcatggacggcgaacggataacagaagagatcgtacagaagctttcccgtttaatcggcatggacgcgcatattcaaggcttgttaaacggggaacaattacttgtctatatagaagaggagaaatcatgagcggtttatttataacatttgaaggtcctgaaggtgcagggaaaacgactgtgcttcaggaactgaaagagattctgtcggcagaggggctcccggtgacagcgacaagagaaccgggcggcatcgacattgcggaacagatcagagaagtgatcttaaataaaaacaatacactgatggatgcaaaaacggaggcgctgctttacgccgcggcgagaagacagcatttaaccgaaaaggtgcagcctgcattgaaagaagggcgcattgtgctgtgtgatcgtttcatcgacagttcgctggcttatcaaggctatgcgagagggctcggcattgatgaagttctttctattaaccagtttgcaatcggcgatacgatgcctgatgtcaccatctatttttctattgagcctgaagaagggttgaaacggattacgtcgaatgattcaagagaaaagaatcgtctcgatcttgaggctctgcactttcacacgaaagtacgggaaggataccaaaaggttatgcagcgttttccggaaagattccatacaatcgacgcatcgaaaaagaaggaactcgtcattcaggacgcacttcaagtgataaatgaagcattgaaaaaaattcagttgtgacctgtttctcataagttgctataatgaatgtaacgacaatgttctttccaacctaaagggggcctagagaatgaaattaatagtggcagtggtgcaggatcaggacagcaacaggcttttgaaagtattaaccgaccacaacttcagggtgacgaagcttgcgacaacaggcggattccttaaatcaggcaatacgacgtttatgatcggggtggaagatatccgtgtcgataaagcgctcagcctcattaaagagaatggctgtaaacgtgatcagatgattgccccggtatccccgatgggcgggaatgcggattcctacgttccatatcccgtcgaagtggaagtcggcggagcgacggtctttgtcctcccggtcgatgaatttcatcaattttaaggatttgacgacgtgaaaataaattctgacttacgtacatttattgagaaaaagcagcagcctgcttataaagcggcagagctttccggaacgtttaaaagttcaatggacagccaaagcagcaagctgaaatttgatcagctgagcaggttcttaacggatatagaaacgttcgggaaaaggctgacgaagtcgagaaacttcaaagacttagcgaagttcaaaggattggtaaaacgttttgtaaaagaggccgtagacagcggattatcgcatgagacggagaaaagctttgacttgtacggcagcagccggaccctggggcttgtgaaagaaatagatgaaaaactgcttcagctgacggaagaaatgttagatcaggaaaaaccggcaattgatttgctggatcgaatcggagaaataaaaggtttattgattaacctttacacatagagagtgatacaatggcaatatcatggaaggaaatgaccgggcagcagcccagagtgatgcggcttttgcataacagcattgaaaagaaaaggctttctcacgcatatctgtttgaaggcaaaaaaggtacgggcaaattggatgccgcactgcttctcgcaaaaagctttttttgccttgaagacgggactgagccttgcggagagtgccggaactgtaagcgtatcgaatccggaaaccatcccgacctgcatgtggttcagcccgacggattatccattaaaaaggctcagatccaatcgcttcaggaagagttttccaaaacggggctggaatcgcataaaaagctgtacattatatcccatgcggatcaaatgaccacaaatgcggcaaacagtctgctgaagtttttagaggagccgagtcaagacaccatcgcaattctgattactgagcagctccaccgaatactggataccatcgtttcgagatgtcaggttctcccgttccagccgcttcagccgaaagccatagaagaaagactgattgaacaggaagtgagccctcacatggcccggctcttagcaaatatgacaaataatattgcggaagcagtcgaattaagtcgaaatgatgagtttgcagagtccagagcgaaagtgataaaattgtatgaagtcttacatcagcggaaaggacatgcctttttcttcattcaggatcagtgggtgccctttttcaaagaaaaaacccatcaagaaatgggtcttgatatgctcttattgatataccgtgatgtattatccatccaaattggaaatgaagataaactgatttatcaagacttattccaatcaataaaacagcatgcgctgcaatttacacaacaaagcgttacgaaccaaattctcgctgttttagaagcaaaaaaacggcttcattccaatgtgaatgtgcagggattaatggagcacttggtgttaacgttgcaggagggataagcttgtacaacgtaataggcgtccgctttaaaaaagcggggaaaatttattattttgatccgaatggatttgatatagaacaagacagctgcgtcattgttgaaaccgtaagaggtgtagaatacgggcaggttgtcatcgcaaataaacaagtggacgagcatgatgttgtgcttccgcttcgaaaggttattcgcgttgctgatgaacgcgatcttctcattgtagaagaaaacaaacaggaggccctgtccgcttttgaagtctgtcagaaaaaagtggctgaccacggcttagatatgaagctggttgatgttgaatttacgtttgaccgcaataaagtcattttttactttacggcagacggacgggttgatttcagggaattggtcaaagacttggcttctatctttaaaacgagaatcgaattgcgtcaaatcggggtaagggacgaggcgaaaatgctcggcggtatcggaccatgcgggagaatgctttgctgctccacgttcctcggtgattttgaaccggtgtccatcaaaatggcgaaggatcaaaatttatcgttgaacccaacgaagatttccggtctgtgcggccgtttgatgtgctgtttgaagtatgaaaatgatgagtatgagacggcaaaagaacagctgccggatttaggcgaaatgattacgacggcaaacggccccgcaaaggttgtcggtcttaatattctggaacgggtgcttcaggtggaactgaagaatcgtgaaaaagtgatagaatatacttgggaagagctcttggaagagggcgtcgtatccgcacaaaccacagattaacgaggtgtggaaccttggataaaaaagagttatttgatactgtcataaacctggaggaacaaatcggttcgctgtaccgtcagctgggtgacttaaagcagcatatcggcgaaatgattgaagagaatcaccatcttcagcttgaaaataagcatttgcgtaagcggcttgatgacacgacggagcaaattgagaagttcaaagccgatcagaaagaaacaaaaacacagaaggcagagcagagtgatataggagaagggtacgacaatctggcccggctgtatcaagaaggctttcatatttgcaacgtccattatgggagcgtccgcaagggagattgccttttttgtctgtccttcttaaataaaaaataaggaaaaggcttccgctgatgtcggaagcctttttcaaagagtgccgaaaggaataagattatggtttcattacgtgatgatgaaagattggattacttattagcagaggatatgaaaatagtacagagtccgacggttttcgctttttcattagatgccgtgctgctgtctaagtttgcatacgttccgattcaaaaggggaacattgttgatttatgcacggggaacggcattgtgccgcttttgctcagcacaaggtcaaaagccgatatcaccggagttgaaattcaggaacgcttgtatgatatggcgcttcgaagcgtggaatacaacgggctgggcggtcagatcagtctcattcatgatgatctgaaaaatatgccggaaagactcggacataataaatatgatgttgtcacctgcaatccgccttattttaaaacaccgaaagaggcggagcagaacctgaacgagcatctcagaatcgcaaggcacgaaatcctttgcacgcttgaagatgtgatttccgtcagcagcaaactgctgaagcaaggaggaaaagcggctctcgttcatcggccggggaggcttctggaaatctttgaactaatgaaagcataccgaatagaaccgaaacgggttcagtttatttatccgaaacaaggtaaagaagcgaataccattttggttgaaggaattaaaggcggccgccctgatctcaaaattcttcccccgctctttgtatataatgaacaaaatgaatatacgaaagagatccgcacgattttatatggagacaaatagtcatttcttttatgtgctgctgtgcaatgacaacagtctgtatgccggttatacaaatgatctgcaaaaacggctgaaaacccacaatgagggaaagggcgcgaaatatacaagggcgagaaggccggtttcgttatgccatgcggaatcatttgaaacaaaacgggaagcgatgcaggcggaataccgttttaagcagctgacccgaaagaaaaaagagcaatatatagaagaaaaacgacgcagcaaggaggctgtatatgttaagacgtcagatgagttttaacggaaaatctgaaatgggaactctgtaccttgttcctacaccgatcggcaatttggaggacatgacctttcgtgcagtagagacgctgaaatcggccgatgtcatagctgccgaagatacgagacagacgaaaaagctgtgccatgtttatgacatagaaacatctctcatcagctatcatgaacataataaagaaagcagcggccataaaatcattgaatggctgaaaagcggaaagaatgtggcattggtcagtgatgccggtatgccgacaatttccgacccgggggctgagattgtgagagatttcacccaaatcggcggatatgtcgttccgcttccgggtgcaaatgcggcattaaccgcgctgactgcatcagggatcaccccgcagccgtttttcttctacggattcttaaacagacaaaaaaaagaaaagaagaaagaactcgaaatcctgaaaaaacggcaggaaacgatgatattttacgaagcgccgcacagattaaaagaaacattaacagcaatgcatgacgttttgggtaatcgaaccatcgccgtcacgagggaattaacgaaaaagtatgaggaattcatcagaggaaccatcgccgaggtgcttgaatgggcaaatgaagatcaaatccgcggtgagttttgtctcgttgtcgaaggcaatcaaggcgctgaaccggatgaagaggaaaagccttggtgggcggagctttctgagaaagaacatgtggagcattacataaatgaaggatcttcttccaaacaggccataaaacaaacagcggtagatcgggacgtaccgaaacgcgagatttatgacgcttatcacattcaatcataaaaaaaaccgttcttgtgtcataacaagaacggtttttgtatgaaatagcttatttttggttttgaagctggttttgaatttcagagatgatttgctcagcgccttctttgctgagtaccaatttgccgccggcaagtttaaggttatcatcagaaacttcaccagttacttggcaagtcatgtttggtttatattttttaaggatgattttttcatcatcaacataaatttcaagagcgtctttttctgcgatgcccagtgtacggcgaagttcgatagggataacgacgcgtccaagttcatcaactttacgtacgataccagtagatttcattaacagtctcctcccgagagataattatttgtagtttatatttttcttcgtcattattcgacaaaattccttacattcctagcataacaaggtttccaataatcgtcaatctttttgtttgctattgtttgtaagaattagttcttatagtaagtaaagccttggaaatcctgaaataacaggctttttgactgctttttcgaacctattatcctactgaaaatccttttaaatcaagactttcgaaccaagatgttttatattagtagattatatacgacaaatttcgacatgttaagactttttttaatttcaataaaaatttttaattttatttactcttttacgcgcagtacgtatatatccttgatcttaaaggctaagatggtatcatagatagaggacaaatatcaatattgtatatcaaataaaaccgctctcgtcctttgggcgtgagcttttcgacattctgaatgggaggttgcaacatgccgcaagacaataatactttttatattacgaccccgatatattatccgagcggaaaattacatatcggccatgcttatactaccgtggcaggcgatgcgatggcgcgttacaaaagattaaaaggatttgacgtacgctacttaaccggaacggatgagcacggacagaaaatccagcagaaagcggaggaagagaatatcacgcctcaagcttatgtggatcgcgcagttgctgaaatccaaaagctatggaagcagctcgacatttctcacgatgatttcatccggacgacggaaagccggcacaaagaaattatcgagaaagtgtttcaaaaacttcttgataatggtgacatttacctggatgagtatgagggctggtacagcatccctgatgaaacattctatacggaaacacagctggtggatgtggaacgaaatgagaagggtgaggttgtcggcggaaaaagccctgacagcggccacccggtcgaattaatcaaagaggagtcatacttcttccgcatgagcaaatatgcagaccgcctgctgaagttttatgaggaaaatccttctttcatccagcctgaatcacgcaaaaatgaaatgattaacaacttcattaaaccggggcttgaagatttggccgtttccagaacgacgttcgactggggcgtaaaagtgccgggaaatccgaagcatgtcgtgtatgtatggattgacgcactgttcaactatattacagcgctcggttacgatacggaaaatgatgagctttacaaaaagtactggccggctgacgtccaccttgtcggtaaagaaattgtccgttttcataccatttactggccgattatgctgatggcgcttgatctcccgctgcctaagcaagtattcgcgcatggctggttattgatgaaagacggaaaaatgtcgaaatcaaaaggaaatgtcgttgatccggtaacgttaattgaacgctacggcttggatgaacttcgctattacctgcttcgcgaagtaccgttcggttcagacggtgtctttacgccggaaggtttcgtagaacggattaattatgacttggcgaacgacttaggaaaccttctgaatcgtacagtcgcaatgatccaaaaatattttgacggcgagattggttcatatgaaggaaatgtgaccgattttgattcagagctttcttccgtagccggtgaaacggttaaagcttatgaaaaggcaatggaaaacatggagttttcagtagctttatcaacgctatggcaattaatcagccgtacgaacaaatatattgatgaaactgctccgtgggtgcttgctaaagatcaggaaaaagaaaaagaattacgttctgtcatgtatcatttagctgaatcattgcgtatttcggccgtattgctacagcctttcttgacgcagacgcctgaaaaaatgttttcccagctcggagttgaggatcagtctcttaaagcttgggacagcattcagacattcggccaattgaagaatgtgaaagtgaaaaaaggggaaccgcttttccctcgtcttgaagctgaagaagaagtagcttacatcaagcaaaaaatgcaaggaactgctcctgctaaagaagaaaaggcggaagagccgcaagaagcagagcgtcttcctgaaattacgtttgatcaatttatggatacagaacttcgcgtcgcagaagtcttgtccgcggaaccggtgaaaaaagcagatcggctgctgaaattgcaaattgatctgggctttgaacagcgccaagttgtatcaggtatcgcgaagcattacacaccggatcagcttgtgggaatgaagatcatctgtgtaacgaatttaaaaccggtaaaactgagaggcgagctttctcaaggaatgatactggcgggagaatcggacggcgttctcaaagttgtagctgtcgaccagtcattaccgaaaggcactcgaattaaataataggggcaaaaggtgtttcacgtgtaacattccgtcgaacaccttttgtttttcaacaagaaaggagtttttatgatgctttttgatacacatgcgcacttaaatgccgagcaatttgacacagacttagaggaagtcattgcgcgtgcaaaggctgaaaaagttgaacgaattgtcgttgtcggattcgacaaacccactatcacgcgtgcgatggagctgattgaggaatatgactttatatacgctgcgatcggctggcatccggtagacgcaattgacatgacagaggaagatttatcatggattaaggaactgtcctctcacgaaaaagtcgtggcgatcggagagatgggccttgattaccactgggataaatcaccaaaagacattcagaaagaagtattccggaaacaaatcgctctcgccaaagaagtgaaccttccaattatcattcataatcgtgatgcaacggaagatgttgtcacaattttgaaagaagagggagcggaagaagtcggcggcattatgcactgctttacggggagcacggaggttgcacggcagtgtatggatatgaatttctatatttcattcggcggaccggttaccttcaaaaatgcgaagaaaccaaaagaagtagcaaaggaaattccgaatgaccgtttgctgattgaaacggactgtcctttcctgacaccgcatcctttccgcggcaaacgaaatgagccaagctacgtaaaatatgttgctgaacagctcgctgaattaaaagggctgacatatgaagaaattgcctcaattacaaccgaaaacgcaaaaagacttttccgcatgaactgacagaatgcgctgtcataacgtgtaaaagcttgtccgattcagtggatatgtaaaacggttctacaagcttccttctcctcataagataggttgtcgatatgtctctcttcctttttttgctttgtttttgcataatgagggatacgctgaaggtttttcatcttcgagatgggagggttgacagcattttagatactctatataatctctccgaggagaaggaggcgtttttcatcacacaaaaaatgaaaaaactgttttccgtaaagcttggtaaaagcaaggttattctgattgcagctattattctgctgggcggaaccgggactgcatacggggcacatgagctctcaaaacaatcagtttctgtttccatcaacggcaagaaaaagcaaatacgcactcatgcaaaaacggttggggaacttctggaagatttacatatagagacgagaaatgaagaccggattaccccgtctaagcagacagcattggcagacaacatgaatgtcgtgtatgatgctgcaaagcagatccgtgtgacaagaggcggagaagaaaagactttatggtcaacggcaaaaacagtcggcgcatttctgaacgaacagcatacacctgtgaatcagcacgataaaatagatccagcagcagatacgaaagtgacaaacggcatgaaagtcacggtcgacccggcttttcaggtcactgtaaatgatgcgggaaagaaaaagaaaatatggacgacttcgactacggtcgctgactttttaacgcagcataagatggacatgaaagacgaagataaagtaaaaccggcattacacgaaaagctcacaaaaaatcaggccggcatacaaatcactcgtatcgaaaaagtcaccgatgtagttgaggaaaaaatagcgtatcaagtgaaagaaaaagaagatgcgtctctcgacagcgggaaagaaaagatcgttcaaaaaggaaaagaaggcaaacttaaaaagcattttcatgttgtcaaagaaaatggaaaagaagtatcaagaaagcttgtcaaagaagaaacatctgaaaaaagcaaagatcagatcattgcggtcggcacaaagcggcacagtcccaagattgagcagctcagtgcacctgtgaaggcatcttcgggcgaaaccggatcttccggtaaagtgattaccgtgtcttccacggcttataccgcaagctgcagcggctgttccggccaaacggctacaggcgttaacctgacaagcaatccgaatgccaaagtcattgcggtagacccaagcgtcatcccgctcggcacaagagtccacgtagacggatacggggatgccgtagccgctgatacaggctcagccattaaaggaagacggattgatgtctttttccctgaaaaatcttcagcttaccgctggggaaagaaacaggtcaaaataaaaatcttaaattaattccgattcattcagagggttttgcgccctctgtttttttcgttataataggtaaagtgtattttcagtatattagacgtgacatgcaagcaaaggtttcgttttggatataaaaagtttttttggaggaagtaatgaaaattaaagaaattatagtagtcgagggacgcgatgacactgcgcgcataaaacttgccgttgatgcggatacgatcgagacaaacggttccgcaatcggagacgaagtcatcaggcagattcggctggcgcaggaaacgagaggggtcatcgtgctgacggacccggattttccgggggagaagatccggaaaaccatttctgaagcagtacccggctgtaaacacgcatttctgcccaaacatcttgccaaaccgaaaaacaagcgcggcattggcgttgagcacgcatccattgaaagcatcagagcatgtctggaaaatgtgcatgaagagatggaggcaaagccgagtgaaatttcagctgaagatgtcatacaggccggtctgatcggcggaccggctgccaaaagacggcgcgaacgattgggcgacctgctgaagatcggctatacaaacggcaagcagcttcaaaaacggctgcaaatgtttcaaatcaaaagaagtgattttattgatgcgctcgatgctatgaggcaggaggaacaggatgaacaataaagatatcgcgacacctatcagaacgaaggaaattctgaaaaagtacggtttctcttttaaaaagagtctgggacagaatttcttaattgatacaaatatattggacagaattgtggaccatgcggaaattacggatcggaccggagtcattgaaatcgggcccggaatcggcgcgttgacagagcagcttgccaaacgggcgaaaaaggtcgtcgcgtttgaaattgatcagcgtctgctgcccattctcaatgatacgctgtctccgtatgacaatgtaacgatcattcatcaagatgtgctgaaagcagacgtcaaatccgtcattgaagagcagtttcaggattgtgatgaaattatggtgacggcgaatctcccatattatgtgacgacgccgatcatcatgaagcttttggaagaacatcttccgttaaaaggaattgtcgtaatgctgcaaaaagaggtcgctgagcggatggccgctgatccttcctctaaggagtacggatcgctttccattgcggttcagttctatacggaggccaaaaccgtcatgaccgtaccgaaaacggtgtttgtgcctcagcctaatgtcgattccgccgtcatccgtctcttgcttcgtgacggcccggcggttgacgtcgataatgaaccgtttttcttccagctgattaaagcaagcttcgcacagcgccggaaaaccttgctgaacaaccttgtgaacaatcttccgggcggaaaagagaaaaaagctcaaattgaagaagttcttcaagaaacgaatattgatggaaagcgacgcggtgaatccctgtccatagaagaattcgcgctcttgtccaacggattgcataaagcccttttctaagagggctttttgttttgcgtcaccacttggactgccgctacataggctagaggagaaccttattcattcaactgcaagaaaagcttgaaacatcaagcgccgcagcggaaagaggtgcatttgccaagacttctttcatgatgaggcttagtctatttgtggagtgggtaacgtgcaatttcaaataggagatatggtagccaggaaatcctatcaaatggatgttttatttcgcattatcggtatagagcaaacaagcaacggaaattcaattgccatcctgcatggtgacgaagtcagattgattgcggatgctgatttttctgatttggagcctgtcagaaaagacgaacaggccatgagaaagaaaagagatgaaagcaggatgaatgaatctctcgagctgctccgccaggattataagctgcttcgggaaaaacaggagtattacgcgacaaatcaatatcagcatcaggagcactactttcatatgcccggaaaggtattgcatctggacggcgatgaggcctatttgaaaaagtgcctgaacttttatgaaaaaatcggtgtgccggtatacggaattcattgccatgagaaaaaaatgccggcgtcaattgacgagctgcttgataaatacaggccggatattttagtcatcaccggccatgatgcatattccaagcataagggaggcgtgaacgatttaagcgcctacaggcattccaaacactttgtcgaaaccgttcagagagcgaggcgtaaagtccctcatttggatcagctggtcatattcgcgggggcgtgccaatctcattttgagtctttaatcagagcgggcgcgaatttcgcaagttcgccgtcacgcgtcaatattcatgcgcttgacccggtatatattgtcgcgaaaatcagcttcactccgtttatggagcggatcaatgtatgggatgtcctgagaaatacgctgacgagagagaaagggctgggaggaattgaaacgaagggtgtgctgcgtgtcggtatgccgtataaatcaaatggatgagtgataaaacccgcatatatttcgctatgcgggttaattattttacatattgatacataaatttccggaacttgtgaaaaataacgcagaaatcaatagaattttgtcaaaataattttgttgacaatgacttattaacgttgatataatttaaattttatttgacaaaattgggctcttgttgtacaataaatgtagtgaggtggatgcaatggcgaagacgttgtccgatataaaaagatcgcttgatgggaatttaggtaaacggcttacgttaaaagcaaacggcggccgccgaaaaacgattgagcgttcgggcattttagctgagacgtacccttctgtttttgtgatacaactagatcaagacgagaattcgtttgaaagagtttcatacagttatgctgatattctgactgagactgttgaattgacattcaatgacgatgcggcaagctcagtagcattttaatgggcagtgaaccttttgtttactgctttttgttttgccttctaaagctcttctaattattccctcgaaagtttcagccgattaaacggaagctataggtgtcacatgttttatcgtggcgtgcacgaatggtgatcaattctataaaaggggttgtttcgtttgggcagacgtcgtggagttatgtcagatgagttcaaatatgagctggcgaaggaccttggtttttacgatacggtgaaaaacgagggctggggaggcattcgggcgcgtgacgccgggaatatggtaaagcgcgcgatcgagattgccgaacagcagatggcggctcagaaccaaaataaccgataatgcagtggcccgggggacaatccgttccccggttttttctatcggctgtcaaaaccggcgtcaatttcggataagtacctccgggtctccaaatgtgatacaatgttcatacttatgtttagatggagaagtaggtgaaagctatgcgtattttagaaaaagcgccggccaaaatcaatctgtccctcgatgtgacgagtaaacgcccggatggttatcacgaagtggagatgatcatgacgacaattgatttggcagatcggattgaactgacagaactgcccgaaaacgttatcagagtggcgtcgcataatcgctttgttccggatgatcaaaggaatctggcttatcaggcagccaaactgcttaaagaacggtttcaagttaaaaaaggcgtttcgattatgattacaaaggtgatccctgtagcggcagggcttgccggcggaagcagcgatgcggcagctacgctcagagggctgaacaggctttgggatttaaagctttctgtcgaagagcttgcagagcttggagctgaaatcggttcagacgtgtccttctgtgtatacggaggcactgccctggcaaccggacgcggtgagaagatcaggcacatcagtgctccgcctcattgctgggtcatgctcgccaaaccgacgatcggggtatcgactgccgaagtgtaccgccggctgaacttacagcaggttcggcatcctgatgtgcaggcgatgattgacgcgattgaagaaaaaagcttccaaaaggtatgcggacaattaggaaacgtattggagtcggttacgctcagcctccatcccgaggtggcgatgattaaaaatcaaatgaaacgcttcggcgctgatgcggtgttaatgagcggaagcggaccgactgtattcggtttggttcaatacgaatcaaaggtgcagcggatttataacgggttaagaggtttctgtgatcaagtgtacgcggtgcggatgatcggcgaacagaatgctcttgattaaatccgtatgttaagttatattatttttaaattattcggattttgggggtaagttcatgaagtttcgtcgcagcggcagattggtggacttaacaaattatttgttaacccatccgcatgaattaataccgttaacgtttttctcagaacggtatcaatcagcaaagtcatcaatcagtgaagatttaacgattattaaacagacctttgaacagcaaggcattgggacgctgcttacagtgccgggagctgccggaggcgtcaaatacattccgaaagtgaaacaggctgaagcagaagcgtttatacaggagctgggacagtctttagtaaatcctgagcgtatccttccgggcggttatgtatatttaacggatatcttaggaaaaccatctgtcctctctcatgtaggcaggctttttgcttccgtttttgcggagcgggagattgatgtggtgatgaccgttgcgacaaaaggaatccctcttgcttacgcagcggccagttatctgaacgttccggttgtcatcgtacgaaaggacaataaagtgactgaaggctccacggtgagcatcaattatgtatcaggatcgtctaaccgcattcaaacaatgtcgcttgcgaaaagaagtttggctacgggttcgaacgttttgattattgacgactttatgaaagccggcggcaccattaacggcatgatcagcctgcttgatgagtttaatgcaaacgtcgcggggataggcgtcttggttgaagccgagggagtgaatgaacggcttgtcgatgaatacatgtcactgctcacgctttcaaccatcaatatgaaagacaaaacgattgagattcaaaacggcaattttctgcgattttttaaagaacagcatttaaagaatggggagacagaaaaatgactaaagcaatccatacgaaacacgcgccggcagcgatcgggccatattcacagggaatcatcgtaaacaacatgttttacagctcaggccagattcctcttactgctgaaggagaaatggtaaacggtgatatcacagaacaaacgcatcaggtgttcagcaatttaaaagctgtgctgaaagaagcgggcgcttctctcgagacggttgtcaaagcaacggtatttattgctgatatggagcagtttgcggaagtgaatgaagtgtacggacaatactttgatgtacataagccggcaaggtcttgtgtggaagtggcgagactgccgaaagacgctctcgtggaaattgaagtcattgcgctggtaaaatcttaaatctcagaaaagtggttccggtctccgggatcactttttttatgcagtatatgatccccaaatatggtttatcacctaattgtgtatgtatatcctatattttcaaaaaaactttttgaaacgtgcaggaatttaaaaagaatcgtggaattgttagactaatgcttttatatagggaaaaggtggtgaactactgtggaagttactgacgtaagattacgccgcgtgaataccgatggtcgcatgagagcgattgcatccatcacgctggatcacgaatttgtcgtacatgatattcgtgtgattgatggaaacaatggtcttttcgttgcgatgccgagtaaacgcacccctgatggagaattccgcgatattgctcatcctattaattccagcacgcggggcaagatccaggatgctgttttaaatgagtatcatcgtttgggtgattctgaagcattagaatatgaagaagccggggcttcttaaacataacaaaatgtaaggactgctgataaaggctgacacaaggccttttccggcagtccttttttaaatctgatttttcagtaataaagcgattacatagaaaattcttgcactttttgatgtcttcttgaaatcaacagctatttaggatatatttttctatggataaaagggatattggaggccattaaatggataagcggtttgcagtgattttagctgccggaaaaggaacgagaatgaaatcgaagctttataaggtccttcatccggtatgcggaaagcctatggtagagcacgtcgcagacgaagctctgaaattatctttagcgaagcttgtcaccatcgtaggacacggcgccgaagatgtgaagaagcagctcggacagaaaagcgattacgctctccaagcagaacagctcggtacggctcatgcggtcaagcaggcaaaaccatttcttcacggagaaaagggtgtcacgatcgttatttgcggcgatacaccgcttctgacggcggagacgatggaagccatgctgaatgaacatacagacaaaggtgcaaaagccacggtgttaacggccgttgccgacgatcccgccggatacggaagaatcatccgcagtgaagacggcgccgttcaaaaaatcgtggagcacaaggatgcttcggagcaagaacgtcttgtgaaagaaatcaacacgggaacgtactgttttgataacgaggctctttttcgtgtcatcgaacaggtttcgaatgaaaatgcccaaggcgagtattatctgccggatgtgatcgaaatcctcaaagacgaaggcgaaactgttgccgcttaccagactggtaacttccaagagacgctcggagtgaatgatagagtcgctctttctcaggctgaaatgtatatgaaagagcgtattaacaaacggcatatgcagaacggagtcactttaatcgatccgatgaatacgtacatctcacctgacgcgcgtatcggacaagatacagttatttatcccggaactgtgttaaagggacaagctgaaatcggcgatgaatgtgtcatcggccctcacactgagatagaggacagttcaatcggcagccgcactgtgattaaacaatccgttgtcaaccgcagcaaagttgggaatgatgtaaatatcggtccttttgctcacatcagacccgattccgcaatcggcaatgaagtgaagatcggaaactttgttgaaatcaagaaaacacaattcggcgaccgaagcaaagcatctcatttaagctatatcggtgatgccgaagtgggcacggatgtgaatctgggctgcggctccatcacggtcaattatgatgggaagaaaaaatatttaaccaagattgaagacggcgcttttataggctgcaactccaatctggtcgctcctgtcacagtgggagaaggcgcgtatgtcgctgcgggttcaaccgtaactgaagatgtgccgggcgaagcgcttgccattgccagagcaagacaagtaaataaagaagattatgtgaaaaatattcataaaaaataatcctaaaatcggaggtttaccatgtctaacgaatacggagataagaatttaaagattttttctttgaattcaaatccagaacttgcaaaagaaatcgcggataatgtaggggttcaattaggaaagtgctctgttacaagattcagtgacggagaggtccagatcaacatagaagaaagtattcgcggctgtgattgctatatcattcagtctacaagtgcgccggttaatgagcacattatggaattgctgattatggttgacgctctaaagcgcgcttccgcgaaaacaatcaacattgtgattccgtactacggttatgcgcgccaggacagaaaagcaagatcacgtgaaccgattacggcaaaactttttgcaaacctgcttgaaacagcgggtgcgacacgcgtgattgcgcttgatttacacgcgccgcaaattcaaggtttctttgatattccgattgaccacttaatgggtgttccgattttaggccattactttgaaggtaaagacttgaaagatatcgttattgtttctcctgaccacggcggtgtgacgcgcgcccgcaaacttgcggaccgtctgaaagcgccgatcgcgattatcgacaaacgccgtcctagaccgaatgaggtagaagtgatgaacatcgtcggtaacgtggaaggaaaaacagcgattctgatcgatgatattattgatacggccggcacaatcacacttgccgctaacgcgctggttgaaaacggagctgcagaagtgtatgcatgctgtacgcaccctgtattgtcaggccctgccgttgagcggatcaataactctaaaatcaaggagcttgtcgtaacgaacagcattaagcttcctgatgagaaaaaaatcgaccgctttaagcagctttctgtcggaccgcttctggctgaagcgattatccgcgttcacgagaaacaatctgtcagctatttattcagctaaaccgaaactttaaggtttaaatcccagttattgtgggtattgttctaataggacgataaaacgataattaggatggtgctgaatatggcaactttaaaagcaaatgaaagaacagattttaaacgttcgacgcttcggaaaatccgtcattcaggacatgttccagggattatatacggtaaagaaataacgaatacgcctgtctctttagacagtgtcgaattgcttaaaacattgcgggacgaaggaaaaaacacgattatcacaattgatgtcaacggaaatcagcaatcggttatggtgactgatcttcagacagacccgctcaaaaacgaattgacgcacgccgattttcaagtcgtgaatatgagtgaggagctcgaggccgaggtgccgattcagctgacgggagaggcgaaaggagtcaaagacggaggcgttatccagcagccgctgcatgagctttcgatcaaggctaagccgaaggacatccctcagacaattaatgttgatatttccgggcttgaaatgaatgatgtgctgaccatcgcagatctgactgctgacggcaattatacatttacaaacgacccggaagaagtcgtggcttccatccttcctcctaagcaggaagcattcgaagaagatgcagaaccgtctcctgaggaagagcccgaaggagaaaatcaataagcgctttaagacgtaacccgcccgaggttacgtcttttgtgctagaatgagaagaattacagcgatgttgagggaggatttacgatgcttgtgattgccggtctcggtaacccgggaaaaacctatgagaacacgaggcataatgtcggctttatggccattgacgagctttctaaagaatggaatattgaactgaataaaacgaaattcaacggactttacggaatggggtttgtttccggaaaaaaagttctacttgttaaaccgcttacatatatgaatttatcaggagaatgtttgcggccgctgctggattattatgatgccgatcatgaagatctgaaagtcatatacgatgaccttgatcttccgacgggaaaaatcaggcttcggacgaaggggagcgcagggggacataacggaattaaatcgcttatacagcacctcggaacccctgaatttgaccgggtcagaatcggaatcggccgccccgttaacggaatgaaagtcgttgactatgtactgggagcttttacgaaggaagaagcgccgcatatcaatgatgccgtctcaaaaaccgtaaaagcctgcgaagcttccttaacgaaaccatttttagaagtcatgaacgaatttaatgcaaatgtataagataaataatgggagaccatactagggaaaaatgattttttcacatcaggaggtccaacgtatggctttgcattatttctgccgccactgcggctttaaggtagggagcctggaatattcaacggtgccgacacagtcacttggatttcagcacttaacaaatgaggaaagaaacgatatgatttcatataaagacaatggagatgtccatgttcttacaatttgtgaagactgccaagaggcgctggaacgcaatccgcactaccatgaacacaacacatttattcaataagaagctttggtgtagattctagaccaaagcgtttttctgttcttgcagaaaatagagaggagggcccatatggacaacattcaaacctttattaaagaaagcgatgattttaaatccattgtcaacggtttacatgaggggctgaaggaacagctgcttgcgggtctgtcaggttccgcgcgttctgtttttacctccgcccttgcacaggaaacgaaaaggccgattttctttatcacccataatttatatcaggcccaaaaagtgacggaagatctgacggcgcttctcggggatcaatctgtttttttataccccgtgaatgaattgatttcttcagaaattgcggtagcgagtcctgaactgcgcgctcagcggcttgatgtcattaatagattaacaaacggagaagcgccggtcgttgtggcgcccgttgcggcagtgagaagaatgcttccgccgaaggagctgtggaaaagcagccagctcgtcatttcactcggagacgatatagaaccggatcagctgtccgcgcgccttgtagaggtggggtatgagcgttccgatatggtttctgcacccggtgaattcagtattcgcggcggaattatcgacatttatccgctgacgtcggagcatccggtgcgaattgaactgtttgatacggaggtcgattccatcagaagcttcaattctgatgaccagagatcaatcgagacgctcaaacatgtggcgatcggaccggcgaaggaattgatcatcagggcggaagaaaaagcccgggcaatggaaaggctcgataaagggcttgccgacagtctgaaaaagctgaagcaggacaaacaaaaggaaatgcttcatatcaatatctcacatgataaagaacggttatcaacgggacagactgatcaggaacttgtgaagtatctctcgtacttttacgaaaaacctgctagtttgctagattatacaccggcagacacgttgttattgttagacgaggtcagccgcattcatgaaatggaggatcagctgcaaaaagaagaggccgaatttacgacaagtctgctcgaggaagggaaaattctgcatgacattcatttatccttcagctttcaggagcttatgagcgaaaagcggcgcccggctatttattattcattatttttgcgtcatgtccagcatacaagccctcagaatatcgtgaatgtgacaagccggcagatgcagagttttcacgggcagatgaatgtcctctcaggtgaaatggagcgctttaagaaatcaaacttcaccgtcgtctttttaggcgcaaataaggacagaaccgacagattggcatccgtgctggctgattacgaaattgaagccgcgaaaacggacagctccaaagcgcttgtgcaaggacaggtctatgtcatggaaggcgagctgcaatccggttttgaactgccgctgatgaagctggccgtcattacggaggaagagctgttcaaaaaccgaatcaagaaaaagccgagaaagcagaagctgacaaatgccgaacggatcaaaagctattccgagcttcaggtcggtgactatgtcgtccacgtcaaccacgggatcggtaagtacttggggatcgaaacactggaaatcaaaggcattcataaagattacctcaacattcattatcagggcagcgataagctgtatgtccctgtagaacaaatcgatcaggtgcagaagtatgtcggctctgaaggaaaagaaccgaagctttataaactgggcggcagtgaatggaaacgggtgaagaaaaaagttgaaaactccgttcaggatattgccgatgatctgattaagctttatgcggaacgggaagcaagcaaaggctatgcgttctcgcccgatcatgaaatgcagcggcagttcgaatctgctttcccttaccaggaaacagaggaccagctccgttccattcaggagattaaaaaggatatggaaagagaacgcccgatggaccgtttgctttgcggcgatgtgggttacgggaagacggaggtagccatccgagcggcctttaaagcgatcgcagacggaaagcaggtcgcgcttcttgtgccgacgacaatactcgcgcagcagcattatgaaaccattacggagcgttttcaggactatccgattaacatcggtcttctcagccgattcagaacgagaaaagaatccaatgaaacgattaaaggactgaaaaacggaacggtagacatcgtaatcggaacccacaggctcttatctaaagacgtcgtctataaagatctcggcttgctcatcattgatgaagagcagcgcttcggcgtaacgcataaggaaaaaatcaaacagatcaaagccaatgtcgatgtactgactcttacagcgacgccgattccgcgtacgcttcatatgtccatgctcggtgtgcgggatttatccgttattgaaacgccgccggaaaaccgtttccctgttcagacatatgtcgtggaatacaacggcgcgcttgtacgagaagctatcgaaagagaactggcgcgcggaggacaggtatatttcctgtacaaccgcgtggatgacatcgagcggaaggctgatgaaatttccatgcttgttcccgatgcaaaagtggcatatgcccacggaaaaatgaccgaaaatgaattggaaagcgtcatgctcaattttctggaaggggaatcagacgtccttgtcagcacgactattattgagacaggcgtagatataccaaatgtcaataccttgattgtgttcgacggagacaaaatggggctgtctcagctgtatcagctgagaggacgggtcggccgttccaaccgcgtcgcttacgcttattttacgtaccgcagagacaaagtgcttactgaggtggcggaaaaacggctgcaggcgattaaagaatttaccgagctgggatcaggctttaaaatcgccatgcgtgacttgacgatcaggggagcggggaaccttctcggcgcccagcagcacggctttatcgactcagtcggttttgacctgtactcgcaaatgctcaaggaagcgattgaagagcggaaaggcgatattccgaaaagcgaacagtttgagacagaaatcgatatcgagcttgacgcgtatattcctgaaaactatatacaagacggcaagcaaaaaatcgacatgtataaacgcttcagatcaatcgccacaattgaggagaaaaatgagctccaagatgaaatcatcgacaggttcggcagctatcctaaagaagttgaatggctgtttacggttgctgagatgaaggtatacggaaaatatgaacgcgtcgaactcatcaagcaggataaagacgcgatcagatttaccatttctgaagaggccagcgcacagattgacggccagaaattattcgaactcggcaataaatacggccggcagatcggactgggaatggaagggaaaaagctgaaaatctcagtacagacgaaaggccgcaaaacggaagagtggctggagaccgtgctcggcatgctgaaaggccttcagaatgtgaagaaagaaacaatcgcgtcttcataaaaattgttactctctggtgtatattacatttgatgtgacggatactaatttcaagcgagtggcggaagctacataaagtaaagagctttagtactttcccttaaatatcatcacatgaaagagaggcaccagagagatgaaagctacaggtatcgtacgtcgtattgatgatctaggacgggtcgtcattcctaaagaaattcggagaacactgcgaatcagggaaggagacccgcttgaaatattcgttgaccgcgacggagaagttatattgaaaaaatattctcctatcagtgagcttggcgattttgcgaaagaatatgcagatgcattgtatgacagtctcggccattccgtcttgatttgcgaccgtgacgcgtatattgccgtttcgggcagttcgaaaaaagaatttctgaataaagccatcagcgatttgctcgaaaaaacgatggatcagcgcagctcagtggtagaaaacgacgtgaagtccgcgcagcttgtgaatgacattgatgaagatatgagctcctatacaatcgctccgatcgtggcaaatggcgatcctatcggtgccgtggtcatcttttccaaggaacaggcgcttggagaagtagaacataaagcggtagaaacggcagccagttttttggcgagacaaatggagcagtaggtcttattaccattattgaaataagaaaacggggaaagaacagctcttatacaagtgctgttctttttcatattcatatgtgctctctatcggttcggccgttaggattgtgatataataagctcgttttatagacgtaattttctagcggctggaaggagcttttggatgaacgattcagttggcgccaagcggcaatcggcatggaaaggtgcttttgtgctcgtcgttgcgggcatcgtgacgaagatattaagcgccgtgtacagggttccttttcagaatattgtcggtgacgtcggattttacatttatcagcaggtgtatccgtttttagggatcgcggtcatgctgtcaacatccggttttccggtgatcatctcaaaattaatgaacgattatagcgatcataaacaaaaaataatgaaaatttccgccctttatgtcacggcggccggacttgttctgtttgcgctcatgtatgccggcgcggcgccgttggccggttttatgggtgatgcccgccttgtgatgctgataagggtcgcggcgttcgctttcatactgtttccgtttacggcggttttccgggggtatttccaaggcgtgcatgatatgatgccgtcagccttatcccagattacggaacagcttcttcgggtggcggtgcttctcggtttatccttctggcttttgaaaagcgggcgttcattatacgcggcgggtgcgggggcggcctcgggatcaattgccgggagctttgcggccctttgtgtattggctgttttctggtataagcgggaagaaacaaagaaagacggcggacatatcgaaacggccgtcattgtaaaaaagctgctgctttattcagtcaccatctgtatcagcagtgtactcatgcttttgattcagcttgtagacgccttaaacttatattcactgctttcagacgggacggagagccatgccgcgaaacagctgaaaggcatatatgaccgcggacagccgctccttcagctgggaaccgtgtttgccgtcagtatcgccgcgtccttggttccttcaatttcaaaagcggtgcatgagaacaagccgtttatcataaaagagaaagcgtcatctgccgtcaagctctgccttgcggtagggatcggtgcatcagccgggcttttttgcattttagaaccggtgaatatcatgcttttccaaaacagtgaggggacgccgaccttacaaatattcagcttatctatcttttttgcctcgattgcgcttacggcagccgcaattctgcaaggagcgggacataccgttttccccgccgtatccgttttggcgggaggggcgctgaaatgggtgctgaatgtttggctggtccccggctggggtattacaggagcggcactggcgaccgtcttggcatttgccgcagttgcgtgcctgaatctccggagaatttggtcgaagggatggctgacgaatatcggaggcgtgattgcccgtctgtgctggtgcagtctgctgatggtcttctttttggtcgtatacatgaagctttggcagttatttgttcctgtcagcagggcggagctgtatgtgagagtctgtctgcgtcaatcatcggagggctattgtttatttattgtatgataagaatgaagattttcacggacgaagagctgagcggtcttcctttcggcagtgctttaagcaaattgaaaaagaggagagaaaaacatggcaggtaatattacggtcgtcggcctcggcgccggagacatggatcagttgacagtgggcgtacataagctgctgactcaggcgaagcatttatatataagaacgaaagaccaccctttgatttcggaattagagcaagagacggaagcggacatccggtattttgatgatatttatgaaaaacatgatcagtttgaagcggtctatgaagagatcgcggacattctgtttgaaaaagcgaagcaagaggatgtcgtctacgctgtacccgggcatccgtttgtcgctgagaaaaccgttcagctgttatttgaacgccgggaagaacaacagatagatgttcataccgctggagggcaaagctttctggatgccacttttaatgcgttgcgaattgatccgattgaagggtttcaatttacggatgcgcaaacaatgacgccggatgagctcgaactccggcatcacctgatcatctgccaggtttatgaccaaatgacggcctctgaggtgaagctgacgctcatggagaaattgcctgacgactatgaagtggtcatcgttacagcagccgggagcaagggagaaaagatgatcaaggtgcctttgtttgaacttgaccgcaatgtagaaataaataacttaacaagcgtgtatgttccgccgattaaaaaagaagaactcctttaccaggaattttctgcattccgaagtattattcgcgagcttcgcgggccgaacggctgtccgtgggatcaaaagcagacacaccagtcattaaagaaatatatgattgaggaatgctacgaactgcttgaggccattgacgaagaggacacggatcacatgatagaagaactcggggacgtcatgcttcaggttatgctgcacgcccagatcggagaagacgaggggtatttctcaattgatgatgtcatcagagacatcagtgcgaagatggtcagacggcacccgcatgtgtttaaggatgttaaggttcaggatgaacatgatgtcgtcgccaactgggaagaaatcaaaaaggcggaaaagcaaacaacatcctcttcattgctggatgccgtgccgaaaacactgccttctcttgcgaaagccgccaagcttcagaaaaaagccgcaaaaaccggctttgactgggataacgttcaggacatatgggataaagtaaatgaagagctgaaggaattttctgcagaggcttccgccgaatcagcagatgaaatcagcttaaaagctgaattcggcgatgttttatttgcattggtcaatatcggccgatactataaaattgagcctgaggaagcgctcgccatgacaaatgacaaattccgcagacgctttgcttatattgagaaagaagcggcagcaaagggccttgaattgaccgcaatgtcacttgaggaaatggacaaattgtgggatgaagcaaaagaaatggagaggagattctgatatgagacttgataaatttttaaaagtatccagattaattaagcgacgcacattggcgaaagaggtcgccgatcaagggagaatcaccgttaacgggaatcaggcgaaagccagctcagacgtaaaagccggtgatgaactgaaggtccgcttcgggcagaagcttgtcaccgtgaaggtaaatgaattgaaagaaacaacgaaaaaagaagaagccgcgggcatgtatacaatcgtcaaagaagaaaaactcggcgaataggcttgttctaaacaaggctcccgcctcatacaatgcagtaataatgctaaaagtatcgaggatatgggggctgaatagatgaattcatattatgagcaaaaaggttcttcttctgttccggaacagcatgatgtaacgatgaaagggagaaagcatttagacatttcgggcgtcaagcatgtggaaagttttgataacgaagagtttttgctggaaacggttatgggaatgctttccgtcagaggcgagaatctgcagatgaaaaaccttgatgtggaaaaagggattgtatctataaaaggcagggtgtttgaccttgtatatttagacgagcagcaaggggataaagctaaagggttttttagcaagttgtttaaatgacgctgacgacccaattttatacgatgctggcaatgaccggtatgggcgcctggctcggagcgtcgcttgatacatacaggctgtttgtcagccgcgccaaaacggccagatggctgttattcattcatgacattctcttttggattgtacaaggtctgctgtttttctatgtgctgctcaacgtgaatgaaggggaactcagggtatacattttcttggctgtcttactgggtattgcgacgtaccaaagcctgtttaaacgaatgtatataaaaatactgaaatttgccattcatcttgcggtgtctctttaccaattcgcaaaaaagctcattcagcacgtgctgttccgtccggtgcttctgctctttaagctgctcatcgggctgatcacggttatttctttatactcctatcgggtgagtgccttttttgcgaagtgtctttttaagatcgtagcgtttttgctgtatccgctgtttttcctgttgaaacaattattgaaacttcttcctgaaaagtggcgtcttactttcaaacgatattttcaaaaaagtgcaggatttttacaaaagagcaagaaactaatcataacaatcagatcgaccatgatacgtattttgaaaaggtgaaaggaggaccgtctggtttgaatctatctagggaacgtacaataactgaaattcaaaacgactataaagagcaggttgaacggcaatcccagcttatgaaaagaaggcggaaagggcttttcagacggttgatcgtattcggcgcccttgtgttgttgacggctattgtcttagcgggttctctgtggtcacagacctcttcccttagcgcaaacgaagaaaaaaaggctcagctggaaaaacaagttaaagaattgaatgcgaaacaggctgatttaaaagatgaaatttccaaattaaaggatgaggattacgtcacagagcttgccagaagagacttgtttatgtcaggaaatggtgagattctctttaatgtagaaaagaagagcaagtagccttgttgacacttaaatttttatttaggtataattaaacaaacgatctttttataagcctaaggaggagcactttttttatgtcgattgaagttggcagcaagttgcaagggaaaataacaggtattacaaatttcggagcatttgttgaattgcctggaggctcaaccggtctcgttcatatcagtgaggtagccgataattatgtaaaagacattaacgagcatttaaaagtcggcgatcaagttgaagtgaaagtcatcaacgttgaaaaagacgggaaaattggtttatcaattaaaaaagctaaagaccgtccgcaagccagacctagaaatgatttccgtccgaaagaatcttttgaacagaaaatgaacaagtttcttaaagatagcgaagaccgcttatcatctttaaaacgaaacacggaatcaaaacgtggagggcgcggagcaagaagaggataacttgctgctttctataaatacatggagcatccgtctatcccagcgggtgctttttttgtatacgcgcatgtagtcagaaaattaaaactttaaagtttctgttgacggaatgaagaaacctttgtattatataacttgtgcttataagcacctatatggcggtgtagctcagctggctagagcgtacggttcatacccgtgaggtcgggggttcgatcccctccgccgctaccatatatatctggcccgttggtcaagcggttaagacaccgccctttcacggcggtaacacgggttcgaatcccgtacgggtcatcaagcgaatcggcttctgttgcagaagccgattttttcatatttagacaactttttgagaaatgtcggaggaaatacaaaaggaaaggggaacaagggagaaagcgtcgaagagttctttggaattgttaccttcttttgacaaaatcctatctgggctttcatttataatgacaagcaacgaataaaacaggtgggggatgagagcaatggaaaaagcggaaagaagagtgaacgggccgatggcgggacaagctctggaaaaactgcaatcgttttttgaaaaggcggcaaagcttacagtccatcaagcgcattcactttttttctataagggtttcatttatgtcgtgatcggttttttacttggacgggctttcatattatctgaggttcttccatttgcactgccgtttttcggagcgatgcttttgatcagaagagataaagccttctatgcttgtctgtctttacttgcgggcgctttaaccatttcgccgaaacactctttattgattctcacagctttggccgtcttcactctattttcaaaaatcggtacatatatcgtgcaggaccgggtgaagatgctgccgatcgtggtgtttttctctatggctgccgcgagaatcggatttgtttattttgaaagcggcgcttttaccacctatgattatgtgatggctgttgtcgaggcgggcctggcctttattttgacgctgatctttttacaaagcctgccgattttcacgatcaaaaaagtgaagcaatcgttaaaaatagaagaaatcatctgttttatgatcttgatcgcatccgttttaaccgggcttgccggtgtttcatttcagggaatgcaggctgaacatatcctggcccgctatgtcgtgctgagtttttcctttgtcggcggggcaagcatcggctgtacggtcggtgttgtgaccggactgatcctcgggcttgcgaatatcgggaatctctatcaaatgagtctgcttgcgttttccgggcttcttggcgggctgctgaaagaaggaaagaaagccggcgccgcagtcggattggtgatcggctcactgctgatttcattatatggtgaagggtctgccggattaatgaccactctttatgaatctttgattgccgttgtattgtttttgattacgccccaatcgattacgaaaaaggtggcgcgatacataccgggcactgctgagcacagtcaggagcagcagcagtacgcgaggaaaatcagagatgtcaccgcccagaaagtagaccagttctccaatgtgtttcatgccttgtcggagagcttcgccacctttcatcagacgtcttccgatgagcaggcggaagaaggggaagtggatctctttttaagcaaaatcaccgagcattcctgccaatcctgctataaaaaaagcaaatgctgggttcaaaactttgataaaacatatgacttaatgaaacaagttatgcatgaaacagaagaaaagcagtatgcctcaaaccgcagattgaaaaaagagtttcaacagcactgttccaaatccagacaggtggaagagctgattgaggacgaacttgcccaccatcacgcccatctgacactgaagagaaaagttcaggacagcaggaggcttgttgccgagcagctgttgggggtttctgaggttatggcggacttttctcgggaaataaaacgggagagggagcagcattttattcaggaagaacaaatgatagaggcgcttcagcatttcggaatcgagattcagcatgtcgagatatacagcttggagcagggcaatattgatatcgaaatgacaatcccgttcagcggaggacacggcgagagtgagaaaattatcgccccgatgctgtctgacattcttgaggagcagatacttgtcaaaagcgaacagcactcggctcatccgaatggctacagccatgttgcgttcggttcgaccaaatcgtaccgggtatcgacaggcgcggctcatgcggcaaaaggcggcggccttgtctccggcgacagctacagcatgatggaactgggggcgagaaaatatgcggccgcaatcagtgacggcatgggcaatggggcgagggctcattatgagagcaacgaaacgattaagctgctcgaaaaaattctcgaatcaggtattgatgaaaaaatagcgatcaaaacgatcaacagtattctgtctttacggacgacagacgaaatctactcaactctcgatctttctatcattgatcttcaggatgcaagctgcaaattcttaaaggtcggttcaacgccgagttttatcaagcggggagatcaagtcatgaaagtgcaggccagcaatctgccgatcggtatcatcaatgaatttgatgtggaggttgtaagtgaacagttaaaagcgggagatctgctcgtcatgatgagtgacggtatttttgaaggaccgaagcacgttgaaaaccacgacctgtggatgaaacggaaaatgaaagggctgaaaaccgaagatccgcaggaaatcgctgatatattaatggaagaggtcatcagaacgcgttccggccaaatcgaagacgatatgacggtggttgttgtccggattgatcacaacacgccgaaatgggcttccataccggtgccggcggtattccaaaataaaaaggagatttcttaatcctttcgtataaatcactttccttctggcgaagatgggactaatcgtatcaccgggaggaatgtatgtgaataagggacatttaaatcaagttctgctgattacagatggctgctccaatcatggtgaagacccgattgcaatggcggctttcgccaaggagcaggggattacggtgaatgttatagggattatggaagaaaacgcgattgaccaagaggcaatgaaggaagttgaaggcatcgccatggccggtggcggcgtccatcaagttgtatatgcgtcacaattgtctcagacggttcaaatggtgacgaaaaaagcaatgacccagacgctgcaaggtgtcgtcaatcaagagcttaaacaaatcttagggaaaaacgttgaaatggaagagctttctccggaaaaacgcggcgaagtgatggaagtggttgatgaactcggagaaacagttcatctgcaggtgcttgtgctggttgatacgagtgcgagtatggcgccgaaactgccgacggtgaaagaagcgctgattgatctttccatcagtttaaattcccgggccggacaaaatgaatttgccatgtgtatatttcccgggaaaagccaggaagttgagcttgtgctgaattggacgccgaagcttgaatccctttctgcgctctttgcgaagctgtcgaccggcggtatcacccctacgggccccgctatccgggaagcgacgcagcagtttgagagaatccgctcaagaaggagcatgttggcagatgatgaacgacgctttaacgagtttggcatgtagtctggcaccggggacggcaattcagggcaaatggaacggcaaatcctacagattgctcaaacagcttggaaaaggggctaacggtattgtatatctggcagaagcatcaggcggacaggtcgctttgaaaataagcagcgacagcatgtctgttacctctgaagtgaatgtcttaaaatccttttcaaaggcccggtcgcaaacgatggggccttctttttttgatgcggacgatgcgtttattccgcagctgaataaaaatgtctctttttacgtgatggagtacatagaagggccgcttcttccgcaatatatcagcagtaagggagcggagtggattccggtgctgatggtgcagcttctttccagcttgtcagtccttcatcagcagggatgggtttttggcgacctcaaaccggaaaatcttattgtaaccggaccgccggctgccatccgctgcattgatgtagggggaacgacaaaacaaggccgcgcgattaaagagtatacggagttttacgacaggggctattgggggtatggaacaagaaaagcagaaccatcctatgacctgtttgctgtcgcaatgatcatgatccactgtgtccagaagaaagagtgcaaaaagtcaggacagccgaaagaacagcttcgttctatcattgaaggccacccgtttctgaataagtataagaaggttctgttttctgctttaaacggccaatatccgtctgcggaagccatgaagcatgacatcctgacggcggggcagagcgccgggagtaaaaggaaagccgccgccaagcctaagccgccgcaatcaaaaccgcggcagggcactgtatctcaaacgcggtataaacctaaacaaaaacccgcaaagcacaatggtttgtttgaaacaacgcttattttaatcagcgttctcgccctttatttcgcttacatcgtcttttttctcatctaatgccggccggacgcctgcgctcatgcttcttctttgcttggagggaatgaaagtgataggatatgtatatctttaaaaaaacctgctcattgtgaggggacattgtgaaaagcgtggaagattttttcaaaacatatcatcttcaggcggagggagaaacgattattgccggggtctccggaggccctgattcaatggcgcttctcagtatgctgaataagcacttcgggcattcttccgttatcatagcggcgcatgtcgaccatcagttcaggggtcctgaatctgaagaagatatgaagtttgtgcagtcatattgcgaagcggaacacatcctctgcgaaacggtacagattgatgtttctgcatacgcaaagaagaataagctgaacaagcaggctgccgcgcgtgattgcagatatcagtttttcgaagatctgatgacaaaacaccaagcgaagtttttggcgctggctcatcacggcgatgaccaggttgagacaatgctcatgaggcttgcgaaaggtacgctcggcgcagggctcgcgggaatgcagcccgtccgcgaatttgcatccggctggctgatcaggcctttcctctatgcggaaaaggatgaaatcctagaatactgccgtcaagaagggctcagctacagaacggatgagagcaatgcaaaagacgattatacaagaaacagattcagaaagaccgtgcttccttttttaaaacaagaatcacctgacgttcataaaatgtttcaaaaggtgagtgaagcactgacagaagacgaacaatacttgcagtcattaacgaaagaacgaatgaataaggttattacaagcaagtctgacacatcggttgaagtcgattcctctcaattgcttgcccttccgatacctttacaaagaagaggagttcaactaatattaaactatctttatgaaaacgttccatcgtcgttttccgcccgccacatacagcagtttctggaatgggcggaaaatggaagcgcctcgggagtgcttgattttccgaaagggctgaaggtggtcaaatcatatcagacatgtttgtttacatttgaacaatggcaatgtgaaaaggttccctttgagctgcagctgcaaggagcggaaggcgagactgctgttctccccaacggctttatgatagaggtggccgatcaggctgaccctcatatcaaaaatgggaatgctgtttttatgacaagcagaaataaggtgcaatttcctttaacaatccggacgagaaaaatcggcgaccggattaaacttaaagggatgaatggctcgaaaaaggtaaaagatatatttattgatcataaactgcctctgcgggatcgggacgaatggccgattgtaacggatgcgagcggtgaaattatctggctgcctggcttgaaaaaatccatctttgacgatcttgtgatttcaaacagtgaccgcattgtattacaatatagacagcatgaaaagtgtagggggcaagcattaacatgaaacaggatatcgaaaaagtgctgatctcagaagatgagatccagcagaaagtaaaacagcttggagaacaattaacaagcgagtacagcgacacgtttccgttggcaatcggtgtgttaaagggagcgcttccttttatggctgatcttataaagcatattgatacatatttggaaatggacttcatggatgtatcaagctacggaaattccacggtttcttccggagaagtcaaaatcatcaaagatttggatacatctgtagaaggccgggacatcttaatcattgaagatattatcgacagtgggttaaccttgagctatctcgtagaactcttccgatatcgtaaagcgaaatcaattaagattgttaccctgttggataaaccaagcggaagaaaagcggacattaaagcagacttcgtaggctttgaagttcctgacgcgtttgttgtgggttacggacttgattatgccgagcgctatcgcaatctgccttacatcggagtattaaaaccggcgatttatgaaagctgatcggctgcctgcttccgagatggttatcggttgtattggaatgattttctatggtactattgaacatagttgtgcttactgtgggaggaggtaaggaatgaatcgggtcttccgtaataccattttttatttacttattttattagtagtaatcggggttgtgagttacttccagacctcaaacccgaaaacagaaaatatgtcgtacagtacgtttatcaagaacctcgatgaagggaaagttgatagcgtatcggttcagcctgtcagaggtgtttatgaggtaaaaggacagctgaaaaaatacgacaaagaccagtactttttaacacatgttcctgaaggaaaaggagcagaccagatatttgacgcaattaaaaagacggacgtaaaagttgatcccgcacaggaaacaagcgggtgggtgacgttcttaacgacgatcattccgtttgtcatcatctttattctgtttttcttcctgctcaatcaggctcagggcggcggcagccgtgtcatgaacttcggaaagagcaaagcgaagctgtatacggaagaaaagaaacgcgtgaagtttaaagatgtagccggcgcggatgaggagaagcaggagctcgttgaggttgttgagtttctgaaagatccccgcaaattcgccgagcttggcgccaggatccctaaaggcgtgctgcttgtcggacctccgggaaccggtaagacattgcttgcgagagcctcagccggtgaagctggcgttcctttcttcagcatcagcggatctgacttcgttgaaatgtttgtcggtgtcggtgcttcccgtgtgcgtgatttattcgaaaatgcgaaaaagaatgcgccttgcctgatcttcattgatgagatcgacgcggtaggacgtcagcgcggcgccggtcttggcggcgggcatgatgaacgcgaacagacgctgaaccagctgcttgttgagatggacggtttcagtgcgaatgaaggaatcattattatcgctgcgacaaaccgtgcggacattcttgaccctgcattgctccgtccgggacgttttgaccgtcagattacggtagaccgtccggatgtcatcggccgtgaagccgtattgcaggtgcatgcgagaaacaaaccgcttgatgagacggtgaacttaaaagcaatcgcttcaagaacacccggtttctcaggcgcagatttagaaaaccttcttaacgaagcggcactcgttgctgcccgtcaaaacaagaagaaaattgatatgcgcgacattgatgaagcaacggaccgtgtcattgcgggtcctgcgaagaagagccgcgtcatctcgaaaaaagaacgcaatatcgtggcgtaccacgagggcggtcacaccgttatcggacttgtgctggatgaagccgatatggttcataaagtaacgattgttccgaggggcaggcaggcggatacgcagtcatgcttccgagagaagaccgttacttccagacaaaacctgaacttctcgataaaattgtcggtcttctgggcggacgtgttgccgaggaaattatcttcggcgaagtcagcacgggggctcacaatgacttccagcgggcaacgaacattgccagaagaatggtgacagagttcggtatgtcagaaaaactcggaccgcttcagttcggtcaatctcaaggcggtcaagtattcctgggccgggatttcaacaacgagcaaaactacagtgatcagatcgcttacgaaattgatcaggaaattcagcgcatcattaaagaatgttatgagcgtgcgaaaaccatcctgactgaaaatcgcgataagcttgaattgattgctcagacattgcttgatgtggaaacattagatgcggaacaaatcaagcatctcgtggatcacggaaaactccctgagcgcaatttctcagatgaccatcttcaaaaagacgatgtgaaagtaaacatcctgtctaaaacagaagacgaaaagaaagacgagccgaaagaatagttcgctttctgatatgaaaaccgccggcgtataccggcggtttttttactggttccgttttgtttacaaaagagccgcagatcgtgtatggtattgtagaatgttgaaaatgttatgattagaaactattcaaaagtggtgatagaggttgttactggttatagatgtggggaacaccaacaccgtgattggtgtatatcatgatggggaattagaatatcattggcgcatagaaacgagcaggcacaaaacagaagacgaattcggcatgctgctccgctccttatttgaacattccggactgatgtttgaacagattgaagggattatcatctcatccgtagtgccgccgattatgttctctttagaaagaatgtgcacaaaatactttcacatcgagccgcaggttgtcggcccgggaatgaaaacaggtttaaatataaaatatgacaatccgaaagaagtgggagctgacaggatcgtcaatgccgttgcagcgatccagcagtatggcggccccttaattgttgttgatttcggaacggcgacgacgtattgctacattgatgaaaacaaacaatacatgggcggtgcgattgctcccggcattacaatttcaacggaagcgctgtactcacgcgcggccaagcttccgagaattgaaatcgcccgaccggataatatcatcggcaaaaacacggtaagcgccatgcagtccggcatccttttcggctatgtcggacaagttgaaggcattgtaaagcggatgaaatggcaggccaaacaagaaccgaaagtcattgcgacaggggggcttgcgtcattaatcgcaaacgaatcagactgtattgatattgttgacccgtttcttactttaaaagggctggaaatcatttatgagcgaaatcgcgtgggtcacatataggaggtaaacgatggattatttaattaaagcaattgcatatgacggtaaagtgcgggcttatgcagccagaacgacagatatggtaaatgaagcgcaaagaaggcatgacacgtggccgacggcatcagccgcaatcggccggacgatgacagcgtctctgatgctcggagcgatgcttaagggtgaagataagctgacagtcaaaatagaaggcggcggcccgatcggagccattgtcgcagatgcgaacgcaaagggtgaggtaagagcatacgtatcaaacccgcacgttcattttgacctcaatgaacaagggaaactggatgtcagacgggcggtcggaactgacggaacactcagtgtcgtaaaagatttgggcttgcgtgattattttacggggcaagtagagattgtctcgggtgaactcggtgatgacttcacgtattaccttgtttcttctgaacaagtcccttcatctgtcggggtaggtgtactagtaaatcctgataacacgattctcgctgcgggcgggttcatcattcagcttcttccggggactgatgaagaaaccatttcaacaattgaaaagcaattatctcaaatcgaaccgatttcaaaattgattcaaaaaggcctgacaccggaagaaatcttagaagaagttctgggtcaaaaaccggacgttctcgaaacaatgccggtcaaatttcactgttcttgttcaaaagatcgattcgaaacggccattttaggactaggcaaaaaagaaatacaagatatgatagaagaagacggaaaagccgaagcggtttgccatttttgtaatgagaaatatttatttacaaaagaagaactggaagagcttcgtgacgaaacaacccgctagctctttagcgggttgttctattttgtaaaagggatggggtagattttgaaatcgagaacacttttgacgattattgtagcggcgctgttggtatgcagtgtagcagtggcgtataagttaacaaaatcccaagccgcggggtcatctgaagaatccatcgcgacaatcggtgataaacatatcacacggcaggactggatgaaaaagatggaagacgagtacggaaaatcaactctggaggatatgattaatgcacaagtagtggaagaacttgcgaaaaagaataaactcacagtttcaaacaccgaattggaacgtgaatttcttttaatcaaagcggtgaataattcattttatgaagacagccatattaccgaaaaagaatggagagaccagatccgctacaacattcttcttgaagaactgctgacgaaggacatcgatatatcggataaggaaatgcaatcattttataataaaaataaagaactgtaccatttcgatgattcctacagaatcaggcacattgtcgtcaaaaacaaggaagaggcggacagggtgcttgctgatttgaaaggcggttccagctttgaagccgtcgccgctgagcgttccacggacagatacacgtctcagtatggcggagacctcggctttgtgacagaaaaccaggaaaatatcccgcaggcatatatcacagaagctaaaaatctcaaagaagatgaatggtccgctgaaccgattaaagtttcttcaggatatgccgtcattcagctgaaagaaaagcttaaagcgagaactttctcatacaatgaagtgaagagtcaaatcagacgccagatcgcgatggatcaattaggtgacaaggcgacagtcaaaacgctgtggaaagaggcgggggtctcttggttctacggggaaaaaagaactaaatgattgacaaaaaattttgaaattgataacttatatttataataccaataaatttagtcggaaattgaggtgtccaacatggtgcgtattgcaaattctattactgaactaatcggaaatactcctattgtgaaattgaatcgcctgacggatgaaaacagtgcagatgtatatctgaagcttgaatacatgaatccgggcagcagcgtaaaagaccgtatcggagcggcgatgattgaagcggctgaaaaagaaggaaaattaaaagccggcgacacaatcattgaaccgacaagcggaaatacaggaatcggtcttgcgatggtggcagcggctaaaggtctcagagccattctcgttatgcctgatacaatgagtatggaacgacgcaatctgctgcgcgcatacggagcggagcttgtgctgactcccggcgcagaaggaatgaagggcgccattaaaaaggcggaagaacttgcggaggaacacggatactttgtgcctcagcaattcaacaatgcggcaaacccggaaattcaccgccaaacgacggggaaagaaatcgtagaacagtttggtgacgaccagcttgatgcgttcgtggccggaatcggtaccggcggaaccatcacgggagcgggcgaagtgctgaaaaaagcatatccatccatcaaaatctatgcggtagagccggcggattctccagttctttccggcggaaaaccgggtccgcataaaattcagggtatcggagcgggatttgtccctgaaacattgaatacggacatctatgatcaaatcattcccgtcaaaaacgaggatgcatttgaatatgcccgtaaaacggcaaaagaagaagggattctcggcggtatttcttccggagcggccatttacgcggcactggaaatcgcgaaaaaactcgggaaaggcaagaaagtgcttgcgatcatccctagtaacggagaacgttacttaagcacaccgctttatcagtttgaatagagacatacacacggctcccggctgtatccgggagtttttttgtgcctgaagtatcgaaaatccaaaaaacgtttcgaattttatggttggaagtgaaattcacttttttcaccagtgtgattgctttaaaataaaactacagtaaaacgaagcagaggattgatatgatggcacaacgcagaccggcaggaagaaaaataccttttacgaaacaagcatttttacagcgatatgaaaacctttcgaaatcgagaaaacggcatgttctgctcgaaagcgcgagagggggaagattcagtatagccggtctagatccgattgcgtccgtcagagggaaagacggaattacaacgatcaagcatgagggagaaacactgtttaaagaaggtgacccgctgcgggcctttcatgaatggtttggaacgctcggaacggaaacaaacgttgagtttccggactttcagggcggtgcgattggttttatcagttacgactatgcccgatatattgagaattttaagatgctgtcgttagatgatctggaaacacctgatatttactttcttgtttttgatgatgtggccgtttatgaccatgaggaagaggcgttatggctcattacccatactgaagcggaagaagcggatcttgcggaagaaaagctgtccggcttagaggacatgtggtgttccctccaaacggcggacgagcctttttcaccgctgaatcggaatggggacggatcgtacgccgctccgttcaccgaggaaggattttcacaggctgtagaacaaattaaacaatatatcgcgagcggggatgtgttccaggttaatttgtccatcaggcagtctcagtctttatccgttcatccgtatgaggtgtataaacacttgcgaaacgtcaatccgtctccttacatggcctatctcgagacaccggggtttcaagtgatatgcgggtcgccggagctattggtgacaaagaaggggaagaagcttgaaacgagaccgatcgcgggtacgcgttcaagaggaaaagacgatgctgaagacaaggctttggctgatgaattaattcacaacgaaaaagaacgtgcggaacacgtcatgcttgttgatcttgagcgtaatgacctcgggcgcgtatcgcgctacggctccgtgcgggttaacgagtttatggcgatcgaaaaatattcccacgtcatgcatatcgtgtcaaacgtacagggagagctgcaggacggatatgacgcgacagacattattcatgcggtgttcccgggggcaccatcacgggagcgcccaaagtgagaacgatggaaattatagaagagcttgagccgacaagacgggggctttatactggatctataggctggttcggattcaacggagatttgcagtttaacattgtgatccggacgatctatgcagccggcggacatgcttttatgcagtccggagcaggagtggttattgattcggttccgaagcatgaatacaaggaatcgttcaaaaaagcttttgcgatgaaaaaggcgttagagctgagcgaagaagagacaaaaaatcagacgaggtgagcagagatgattttaatgattgacaattatgattcatttacgtacaacttggttcaatatttgggtgagctcggggaggaactgatcgtcagacggaatgacgagattacgattgagcagattgaagagctgggtccggacttcttaatgatttctcccgggccgtgcagtcctgatgaagcggggatcagcctcgaagccatcaaacattttgccggcagtattcctattttcggcgtatgtctcgggcatcagtcgattgcgcaagtattcggcggcgatgtcgtcagagcagagcggctcatgcacggcaaaacgtcagaagttatgcatgacggacagacgatttttaacggcctgcaaaatccgctggtcgccacccggtaccattcacttattgtcaaagcggacacgctgccggattgttttacggtatccgctcaaaccaaagaaggagaaattatggccatccgccataatgagctgcctgttgaaggtgttcagttccatccggaatccatcatgacctccttcggcaaagagatgctcagaaactttatagagacacaccgcaaaaaggaagtatcggtgtgattatatatttgaatggtcaatatatagaggagaaagaagcggcgctttctccttttgaccatggttatctgtacgggatcggagcgttcgagacgttcaggctttacagcggccggccgtttctgccggatgcgcatgtcgccaggctcaacagggcgcttcgggatctgcagattgcattcgaggtgaacaaacaggagctgcttgatatgcttcggagactgttgcttctcaatgacataaaggacggcagcgcgcgtgtccggcttaacatctcggcaggcgtcagcgataagggatttgccgcgcagacttatgaaaagccgaccgtcctttgtttcgtgaaccggctcaatccggaaactctgcctgttcaaaaagaaggcaggcttctctctgtccggagaaatacgcctgaaggatctttccggttaaaatcccatcactatttaaacaacatgtacgctaaacgggagatcgggaatgatcccaatcttgaagggattttcctgaccggagaaggagatgtcgcggaaggcattgtctccaacgtgttttggcgaaaaggagacaaggtctttacgccatctttggatacgggaattctcgacggtgtaacaagacagtttgtcattgatgaattgaaacggcaggggacagaagtcaccgaaggccgattccgttttcaatcaatgcttgaagcggatgaagcatggttgacaaactccgtgcttgaaatcatcccgttttctaaaatagaggaagtgccgctgcccggaatgagcgggaaaacggtgcaattgctccgtaagcagtatcggcaggaaataaacaaaatgaatgtacaggaggaggaacaaaatggcgcagcaaacaattgaacagcctaaactgattcatacaaaaaaaggcgctctgtcctataaagagaagacgctcgttatggggatattaaatgtaacgccagactccttctctgacggcggcaaatacgacagtacggaaagggcgcttctgcatgcggcgaagatggctgaagaaggggcgcatatcatagatatcggcggcgaatcgacaaggcccggcgcatcactcgtttcggctgatgaggaaatgtcacgagtcatccccgtcatagaacggattacaagcgagctggacattccgctttcaatcgatacgtacaaagcgtccgtggcagacgaagcggtcaaagcgggagcctctatccttaatgacatctggggggcgaaaggtgaccctgacatggcgtcagtagccgccgcacacggagttccgattatcttaatgcataatcgtatggaaagaaactataacgatcttattcctgatatgcttgcagacttgatggaaagcgtaaaaattgccgcagaagccggcgtcacagatgaaaacatgattctggatccggggatcggctttgcgaaaaactatgaggacaatctggctgtcatgaacaagctggaggtgttcagcgggttagggtatccgctgctcctggcgacatcgagaaaaaggttcatcggccgtgtgcttgaccttccccctgaagaacgtgccgagggaacgggagcgacagtatgccttggcgtccaaaaaggctgcgacattgtgagggtgcacgatgttaaagagatcgcaagaatgactaagatgatggatgctatgctgaacaaaggaggcgcgcattatggataaagtatatgtggaaggtatggagttttacggatatcacggcgtgttcgaggaagaaaacaaactcggccagcgcttcaaagtagacctgactgccgaactggatttgagcaaagcgggaaaaacggatgacctttcttataccattaactatgcggaattgtacagtgtctgccgcggcatcgttgagggcgagcccgttaatttggtcgagacccttgcggaacggatcgcagacaccgtccttgagaaatttgagccggtgcagcaatgtacggtaaaggttgttaagcctgacccgccgattcccggccattataaatcagtagccatagaaatgacgagaaagaaatcatgaacaatacggcatatatcggcctcggttccaatatgggcgaccgtgaacattatttgcgccaggcagtggccatgctcacccggcatgatggcgtgacggtgtcaaagatatcctctatatatgaaacagatcccgtcggttatgaggatcaggatcagtttctcaatatggcggttgaagtgaaaacgtcgttatctccttttgaacttctagatgtaacacagtccattgaagctgaattaggcagaacgagagagattcgctggggaccgcggacggcagaccttgacattttgctgtataatcgtgaaaatattgaaacagagcggctgattgttccgcatccgagaatgtatgagcgcttatttgtccttgcgccgttaaaagaaatatgtccgcaggcggatcatatcacgataagcgctgaaacaaaccaagaaggtgtaagagtatggaagcagaaatctggggtaggcgaattcgtgcattcagaaagctgaaaggttatactcaagaaggatttgcaaaagcattaggtatatcagtttctattgtcggtgaaattgaacgcggaaaccgattgccgtcagatgccatcattcaagatgcggcagatgttttaaatataagtgcggacgaattggccccgcctgaaaaatagacaaatgaaaggaggggaaaaatgtttaaaatcggtgatattcaattgaaaaaccgggttgtgcttgcccctatggccggtgtctgcaactcagcgttcagattgactgtaaaggaattcggagccggattggtatgcgctgaaatggtcagtgacaaagcgatcctttacaacaacgcaagaacaatggggatgctttacattgatgaacgtgaaaaaccgctcagccttcagatttttggaggaaaaaaggaaacccttgtggaagcggcgaagtttgtagatcaaaacacgactgctgatattattgatattaacatgggatgtcccgtaccaaagattacaaaatgtgatgcgggcgccaaatggcttctcgatcctgataagatttatgaaatggtatccgcagtagtagatgctgttgataagccggttacagtgaagatgagaatgggttgggatgaagatcacatttatgcggtgaaaaacgcccaagccgttgaacgtgccggcggaaaagccgttgcccttcacggccgcacaagagtgcaaatgtatgaaggcactgcgaactgggatatcattaaagaagtgaagcaatccgtctccattcccgtcatcggaaacggtgatgtcaaaacgcctcaggacgcgaaacgcatgcttgaggaaacaggagttgacggcgtcatgatcggccgggccgcactcggcaacccgtggatgatttaccgtacggtgcagtaccttgaaaccggtgagttaaaagacgagccgaaagtccgtgaaaaaatgtcggtatgcaaactgcacttagaccgcctgattaagttaaaaggcgaaaatgtggcagtcagagaaatgagaaaacacgctgcctggtatctgaaaggtgtcagaggcaatgcgaatgtacgcaatgaaattaaccaatgtgagacgcgtgaaaaatttgtgcagcttttagatgcatttaccgccgaagcagaggcaaaagagcttcaagatgcaaaagtaggttaatatacaccctctattgctgctcactgccagcttaccgctggcagtttttctgctttttcgtgaaatcaaaatgtaacggagtgataccaatgagtcaagaagagcaaaatcatgaggaattgaacgaccagctgcaagtcagacgagataaaatgaaccagctgagagaaaacggcattgaccctttcggcgaacgtttcgagagaacgcatcaatctcaacaaatcattgacgcctaccaggagctttctaaagaagaactggaagaaaaagcgatcgaagtgaccattgcaggccgtatgatgacaaagcgcggaaaagggaaagccggctttgcgcatctgcaggacttagaaggtcaaattcaaatttacgtaagaaaagacagtgtcggcgaagaacaatatgaaatctttaaatcttcagacctcggagacgttatcggcatcaccgggaaagttttcaaaacaaacgtaggcgagctttctgtcaaagcgacatcttttgaactgctgacaaaagcactgcgtcctcttcctgataaatatcatgggttaaaagacgttgaacagcgttaccgccagcgctatctcgatctcatcgtaaaccctgacagcaaacaaacgtttatcacacgcagcaaaatcatccaagcgatgagaagatacttagatgaccatggatacttagaagttgaaacacctacgatgcacagcataccgggaggagcgtctgcacgcccgttcatcacgcaccataacgcgctcgacatgcctctttatatgcgtattgcgattgaactgcacctgaaacgcctgattgtcggcggattggaaaaagtctacgaaatcggccgcgtgttccgtaacgaaggtgtttctacacgccataaccctgaattcacgatgatcgagctgtatgaagcgtacgccgattataaagatattatgagtcttacggaaaacctcgtagcacatattgcgcaggaagtgcttggaagcaccacaatccagtacggcgaagagcagattgatctgaaacctgagtggaaacgactccacatggtagatgcggtcaaagaagcgacaggcgtagatttctggaatgagatgactgttgaagaagcgcgcggtcatgcaaaagagcatggtatcgagatcacaaactctatgacggtgggtcatatcatcaatgaattcttcgaacaaaaaattgaagaaacactcattcagcctacatttatttacggccaccctgtagagatttctcctcttgctaagaaaaatccggaggaccctcgctttacagaccgttttgagctgtttatcgtcggccgtgagcacgctaatgcgtttacggagctgaatgaccctattgaccagagggaacgctttgaagcgcaattaaaagaaagagaagaaggaaacgatgaagcgcatatgatggatgaagacttcgttgaagctcttgaatacggcatgccgccgaccgggggattgggtatcggtatcgaccgccttgtcatgctgttaacaaatgctccgtctatcagagacgttttattattccctcaaatgagacaacgctaataaaagggaaggcgccgttttctgcttatcgcagtacggcgcttttttagaaacaagccgctcgtaaaactttttgattttctttaaaaaaactattgcactattatttgtgaggtggtatattattattcgttgccgctaaacaaggcgctgacgaaaaaaagaaatttaaaaagttgttgacttcaagagattgataagatataataataaagtcgcttgaacgaaagacaaaatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtgacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattcgattcttcgagatattgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgatttcctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatgggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagccattacacgtaagtgtaatatatggaggattagctcagctgggagagcatctgccttacaagcagagggtcggcggttcgagcccgtcatcctccaccatatttgccggcctagctcaattggtagagcaactgacttgtaatcagtaggttgggggttcaagtcctctggccggcaccatttttggacaagataataacacaagtcttttaaaaagagccattagctcagttggtagagcatctgacttttaatcagagggtcgaaggttcgagtccttcatggctcaccatgtaacgcgggtgtggcggaattggcagacgcgctagacttaggatctagtgtcttatgacgtgggggttcaagtcccttcacccgcattatacaggatagttatcctgtatgcggaagtagttcagtggtagaacaccaccttgccaaggtgggggtcgcgggttcgaatcccgtcttccgctccaactataccatccacgccggggtggtggaattggcagacacacaggacttaaaatcctgcggtaggtgactaccgtgccggttcaagtccggccctcggcattcattattatgcgcccgtagctcaattggatagagcgtttgactacggatcaaaaggttaggggttcgactcctctcgggcgcgccataatatttttaaaaatcgggaagtagctcagcttggtagagcacatggtttgggaccatggggtcgcaggttcgaatcctgtcttcccgaccacttcggggccttagctcagctgggagagcgcctgctttgcacgcaggaggtcagcggttcgatcccgctaggctccaccatttataaaaaaacatgttgactttaagagaaacttattatatacttaaaaagttgcttgagaaagtgaacaaaatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgcccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatattagacctcgggtcttataaacagtacgttccctgtcttgtttagttttgaaggatcattcgattcttcgagatgttgttctttgaaaactagataacagaagtaattcacattcaattgtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagatggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctatatttacggtaaaggcagctcatcatgagctgccttttttgtgtttttctgcatacgttatatagtatgagaaaagtaacgatatggctttttgcaaaagcaggttttatgcttgtgtaaagtggaaataatagagatagagcgatacagttgaaaaattttgcgaaacaccttatagtaagattaaagtcaaatatagtcaaagtcaataaaggagggggttgagtgggacataatatttctgacatcattgaacagtacttgaaacaagtattagatcaaaatggcaaagaaattttagagatcaaacgcagtgaaatcgctgataaatttcaatgtgttccttcccaaataaattatgtcatcaacaccagatttacaagtgaaagaggatatattgttgaaagtaaacggggaggcggcggttatattcgtattatcaaaattaaaatgaataacgaagtcgtcctcatcaataatattatttcgcagatccatacccacttgtcccaggcagcctctgatgacattattctcagactgttagaggacggagttatttcggaaagagaagctaaaatgatggtgagtgtaatggatcgttcagttctatatattgatttgcccgaacgggatgaactaagagccagaatgatgaaagcaatgctcacatctttaaaactaaagtaagcgggtgaaaagattgatttgtcaagaatgcaatgagagaccggccacttttcactttacgaaagttgttaatggagaaaagcaagaagttcatatttgtgaacaatgtgcaaaagaaaatagcgattcatacagtataagtggaaaccaagggttctcaattcataatttattatcaggactgctgaatatggagtcctcatttcaaaacaccggttctcaaatgttcggctactcagagcaaggcacagcttgtaagaaatgcggtatgacgtttcagcagctgagaaaaacagggcgtttcggctgtgcggaatgttacgatacgttctacagccaaattacgccgatcttgcgaaaagttcacagcgggaatacggtgcatgccgggaaaattccaaaacgaataggcggaaacctgcatgtaagacggcaaatggaaatgttaaaaaaagaacttgaatctttaatacaccacgaagagtttgaaagagcagcggaggtcagggatcagatccgatcgttagagcaggaattaaaaagtacagacagtgagggggaacaagggtaatgtcgctcaagcattttattcaggacgcactaagcaattggatgaagcaaaagggacctgaaagtgacattgtactcagcagccgtatacggttggcccgaaactttgaaaatataaagtttcccgcccggtatacgaatgaagaagcctcatccatcattcagcaattcgaagatcatttttcaggtaaggaactgcctgatatcggtcaatttcatttaatcagaatgagtgaagctcagcctttggaaaaacgggtgctgatggagaaacatctgatcagcccgaatttaacggaatctccttttggcggctgtctgctttctgaaaatgaagaagtcagcattatgttaaatgaagaagatcatatcagaattcaatgcctcttccccggcttccagcttctcaacgccataaaagcggcaaaccaggttgatgactggattgaggagaaagtggattacgcctttggagagaagagagggtacttaacaagctgtcctacaaatgtagggacgggactaagggcttcagtcatgatgcatttgccgggtcttgtattaactaggcaaatgaatcgaattataccggcaattaaccaattaggcttagttgttagaggaatttacggtgaaggcagcgaagcattaggaaatatctttcaaatttcaaatcaaatcacactcggaaaatcagaacaggacattgtagatgatttaaacagtgtggctgcccagctgattgagcaggaacgttcagcccgagaagcgctttaccaaacttcgaaaattgaattggaggaccgggtattcagatcttacggcgttttatccaactgccgtatgattgaatcaaaggaaacggcgaaatgcctttctgacgttcggctggggatagaccttgggatcatcaaagggctatcaagcaatatacttaatgaactgatgattttgacacagccgggttttctccagcaatattcgggcggtgcattacggccgaacgaaagagacgcgagaagagcggcgcttatcagggaaaggctgcatttagaaatgagtgcaaatagacaggaggatgattcgatatgatgtttggaaggtttacagagcgagctcaaaaggtattggcactggcacaggaggaagcactgcgcttaggccataacaatattggaactgaacatatcttattaggtctggttcgtgaaggagaagggattgcggctaaagcactccaagcactcggactcggttcggataaaattcagaaagaagtggagagcttaatcggacggggacaggaaatgtctcaaacgattcattatacgccaagagcaaaaaaagtcattgagctcagcatggatgaagccagaaagctaggacattcttatgtgggaacagaacacatacttctcggattgatccgtgaaggagaaggcgtggcggcgagagttctgaataatctcggtgtcagcttaaataaagcgagacagcaagtgctgcagcttctgggaagcaatgagacggggtcttctgcatccggtaccaacagcaatgcaaacacgccgacgcttgacagtctggcgcgtgatttaactgcgattgcgaaggaagacagtcttgatccggttatcgggcgaagcaaagaaattcagcgtgttattgaggtattaagccgcagaacgaaaaataatcccgttcttatcggagaaccgggtgtaggtaaaactgcgattgctgaaggcctcgcacagcagatcatcaataatgaagtgccggaaattttacgtgataaacgcgtaatgacgttagacatgggtacggttgtagccggtacgaaataccgcggagaatttgaagaccgcttgaaaaaagtaatggatgaaatacgtcaggccggcaatattattttattcattgacgaactgcatacactgatcggagcggggggagcagaaggtgcgattgacgcatcgaatattttaaaaccttcactggcccgcggagagcttcaatgcatcggtgccacaacgcttgatgaataccgtaaatatatcgaaaaagacgcggctctcgagcgccgtttccagccgattcaggtggatcagccgtcagccgatgaaagcattcaaattttaaaagggctccgtgaccgctatgaagcgcatcaccgcgtatccattaccgatgaagcgatcgaagccgcggttaaattgtccgaccgttatatttctgaccgcttccttccggataaagcgatcgatttaattgatgaagccggttcaaaagtgcgtctccgttctttcacaacgcctccgaacttaaaagagcttgagcagaaactcgatgaagttcgcaaggaaaaagacgctgccgttcagagccaggagtttgaaaaagcggcttcccttcgtgatacggagcagcgcctgagagaacaggtggaagacacgaaaaaaacctggaaagaaaaacaaggccaggagaactccgaagtttctgtagaggatatcgcgatggttgtatccagctggaccggggtgcccgtatctaaaattgcccaaacggaaacagataagcttctcaatatggaaagcattctgcattcccgcgtcatcggccaggatgaagccgttgtagccgtggcaaaggctgtcagacgtgcaagagccggactgaaggacccgaaacgtccgattggttcattcatcttcttaggccctacaggcgttgggaagacagagctggcaagagcgctggcggaatccattttcggtgatgaggaagcgatgatcagagtggatatgtccgaatacatggagaaacactcgacttcacgtcttgtcggttctcctccgggatatgtcggctatgatgaaggcggccagctgacagaaaaagtgagaagaaaaccttactctgtcgtattgcttgatgaaattgaaaaagcacaccctgatgtgtttaacattctcctgcaagtgcttgaagacggacgcttgactgattcaaaaggacgcactgtggatttccgcaacacgatcctgattatgacgtcaaacgtcggggcgagcgagctgaagcgcaacaaatatgtaggcttcaatgtccaggatgaatcacaaaaccataaagacatgaaagacaaagtcatgggagagttgaagcgtgccttcagacctgagtttatcaaccggattgacgaaattatcgtcttccactcccttgagaaaaaacatcttacagacatcgtgtcgcttatgtctgatcagttaacaaaacgtctgaaagaacaagatctctctatcgagctgacggatgctgccaaagcaaaagtagcagaagagggcgtcgatttggaatacggcgcacgtccgttaagaagagcgattcaaaagcatgtggaggaccggttatcagaagaactcctcagaggcaatattgataaaggccaacacattgttcttgatgttgaggacggcgaatttgtcgtaaaaacaactgctaaaacgaactaatatagtgacaaacatgaggcatacgtaagcgagtgtatgcctcactttgttatatagagaaatattcgataaggaagaggtcttacaacatatatggctaaatcaaaaacaaaattcatctgccactcatgcggttatgaatccgcaaaatggatgggaaagtgcccgggctgcggggcttggaatacaatggtggaagaaaccataaaaaaagcgccggcgaatcggcgggcggctttctcccactccgttcaaaccgtccagaaaccatcacccattacatcaattgaaacatcagaagaaccccgcgttcaaacaaagctcgaagaattcaacagagtgcttggcggcggcgttgtgaaaggctcgttagtattgatcggcggcgatcccgggatcggaaaatcaacgctccttctccaagtatccgcacaattagcagatacggccggcagcgtgctttacatttcaggggaagaatccgtgaagcaaacgaagctgcgcgccgacagacttggcatcaacagccaaatgttacatgttttatctgaaaccgatatggagtatatttcgtctgctatacaagagatgaaacccgcatttgttgtcgtagactccattcagaccgtttaccaaagtgatatcacctcagctcccggcagtgtatcacaagtaagagagtgtacggccgaattgatgaaaatcgcgaaaacaaacggcatacctatttttatcgtcggacacgtcacaaaagaaggatcgatcgcagggccgagattgcttgagcacatggtcgataccgttctatactttgaaggagagcggcatcatacattccgtattttgcgggccgtaaaaaaccgtttcggctcaacaaatgaaatgggcatctttgaaatgcgggaagaggggcttacggaagtgctcaacccttctgaaattttcttggaagagcgttctgccggggcatcgggttcgagtatcgttgcgtcaatggaaggaacgagaccgattctggttgaaatccaggcgctcatatcaccgaccagttttggaaacccgcgccgcatggctacaggcattgaccacaacagggtatcgttaattatggctgtgcttgagaagcgggtgggtcttttgcttcaaaatcaagatgcatatttaaaagtcgccggcggggtcaaactggatgaaccggcgattgatttggcagtagccgtcagcattgcctcaagcttcagagatacaccgccgaatcccgcagattgctttatcggtgaagtgggactgacaggagaagtccgcagggtgtcaagaatcgaacagcgcgtaaaagaagcggcgaaactcggcttcaagcgcatgatcatacctgaggcgaatgcagatgggtggacaataccaaaagggattgaggttgtcggagtagcaaatgttgcagaagcgcttcgtacttcattaggaggatcataatagatggaaaaagagaaaaaaggggcgaaacaagagcttgacctgtctgcaattctgcagttcgttgcaccgggcaccccgctcagagccgggatagagaatgtacttcgggcaaatacaggcggcctgattgttgtcggatacaatgataaggtaaagcaagtcgtcgatggcggttttcatattaatacatcatttgcgcccgctcacttatacgagctggccaaaatggacggtgccattattttaagtgattccggccagaaaattctttatgcgaatacacagcttatgccggaggcgaccatttcttcttcagaaacgggaatgaggcaccgtacggcggaacgggtggcgaagcagaccggctgtctcgtcatcgccatttctgagcgcagaaatgtcattacgttatatcaggacagcatgaagtacacactaaaggacataggttttattttaacaaaggcaaatcaggccattcaaacgctcgagaagtataaaaccattttagacaaaacaattacggctctaaacgcattagagtttgaggagcttgtgacattcagtgacgtgctgtctgtcatgcatcggtatgaaatggtgctccgaataaaaaatgaaatcaatatgtatattaaagaactcggaacggaaggacacttaatccgtctgcaggtgattgaactgattacggacatggaagaagaggcggcacttttcatcaaagactatgtcaaagaaaaaatcaaagatccgttcgtgctgttaaaagagctccaggatatgtccagctatgatctgctggatgattccattctgtttaaactgcttggatacccggcttctacgaatcttgatgattatgtgctcccgagaggctacaggctgctgaacaaaattccgcgtctgccgatgccgattgttgaaaatgtggttgaggcgttcggatttttgcccagcataacggaagccactgtagaagagcttgatgatgtcgagggtatcggcgaagtgcgcgcccaaaaaatcaaaaaaggcttaaaacgccttcaggaaaaacactatatagatagacagctttaagtatcgcttaaacctgtcggaatccgggtatattattgttagtttttgtttattctgaatttgtaggctctgacagtctgctgaaaaaatgctacttaaaaggaggtggaggtatgttaaaacgaatagttcaggcgttcttcattattgtgggcggcgttgtcggtatctttttaatacctgaattgtttgtgctgtcaaatatacaggacatacctttaataacaaacgcatatacgtctgctgcaattggtgctattatcttttttctcatcagtatatggacgacagaatatgtgattaattgggtaaaatggattgaagattctttgctgagagctccggtgccggatctgttattcgggagtctcggattggtttttggacttatcatcgcatatctcattgtaaacgtgattccgctggacaatattccgtaccgtatattcagcaccatcattccggtctttctggctttctttctcggttatctgggcttccaagtcggatttaagaaaaaggatgaactgatcagtcttttctccatttctgcaagaatgcagaagaaaaagggaagtgctgatgaggagcaggaagaacaggataaaaggctgaaaatcttggatacaagtgttattattgatgggagaattgcagatatttgtcagacgggctttttagaaggcgtcattgtcattcctcaatttgtgctggaggaattacagcatatcgctgattcttcagatgttttaaaacgtaacagaggacgccgcggactggatatcttgaatcgcattcaaaaggaactggatattacggttgaaatttatgaaggcgacttcgaagacattcaggaggttgacagcaagcttgtcaaacttgcgaagctgacatccggtgtcgttgtgacgaatgattttaatttaaataaagtatgcgagcttcaaaaggttgcggtactgaatattaatgaccttgcaaacgcggtgaagccggttgtgcttccgggcgaagagatgaatgtgcaggtgattaaggacgggaaagagcataatcaaggtgtggcttacttagatgacggcacaatgattgttgtggaagaaggccgcaattatatagggaaacatattgatgtgctcgtaaccagcgtactgcagacagcggcgggacgaatgatttttgccaagcccaagctgcttgagaaagctctttaagagggagttcatatggagtatgttgtcgttattccggctgccggacaaggaaaacggatgaaggccgggaaaaataagctgttcatcagcttaaaaggtgcgcccgttattatacacacactgcgggtttttgaaagccacgcaccctgtcagaaaataatcctggtgataaacgagagtgaacgggaagattttcgccagctgctggtccaatttccgattcagacggaaattgagcttgttaccggaggtgcggagcgtcagcacagtgtatacgaaggactgaaagtgattgataaggaatcggtcgtgcttgttcatgacggagcgcgcccgtttgtcacacatcagcatatcgataagctcgttgaaacagcagaggaggcgggagcggctgtcctggctgttcctgtgaaagacacgataaaacgggcggaaggctcccgggctgcggagacctttgatcgttcaagcttgtgggccgttcaaacgccgcaagcttttcgtctttctttattgaagacggcgcatatggaagcggaaaacaaaggcttcttaggtacggatgacgccagcctcgtcgagcgtcttgatggatatcaggtgagtatcgttgaaggcagctataccaatattaagctgacaacgccggatgacctgatatttgcggaagcaatcatgaaagcggaaagtgggaatcataatgtttagaatcggacaaggatttgatgtgcatcaattaacggaaggccgtccgctcatcatcggcggaattgaaattccttatgaaaagggactgctcggacattcagatgctgatgtattgctgcatacagtcgcagacgcgtgtctcggagcggcaggtgaaggagatatcggcaagcatttcccggatactgatccggaattcaaggatgctgattcttttaagctgcttcagcatgtctggaacattgtaaaagaaaaagggtacgtactcggaaatatagactgcacgattattgcgcaaaagccgaaaatggcgccgcatattgatgctatgagaaaacggatagcggaaggccttgaggcggacgtctctcaagtaaacgtaaaagcgacgacgactgaaaagctcgggtttaccggaagagccgaaggaattgccgctcaggcaaccgttctgattcaaaaagcctgatcattgttttgatgccgggtctatttggtggtagaatagatacatatattcggctagaggctacagacgagatgaaaggaagtatttgaacatgggaaatgaagtacgcgttcgttatgcaccgagtccgaccggacatttgcatatcggtaacgccagaacggcgctttttaactatttatttgcccgcagccaaggcggaaagtttattatccggattgaggatacggacaaaaagcgaaatattgaaggcggagagcaaagtcagcttaactatttgaaatggctcggcatggactgggatgaaagtgtggatgtcggcggagaatacggcccgtaccgccagtctgagcgtaacgacatttacaaagagtactatgaagagcttcttgaaaaagggcttgcttataaatgtttctgtacggaagaagaacttgaaaaagaacgtgaagagcaaatcgcccgcggggaaatgccgcgctattccggcaaacacagaaacctgactcaggaagagcaggagcagtttttagccgaaggcagacagccgagcatccgtttccgcgtgccggaagggaaaatcatcgcatttaacgatatcgtaaaaggcgagatttcttttgaatcagacggcatcggcgactttgtcatcgtcaaaaaagacggaacaccgacgtataactttgccgtcgcgattgacgattacttaatgaaaatgacgcacgtgctccgcggtgaggatcacatttcaaatacaccgaaacagatcatgattttccaggcattcggctgggatattcctgtcttcggacatatgacgcttatcgtaaacgaaagccgcaaaaaattaagtaaacgtgatgaatcaattatccagtttattgagcagtatgatgagctgggttacctgcctgaagcgctgtttaactttatcggacttctcggctggtctcccgtcggtgaagaagagcttttcacaagagaacaattcattgaaatttttgatgtaaatcgtttgtctaagtcaccggctctgtttgatatgcataaactgaaatgggtcaacaaccaatacgtcaaagcgctggatcttgatcaagtggttgagctgaccctgccgcacctgcaaaaagcaggaaaagtcggcactgagctttctgccgaagaacaggaatgggttcgtaaattaatctctctttaccatgagcaattgagctacggcgctgaaattgtcgagcttactgatttgttctttaaagatgagatcgagtataatcaagaggcaaaagccgttctggaagaagaacaggtgcctgaagtgctcagcgtatttgctgcgaagcttgaagagcttgaagaatttacgcctgagctgatcaaagcctcaatcaaagctgttcagaaagaaacaggccataaaggcaaaaagctgttcatgccgattcgtgtagcggttaccggtcagacacacggtccggagcttccgcaggccattgagctgatcggcagagaaacagccgtcagacgcctgaaaagcatttaaatatacgattgttgacagggaagagtataaaacaatgaccattacagaaagaatcttcatcggctgagagagattcatgcgtcatgttttagaagtgcgcccttaagacctttgaagaacatttctgcggaaatcagtatttaaaggcggccgccgccgttaccggcttttaagttgggaaaacattgacttgtttttcaaacagagtggaaccgcgcggtaaaagcgtctctgtcatgtttacatgcagaggcgctttttttataggcggaaaaacagactggagcggggagagaatggggggaagcatgtgttttttaaaatgctaaaagaagacatagatacagtgttcgatcaagatccggcagcaagaagctatttcgaagttgttttaacttattctggtttacatgctatatgggcgcatcggattgcacatgctttatataaacggagatttttcttcctggcgcgcctgatatcacagattgcccgtttctttaccggaattgaaatccatcccggcgcgaccatcgggagaaggtttttcattgaccacggtatgggggtcgtcataggggaaacatgtgaaatcggcaataacgtgacggtattccaaggtgtcactctcgggggaacgggaaaagaaaaggggaagcggcatccgaccataaaagatgatgctttaattgcaaccggagcgaaggtgctcggctctattacggtcgggcagggttctaaagtaggggccggctccgttgtgcttcgtgatgttcccgacttttcgaccgttgtcggcataccggggaaagtcgtcattcagaacggaagaaaaatcaaacgcgatctcaatcaccaagacttgcccgatccggttgctgaccggtttagagcattggagcagcagatttttgaactgcaggctgaactggaagataaaaaagaaaggatcaaccaaaaatgaccattacactttataatacattgacacggaaaaaggaaacatttgttcctcttgaggaaggcaaagtaaaaatgtacgtgtgcggacctactgtatacaactatattcatatcggaaacgctcgtccggcgattgtgtatgataccgtacgcaactatttggagtataaaggatacgatgttcaatacgtatcgaatttcaccgatgttgacgacaaactgattaaagcggccaacgagctcggcgaggacgtcccgaccgtttctgaacggttcattaaagcgtattttgaagacgtgggcgccctcggatgccggaaagcggatcttcacccccgggtcatggaaaacatggacgccattattgaatttgtcagcgagctgattaaaaaaggctacgcttatgaatcagaaggcgacgtctatttcaaaacaagggccttcgaaggctacggcaagctatctcagcaatcaattgatgaactcagatcaggcgcgcgtatccgtgtcggcgagaagaaagaggatgcgctggactttgcgctttggaaagctgctaaggacggagaaatttcatgggatagcccttggggaaaaggccgcccgggctggcatattgaatgctccgcaatggtgaaaaagtatttgggtgacgaaatcgatattcacgccggcggtcaggacctgacattcccgcaccatgaaaacgaaatcgcgcaatctgaagcattaacaggcaagacattcgcaaaatactggcttcacaacggatatatcaatatcgataatgagaaaatgtcaaaatcgctcggcaactttgttttggtgcacgatatcattaagcaatatgacccgcagcttttgagatttttcatgctttccgttcattaccgccacccgatcaactattcggaagagctgcttgagaaaacaaaaaacgcgtttaaccgcctcaagacggcatacagtaatttaaaccatcgtttgattagcagcacgaatctgactgacaatgatgaggaatggctcgctaaaatcgaagagcaccgcgcttcgtttgaagaagcaatggatgatgattttaatacggcgaatgcgatttccgtttggtttgatctggcgaagctcgccaattactacatgcaggaagacaatacggcggatcacgtcattaaagcctttatcagcatgtttgacagaatcggatctgttctcggacttacgctcggcgaagaagagcttgtcgacgaagagattgaagagttgattgagaagagaaatgaagcccgccgcaatcgcgatttcgctttgtcagaccagattcgcgatcagctgaaaagcatgaatatcattcttgaagacacagcccagggaactcgctggaagcggggagaataagcggatgcttcaatttgaacaaatcaaagattcaaagcagttaaacggtcttgcgcttgcttatatgggtgatgccatttttgaaatatacgtccggcatcacctgcttaagcagggctttacgaaaccgaatgaccttcataagaaggcgagccggattgtatcggcaaaatcacaggcagacatattgttccgccttcaggacgaatcctttttcacggaggaagaggaagccgtgctgagaagaggcagaaacgcgaaatcagggaccacgcctaaaaacacagatgtacagacgtaccgccatagtacagcttttgaggctttactcggatacctttttcttgagaaaagagaagaaagactgaatcagctgattgctgaggctatacaagtcgggacgtcagggaggaaaacaaatgagtcagcaacatgattacgtcataggaaaaaacgctgtgattgagacgttaaagtcagatcgcaagctgtataagttatggatggcggaaaacacagtaaaaggacaggcgcagcaagttatggagcttgctaaaaagcgcggcgtcaccattcaatttgtaccgaggaaaaaactcgatcagatggtggaggggcagcatcagggtgttgtcgcccaggtggcggcatatgaatatgcacaattagacgaattatataaaagagcggaagagagaaacgaacagcctttctttctcatattggacgagctggaagaccctcataatctcggttccatcatgagaacggctgacgctgtcggtgcacacggcattgtgattccgaaacgcagagcggtcggactgacatcgacggtcgcaaaagcttcgaccggtgcgattgaacacattcccgtcgtgaaggtgaccaaccttgcccggacacttgatgaaatgaaggagcgggggatttgggtcgtcggaacggatgcatccgcccgggaagactaccgctctatggacggcaagatgcctttggcgctcgttatcggaagcgaaggcagaggaatgggccggcttgtgaaagagaaatgtgattttctcattaaacttccgatggccggaaaagtcacgtctctgaatgcgtcggtagcggccggccttctcatgtatgaagtctaccggaagcgcaatcctttaggggaataatgacagatggacatcctgttagtagacggatacaacatgattggagcttggccgcagctaaaggatttaaaagcgaacagttttgaagaagcgagagatgtactgatccagaagatggcggaatatcagtcctacacgggaatcagagtcattgtggtgtttgacgcacatctggtaaaaggcatagagaaaaaacaaacgaatcacagagtcgaagtgatttttacacgggagaatgagacggcggatgagcggatcgagaaacttgcccaggcgctgaataatattgcgacacagattcatgtcgcaacctccgattatacggagcagtgggcgattttcggacaaggggctctccgcaaatccgcccgggagcttctgagggaagtggatacgatagaacggcggattcaaaggcgggtttcaaagatcacttctgaaaaaccaccgggtaaaatcgagctgtccgaagaggttttgaaaacgtttgaaaagtggcgccgaggcggtctggattaggttgacgctttttcgcccattaatgtataatatttctatctacgtgcgccggggggatcgcagtgaatctacagaacagcaagggaaagttcaacaaagtgcaattttgccagttggaggacgagcaggtcattgaaaaggttcatgttggggatagtgatgcgttagattacttgattacgaagtaccgtaattttgtacgggcgaaagcaaggtcttattttttaataggggccgacagagaagatattgtacaggaagggatgataggcttatataagtctatccgagactttagagaggacaagcttacttcatttaaagcttttgcagaattatgcattacccgccagattattaccgcaataaagacagctacccgtcagaaacacattcctttaaattcctatgtttctttagacaaacctatttttgatgaagaatctgacagaacactgcttgatgtcatttcaggcgctaaaacgttaaatcctgaagagatgattattaatcaggaagaatttgatgatatcgaaatgaaaatgggagaactgctgagcgatctggagagaaaggtgcttgttctgtacttggacggaagaagttaccaggaaatttcagatgatttaaaccgacacgtaaaatcaatcgataatgccctgcagcgcgtgaagcgcaagcttgaaaagtatttggaaataagagaaatcagtctgtagcgggtttctgtgtcatattgacagaatttttctgactgtgctattttattaagataaatgattgtttaggaaaaggtgtaacgacatgagaaaaaagattacgctggcatgcaaaacatgcggaaatcgtaattatacgacaatgaaaagctctgcatcagcggctgagcggttagaagttaagaagtactgcagcacttgcaattcacatacagctcatttagaaacaaaatagtgttcgctttttaaattgtggaggtcttttacatgcgcatgatgagtttctttaaagatgttgggaaagaaatgaaaaaggttagctggcctaaaggcaaagagttaacgcgctatacgatcacggtgatttcaacggttatcttttttgttatcttttttgccctccttgatacaggaatttctcaattaattcgtttaatagttgaataatgatcagcaatacgtgctataatagatcataatatcgtttgccaaaacccgttcagcgggttttttattgtgttgaaaaaaggattcataggctctgagcctattttttgttttacacttcatttttaaatgcggggagggaaggactgcagagtcctgatagaatggaaaagaattggtatgttgttcatacgtattccggttatgaaaacaaagtaaaagcgaaccttgaaaaacgtgtggaatcaatgggaatgcaggataaaattttccgcgttgtcgtccctgaagaggaagagactgatattaagaacggcaagaaaaaagtagtcaaaaagaaagtgttcccgggttatgtgcttgttgaaatcgtcatgactgatgattcctggtatgtggtccgcaacacgccgggcgttaccggattcgtcggatcagccggttcaggctcaaagccgactccgcttcttcctggcgaagcggaaaccatcttaaagcggatgggcatggatgagcggaaaaccgacattgattttgaattgaatgagacagtcaaagtcatagacggacctttcgccaactttacaggatcaattgaagagattgattatgataagagcaaagtgaaagtattcgttaacatgttcggccgtgaaacgccggttgagctggaatttacccagatcgacaaattgtaatgtgaaaaaacttgaaattgctatatattaatgataatatagcaaaggtacgtcttggactaatccaaggcagctagcttgatatttcgtcattcatataaagaatgaaaccttgagtgggagggtttaccctattaccacatcacggacttaaggaggtgtgtctcgtggctaaaaaagtagtaaaagttgtaaaattgcaaattcctgctggaaaagctaacccagcgccgccagttggacctgcactaggtcaagccggtgtaaatatcatgggattctgtaaggagtttaacgctcgtacagctgaccaagctggtttaatcattcctgttgaaatttcggtttacgaagaccgttcatttacatttattacaaaaactccgcctgctgcagtattgcttaaaaaagcagctggaattgagtctggttctggtgaaccaaaccgtaataaagtggcaaccgttaagcgcgataaggttcgcgaaatcgctgaaacgaaaatgcctgacttaaacgcagcagacgttgaagcggcaatgcgcatggttgaaggtactgcccgcagtatgggtatcgttatcgaggattaatttgtttcttgtcgggttgcgagttttcacaagttcgcaacccttattcgtgggaggttattccgctataaccacataaggaggaaattttaaaatggctaaaaaaggtaaaaagtacgttgaagctgcgaagcttgtagaccgtgcgaaagcttacgacgtcgctgaagcagtggcgcttactaaaaaaacaaacacagctaaattcgacgctacagttgaagttgcttttcgtttaggggttgaccctcgtaaaaacgatcagcaaatccgcggtgcagttgtacttcctaacggaactggtaaaactcagcgcgtgcttgtattcgctaaaggcgaaaaagcaaaagaagctgaagctgccggtgcagactacgtcggtgattctgattacatcgcgaaaatccagcaaggctggttcgaattcgatgtaatcgttgcgactcctgacatgatgggtgaagtcggtaaaatcggccgtgtgcttggaccaaaaggtcttatgccaaaccctaaaacaggaactgttacattcgaagtagaaaaagcaatcggcgaaatcaaagctggtaaagtagaataccgcgttgacaaagctggtaacatccatgttccgatcggaaaagtttctttcgaggatgaaaaacttgttgagaacttcacaacaatgtatgatacaatcctgaaagcaaaaccggctgcggctaaaggtgtttacgtgaaaaacgttgccgttacttctactatgggccctggtgtcaaagtagacgcttctactttcaacgtaaaataatatttgactttagatcagcattctgatatgattcaaaatgttgtaaaatataatatgtcatttataccgtagacagcaggggccgttgaggcttaatatcctgccgaggtgtatatatatcacagctattacgttacgtatgcttgtatatacagcctccatgtccacatggaggctttttatatgaaatcgtcgtcacagtcgtgatcacctagcggtataagtgttacacaaaatctacaggaggtgtaaccatgagcagcgcaattgatacaaaaaaagttgttgttgaagagattgcttctaaactgaaagaaagcaaatcaacgatcatcgttgactaccgcggacttaacgtttctgaagtaactgaactccgtaaacagcttcgcgaagctaacgtagagttcaaagtgtacaaaaacacaatgactcgccgtgcggttgaacaagctgaacttgatggtttgaatgatgtcttaactggaccgaatgcgatcgcattcagtactgaagatgttgtcgctccggcaaaagttcttaacgagttcgcgaaaaatcacgaagctctggaaatcaaagcgggcgttatcgaaggaaaagtatcttctgttgaagaagtgaaagctcttgctgaacttccttcacgcgatggcttactttctatgttgcttagcgtacttcaagctccagttcgcaaccttgcacttgcagctaaagcagttgcagaccaaaaggaagaacaaggcgcttaatctgattttaccctaaaataaaacaaatggaggaatttcaaatggctttaaatatcgaagaaatcattgcttccgttaaagaagcaactgtacttgaattgaacgacctagtaaaagcaatcgaagaagaatttggcgtaactgctgctgctcctgtagctgtagctggcggagctgctgctggcggcgctgctgaagagcaaagcgaattcgaccttatccttgctggtgcaggttctcagaaaatcaaagttatcaaagttgttcgtgaaatcactggtcttggcttgaaagaagctaaagaacttgttgacaacactccaaaaccacttaaagaaggtattgcgaaagaagaagctgaagagcttaaagctaaacttgaagaagttggcgcttctgtagaagttaagtaatcttcacttgcctgtaggggaagctcgcttttatgaggcgggctttttctttgcttttctttaagtgcaattaaaaaaggaggttctaataatgagtgaacactattattcagaaaaaccttcagttaaaagcgataaacagacatggtcatttacactgcggaacagatcttatacattcacaagtgacagcggcgttttctcgaaaaaggaagttgatttcggttcgcgtgtcttaattgaagcgtttgaagagccggagatcgatggtgacttcctggatgcaggctgcggttacggcccgatcggtctgtcgctcgccggtgcatttacagaccggaccgtgcacatgattgacgtgaatgaaagagccgtagagctgtcaaatgaaaatgcagaaaaaaacggaataaaaaacgttcggatttatcagagtgatttattttcaaatattgattctgctcaaacatttgcttctattattacaaaccccccaatccgcgccggaaaaaaagttgtccatgccatttttgaaaaaagcgctgagcatttaagggcttcaggtgaattgtggatcgttatacagaaaaaacagggcgggccttctgccattgaaaaactgaaggagctttttgacgaagtttctgtggttcaaaaaaagaaaggctattatatcataaaagcaaaaaaagtttgacttgaattttcagctatgttaatattgtaaaatgccaatgtatatattttgcatgatatgctcaaataatcatagtgcatgtataaattatacaaacatggaaatgctaataaaatcggtatttgtttttggatgtggttttcttaattagaaacccttttttcttttgtcttgtaaaagtatttctttatcgtaagagatgcttattacacatataatacgcatgatttgaggggtgaatcagttgacaggtcaactagttcagtatggacgacaccgccagcgcagaagctatgctcgcattagcgaagtgttagaattaccaaatctcattgaaattcaaacctcttcttatcagtggtttcttgatgagggtcttagagagatgtttcaagacatatcaccaattgaggatttcactggtaacctctctctagagttcattgactacagtttaggagatcctaagtatcccgttgaagagtcaaaagaacgtgatgtgacttactcagctccgctaagagtgaaggttcgtttaattaacaaagaaactggagaggtaaaagaccaggatgtcttcatgggtgatttccctattatgacagataccggtacttttatcatcaacggtgcagaacgtgttatcgtatctcagcttgttcggtctccaagtgtatatttcagtggtaaagtagacaaaaacggtaaaaaaggttttaccgcgactgtcattccaaaccgtggcgcatggttagaatacgaaactgatgcgaaagatgttgtgtatgtccgcattgatcgcacacgtaagttgccggttacggttcttttgcgtgctctcggcttcggttccgaccaagagattctcgatctcattggtgagaacgaatatctccgcaatacactggataaggacaacaccgaaaacagtgacaaagcgcttcttgaaatctatgagcgccttcgtcccggagagccgcctacagtagaaaacgcaaaaagcttgctggattcccgtttcttcgatccgaagcgatacgaccttgcgaatgtaggacgctataaaattaataaaaagcttcatatcaagaaccgcctgtttaaccagcgccttgcagaaacactggtggatccggaaaccggtgaaattctcgctgaaaaagggcagattcttgacagaagaacacttgataaagtattgccatacttagaaaatggaatcggcttcagaaaactttatcctaacggcggcgttgtcgaggatgaagtgatgcttcaatccattaaaatctatgctcctactgatgcagaaggagagcagacgatcaatgtgatcggcaatgcttacatcgaagaggcgattaaaaacattacgcctgctgatattatttcttctatcagctacttcttcaacctcctgcacggagtgggcgacactgatgatatcgaccatctcggaaaccgccgtctgcgttctgtaggtgagctcctgcaaaaccaattccgtatcggtttaagccggatggaacgtgtcgtacgtgaaagaatgtctattcaagacacgaatacaattacgccgcagcagctgattaacatcagacctgttattgcgtctattaaagagttcttcggaagctcacagctttctcaattcatggatcagacgaacccgcttgctgaattgacgcacaaacgccgtctgtcagctctcggaccgggcggtttgacgcgtgagcgcgcaggtatggaagtacgtgacgttcactactctcactacggccgtatgtgtccgattgaaacgcctgagggcccgaacatcggtttgatcaactcattgtcatcatttgcgaaagtaaaccgctttggtttcattgagacgccataccgccgcgttgatcctgaaacaggaaaagtaacgcctagaatcgactacctgactgctgatgaagaggataactatgtcgtagcccaagcgaatgctaagctgagcgatgacggttctttcttggatgacagcatcgtagcgcgtttcagaggggaaaacaccgttgtagcccgcaaccgcgtggattacatggacgtatctcctaaacaggttgtttctgctgcgacagcatgtattccgttcttggaaaacgatgactcgaaccgcgccctcatgggagcgaacatgcagcgtcaggctgtgcctttgatgcagccggaagctccgatcgtcggaacgggtatggaatacgtatccggtaaagactccggtgcagccgttatttgtaaacaccctggtatcgtagaacgggtggaagcgaaaaacgtatgggtgcgccgctatgaagaaattgacggccaaaaagtaaaaggcaacctggataagtacagcttgctgaaatttgtccgctccaaccaaggtacgtgctacaaccagcgtccgattgtaagtgtcggcgatgaagtagtcaaaggagaaatccttgctgacggaccttcaatggagcttggtgaacttgctctcggccgcaacgtaatggtcggcttcatgacatgggacggttacaactatgaggatgccatcatcatgagtgaacgccttgtgaaagatgatgtatacacatctattcacattgaagaatatgaatcagaagcacgtgatacaaagcttgggccggaagagatcacccgcgatattccaaacgtaggggaagacgcgcttcgcaaccttgatgaccgcggaattatccgtatcggcgcggaagtcaacgacggagaccttctcgtaggtaaagtaacgcctaaaggtgtaactgagcttacggctgaagaacgccttcttcatgcgatctttggagaaaaagcgcgtgaagtccgtgatacttctctccgtgtgcctcacggcggcggcggaattatccacgacgtaaaagtcttcaaccgtgaagacggcgacgaacttcctccgggagtgaaccagcttgtacgcgtatatatcgttcagaaacgtaagatttctgaaggtgataaaatggccggacgtcacggaaataaaggggttatctcgaagattcttcctgaagaagatatgccttaccttcctgacggcacgccgatcgatatcatgcttaacccgctgggtgtaccatcacgtatgaatatcggtcaggtattagaacttcacatgggtatggctgcccgctacctcggcattcacatcgcgtcacctgtatttgacggcgcgcgtgaagaagatgtgtgggaaacacttgaagaagcaggcatgtcaagagacgctaaaacagttctttatgacggccgtacgggagaaccgttcgacaaccgtgtatcagtcggaatcatgtacatgatcaaactggctcacatggttgacgataaacttcatgcccgttctacaggtccttactcacttgttacgcagcagcctctcggcggtaaagcccaattcggcggacagcgtttcggtgagatggaggtttgggcgcttgaagcttacggcgcagcttacacgcttcaagaaatcctgactgtgaagtccgatgacgtggtcggacgtgtgaaaacatatgaagccatcgtcaaaggcgacaatgttccagagcctggtgttccggaatcattcaaagtattgatcaaagagcttcaaagcttaggtatggacgtaaaaatcctctcaggcgatgaagaagaaatagaaatgagagatctagaagacgaggaagatgcgaaacaggctgacggccttgcattatcaggtgatgaagcgccggaagaaacagcatctccagacgttgaacgtgacgcagtaacgaaagaatagtctctgattgataaaggcaagtgacatcggttaatccgaagataaaaagggaggtaggccccttgctagatgtgaacaattttgagtatatgaacatcggtcttgcttcaccggataaaatccgttcatggtcttttggtgaagtgaaaaagcctgaaacgataaactatcgtacgttgaaacctgaaaaggacggcctgttctgcgaacgcattttcggaccgactaaggactgggaatgtcattgcggcaagtacaagcgggttcgttataaaggcgtagtttgtgaccgttgcggagttgaagtaacgcgggctaaagtccgtcgtgagagaatggggcatattgaactggctgccccggtttctcacatttggtatttcaaaggtattccgagccgtatgggtcttgtattggatatgtcaccgcgtgcgctggaagaagttatttactttgcttcttacgtcgtaactgacccggccaatacaccgctcgaaaagaaacagcttttatctgaaaaggaataccgtgcgtatctggataagtacggaaacaaattccaagcctctatgggtgcggaagccattaataaacttctgcaggacatcgaccttgtcaaagaagttgatatgttaaaagaagagctgaagacttctcaaggacagcgccgtacacgcgcgatcaaacgccttgaagtgcttgaagccttccgtaattcaggaaacaagccgtcttggatgattctcgacgtgcttccggttattccgcctgaattaagaccgatggttcagcttgacggcggacgtttcgcaacgtctgacctgaacgacctttaccgtcgtgtcatcaaccgtaataaccgtttaaaacgtctgttagacctcggcgcgccaagcatcatcgttcagaacgaaaaacgtatgcttcaggaagcagtcgacgctctgattgacaacggacgccgcggccgtccggttaccggaccgggtaaccgtccgcttaaatctctttctcacatgctgaaagggaaacaagggcgtttccgtcagaaccttctcggtaaacgtgtagactactcaggccgttccgttatcgtcgtaggtccgcatctgaaaatgtatcagtgcggtttgccgaaggaaatggcgcttgagctcttcaagcctttcgtcatgaaagagcttgttgaaaaaggccttgctcacaatatcaagagcgcaaaacgcaaaatcgaacgcgtgcagcctgaagtatgggatgtacttgaatctgtcattaaggagcatccggtcttactgaaccgtgcccctactcttcacagattaggtatccaggctttcgaaccgacgcttgttgaaggacgcgccatccgtcttcacccgttagtatgtacagcttataacgctgactttgacggtgaccaaatggcggttcacgtacctttatcagctgaggctcaagctgaggcgcgcattctgatgcttgcggcccaaaacatcttgaaccctaaagatggtaaaccggttgttacgccgtctcaggatatggtattaggaaactactacctgacgcttgagcgcgccggagcagtcggcgagggtatggttttcaaaaatacggacgaagcgcttcttgcttatcaaaacggttatgttcatcttcatacgagagtagctgttgcagcgaactcccttaagaatgtgacatttactgaagaacagcgttcaaaattgttaattacaactgtcggtaagctcgtcttcaatgaaattcttccggaatcattcccttacatgaatgaaccaacgaagagcaacattgaagagaagacacctgaccgtttcttcttagataaaggtgctgacgtaaaagctgtgattgctgagcagccgatcaacgcaccgtttaaaaaaggtattttgggtaaaatcatcgcggaaatctttaaacgattccatatcacggaaacgtctaaaatgcttgaccgcatgaaaaacctcggtttcagatattcaacgaaagccggcatcacagtaggggtttctgatatcgtcgttctcgatgataaacaggaaatccttgaagaagcacaaagcaaagtagataatgttctgaaacagttcagacgcggtttaatcaccgaagaagaacgttatgaaagagtcatttcaatttggagttcagcgaaagatgttatccaaggcaaactgatgaaatcattagacgaagtcaacccgatctacatgatgagtgattcaggagcccgtggtaacgcatctaactttacacagcttgcgggtatgcgcggtctgatggccaacccggctggacgaatcattgaattgccgattaaatcaagtttccgtgaaggtctgacagtattggagtactttatctccactcacggtgcgcgtaaaggtcttgccgataccgccctgaaaacagctgactcaggttaccttacacgccgtcttgttgatgttgcgcaggatgttatcattcgtgaaacagattgcggaacagaccgcggtattcttgcaaaaccgctcaaagaaggcacggaaatcatcgagcgtctggaagagcgtctgatcggacgtttcgccagaaaacagatcaaacatcctgaaacgggtgctgtgctcattaacgaaaatgaattgatcgatgaagataaagcgctggaaatcgttgaagccggaatcgaagaagtgtggatccgttctgcgttcacatgtaacactcctcatggtgtatgtaaacgatgctacggacgaaaccttgcaaccggaactgatgttgaagtcggcgaagcagtaggtattatcgccgctcaatctatcggtgagcctggaacacagttaacgatgcgtacgttccacacaggcggggttgccggagacgatatcacacaaggtcttccgcgtatccaggagcttttcgaagcgcgtaatccgaaaggtcaagcgacgatttctgagattgacggtacaattgccgaaatcaatgaagtccgcgacaaacagcaggagattgttgttcagggtgctgttgagacccgttcatacacggcaccttacaactcacgcctgaaagtgactgagggtgatcagattacccgcggtcaagtgctgacggaaggttcaatcgatccgaaagaacttcttaaagttactgacctgacaacggttcaggaatatcttctgcatgaggttcagaaggtttaccgtatgcagggggttgaaatcggcgataaacacgtagaagtaatggttcgccagatgcttcgcaaagtccgtgtaatcgatgccggagatactgatgttctccctggcacattgcttgatattcaccaatttacagaagcgaacaaaaaagtgctgcttgaaggcaatcgacctgctacaggccgtcctgtccttctcggtatcacgaaagcttcacttgagacggattcattcttgtctgccgcatcattccaggaaacaacacgcgttcttacagatgctgcgattaaaggcaagcgtgatgaacttctcggcctgaaagagaatgtcatcatcggtaaactggttccggccggtacaggtatgatgaattacagaaaagtaaaacctgtttcaaacgttcagccttcggaagatatggttccggctgaataacagaaactgctgcaggaaaggctgtttcgacagcttttcctcagtattacaattattctggcggggactgcactaaaaaatgtcatacgttgttgacatccgtcccgcagagtgataatataaccaaggtgctcgaaataaaacctgttactttggaggatatgtttatgtcttatgataaagtatcacaggccaaatcaattattattggtacgaagcaaacagtgaaagctctaaaacgaggttcagtgaaggaagtcgtcgtggcaaaagacgcggattcagttcttacggctggcgttatccagcttgcaaagaaccaaaataccgctgtctgtatggtggattccatgaaaaagctcggcaaagcctgcggaattgaagtgggagcagcagctgttgccattatgttatagcgtactttttgtttttatataagatatcaatcttatgtaaagacattgtttttttgcctaatgatgaaccacctgggtatgtgggttataaaacgtaatgaagggaggaacacaacatgcctacaattaatcagctaattcgcaagggacgcgtgagcaaagttgaaaactctaagtcacctgcactaaacaaaggatacaacagctttaaaaaagagcacactaacgtatcttctccacaaaaacgcggggtatgtactcgtgtcggtacaatgacaccgaaaaaaccgaactcagcacttcgtaaatatgctcgtgttcgtttgactaacggaatcgaggttactgcctacattcctggtatcggtcacaacctgcaagagcacagcgttgtactgatccgcggcggacgtgtaaaagacttaccgggggtacgctaccacatcgttcgtggcgcgcttgatactgccggagttgaaaaccgtgcgcaaggccgttctaaatacggtacgaaacgtcctaaagcaaagtaataataataaatcattaaaactatgaagggaggatattcagatgccacgtaaaggtcctgtagcaaaaagagatgttttacctgatccgctttacaactctaagctggtatcccgcctgatcaacaaaatgatgatcgacggtaaaaaaggtaaatctcaaacaatcctatacaagtcattcgatatcattaaagaacgcactggcaatgatgcaatggaggttttcgaacaagcattgaaaaacatcatgcctgtacttgaagtaaaagcacgccgtgtaggtggagctaactaccaagtgcctgtagaagttcgtcctgaacgccgtacaactcttggtcttcgctggttggttaactatgcgcgtcttcgcggagaaaaaacaatggaagagcgcctggctaacgaaattcttgatgcagctaacaacactggtgctgccgttaagaaacgtgaagacactcacaagatggcagaagcgaacaaagcatttgctcactaccgctggtaggattcatataatcaaaataataattccctaataaggaaggagaaattacccaatggcaagagagttctccttagaaaaaactcgtaatatcgggatcatggctcacatcgatgccggtaaaacgactactacagaacggatcttgttctacacaggccgtatccacaaaattggcgaaactcacgaaggtgcttcgcaaatggactggatggagcaggaacaagagcgcggtatcacaatcacttctgcagcaacgactgcacagtggaaaggttaccgtgtaaacatcatcgatacaccgggacacgtagacttcacagttgaagttgaacgttcactccgtgtacttgatggtgcggttgccgtacttgatgctcaatcaggtgttgagcctcagacagaaacagtatggcgccaagcaacaacttacggagtaccgcgcgttgtatttgtcaacaaaatggacaaaatcggcgcagacttcctttactctgtaggcactttaagagaccgtcttcaagctaacgctcacgcaattcaattgccgatcggcgctgaagacaacttcgaaggtatcatcgacttagtagaaaacgttgcgtatttctacgaagatgaccttggaactcgttcagatgcgaaagaaatccctgaagagtacaaagagcaagctgaagagcttcgcagcagcctgattgaagctgtagctgagcttgatgaagagcttatggaaaagtaccttgaaggtgaagaaatcactatccctgaactgaaagctgctatccgtaaaggtacactgaatgttgaattctaccctgtacttgttggttctgctttcaaaaacaaaggtgttcagcttgtacttgatgctgttcttgactaccttcctgcgccaactgatgttgctgcaatcaaaggtgttcgtcctgatacagatgaagagatcgttcgtcattcttctgatgaagagccgttctctgcacttgcatttaaagttatgactgacccttatgtcggtaagctgacattcttccgcgtatattccggtacacttgattccggttcatatgtaaagaactctacaaaaggcaagcgtgagcgcgtaggacgtatccttcaaatgcacgctaacagccgtgaagagatctctactgtttacgctggagacatcgcagctgctgtaggtctaaaagatacttctactggagatactctgtgtgatgaaaaggatcttgtaatccttgaatcaatggaattcccagagcctgttatcgacgtagcgattgagcctaaatcaaaagctgaccaagataaaatgggtatcgctttagcgaaacttgctgaagaagatcctacattccgtacacaaactaaccctgaaacgggtcaaacaatcatctctggtatgggtgagcttcaccttgatatcattgttgatcgtatgaagcgtgagttcaaagttgaagctaacgttggtgctcctcaagttgcgtaccgtgagacattccgtaccggtgcaaaagttgaaggtaaattcgtacgtcaatcaggcggacgcggtcagttcggtcacgtttggatcgaatttgaaccgaacgaagaaggcgctggctttgaattcgaaaacgcaatcgtcggtggtgttgttcctcgtgaatacatcccagccgtacaagcaggtcttgaagactctcttgaaaatggtgtcctagccggattcccgctaatcgacatcaaggcgaaactttttgatggatcttaccatgatgttgactcaaacgaaatggcgtttaaagtcgctgcttctatggcattgaaaaatgcagtcagcaaatgtaacccagttcttcttgaaccaatcatgaaagttgaagttgttattcctgaagaatacatgggagacatcatgggtgatgttacttctcgtcgcggacgcgtagaaggtatggaagctcgcggtaacgctcaagttgtgcgtgcgatggtacctcttgctgaaatgttcggttacgctactgcccttcgttctaacacgcaaggacgcggtacgttcacaatgttcatggatcactacgaagaagtgccgaagagcatcgctgaagaaattatcaaaaaaaataaaggcgaataattgattttgccacttaactcaagtataactactattgtaagatgaggaagtgagagcttgctttcactttctatcactctatacattactaattaaaagctcttaaggaggattttagaatggctaaagaaaaattcgaccgttccaaatcacatgccaatatcggtacaattggacacgttgaccatggtaaaacaacattaactgctgctatctcaacagtacttcataagaaatctggtaaaggtacagctatggcgtacgatcaaattgatggtgctccagaagaacgtgagcgcggtatcacaatctctactgcacacgttgagtacgaaactgacactcgtcactatgcacacgttgactgcccaggacacgctgactatgttaaaaacatgatcactggtgctgcgcaaatggacggagctatccttgtagtatctgctgctgatggcccaatgccacaaactcgtgagcacatccttctttctaaaaacgttggtgtaccatacatcgtagtattccttaacaaatgcgacatggtagacgacgaagagcttcttgagcttgttgaaatggaagttcgcgatcttcttagcgaatacgacttccctggtgatgatgtaccagttgttaaaggttctgctcttaaagctcttgaaggcgatgctgagtacgaagaaaaaattcttgaacttatggctgcagttgatgagtacatcccaactccagaacgcgacactgaaaaaccattcatgatgccagttgaggacgtattctcaatcactggtcgtggtacagttgctactggccgtgtagaacgcggacaagttaaagtcggtgacgaagttgaaatcatcggtcttcaagaagaaaacagcaaaacaactgttacaggtgttgaaatgttccgtaagcttcttgactacgctgaagctggagacaacatcggtgcacttcttcgcggtgtagctcgtgaagacatccaacgtggacaagtacttgctaaaccaggtacaatcactccacacagcaaattcaaagctgaagtttacgttctttctaaagaagagggtggacgtcatactccattcttctctaactaccgtcctcagttctacttccgtacaactgacgtaactggtatcatcaatcttccagaaggcgtagaaatggttatgcctggagataacactgaaatgatcgttgaacttatctctacaatcgctatcgaagaaggaactcgtttctctattcgtgaaggcggacgtacagttggttcaggcgttgtttctacaatcactgagtaatcgactcgttcaataatgcggggtcccttatggggcctcgtttttttgtttccctgctgattccatgtataatagaacgtatacaaattttaggagcagaccgatgaacgataacttcaagaaaaccaatcgtatttcaatgcttcagcaattgcagattaatggcagtgaacaaaccattatgattaatggtgatgacaggagtagtccgctgcttttgtttttgcatggcggtcccggcacgcctcaaatcggttatgcgagaaaataccagaatgagctggaaaagcatttcaccgttgtgaactgggatcagagaggggcgggtctctcttattcaaaggaaattccgggttcatctatgactttggatcagctgacagctgacaccattcatctgaccgaacgcttatgcaagcaattcagcaggagaaaaatatatatcgccggctattcgtggggttcagttttggcgcttcaagttcttcaagagaaacctgatttgtattatgcgtatatcggtatcagtcaggtggttaatattcaaaaggaagaaacggaagcctaccggttgatgatggaatggagcaggcaacacaaacatatcctgctgggcaagacgctgagctttatcggagcaccccatgggagaaacagctgcagcgaacgctgtttctgctttgtattgaaatgaggggagggggctttacccatcatccgatcggcgctcttaaagcaggggggcgaatgctgtttggtgaaccgtacggtgtgagagggagcttcttagccgcgcggggacaaatgttcagcctgaaacacctgtgggaggatctcatttcctttgatgcaggggaatcagtttcttctattgtaataccgtgctgttttatgtcagggagatacgatttgacggttccggggacgacgtcttatgaatattatcagaaggttgatgcgccgtataaagaatggcattggtttgagaactcagcccattcgcctcacttggaggaaccggatcgctttgccgaagttgtcagccggttcgcatcgttccatctctgaaagaaaacagtcatatccttgattaatcatggtatcacctgtataataatcaaagtgtgaaaaccacaaggttctttaaataaaccttgcaacatgcgtctattttctgtataatagtgtatgttggtctttgactgcgatgaagtgagaggttgctgacacacccggccgctttgccatggcaaggtgatcaggtttttctcacggagaactgtctaacgtgatgtaggcgaaaaggagggaaaataatggcaaaacaaaaaattcgtattcgtttaaaagcatatgatcatagaatccttgatcaatctgcagagaagattgttgaaacggcaaaacgttctggtgccagcgtatctggtccgattccgttgccgactgaaaaatcagtttacacaatccttcgtgcggtgcacaaatacaaagattctcgtgagcaatttgaaatgcgtacacataaacgtttaatcgacattgtgaacccaacaccacaaactgttgatgctctcatgcgattagacttaccatctggtgtcgatatcgaaatcaaactttaattctaaaatatagaatgatcttaataggaggtgtgacgaatgaccaaaggaatcttaggaagaaaaattggtatgacgcaagtattcgcagagaacggtgatcttatcccggtaactgttattgaagcagctccaaacgttgttcttcaaaagaaaacagctgaaaatgatggctatgaagcgatccagcttggttttgacgataagcgcgaaaagctttcaaacaaaccggaaaaaggacacgttgcaaaagcggaaactgctcctaagcgcttcgttaaagaattacgcggcgtggatatggatgcgtatgaaattggtcaggaagtcaaggttgaaattttctctgcaggagaaatcgtagatgtaacaggagtatctaaaggtaaaggtttccaaggtgcaatcaagcgccacggacaatctcgcggacctatgtctcacggttcacgctaccaccgtcgtcctggttcaatgggacctgtagatcctaaccgtgtattcaaaggtaaactattacctggacgcatgggcggagatcaaatcactgtccaaaaccttgaagtcgtaaaagtagatgctgagcgcaatcttcttttgattaaaggtaacgtacctggtgcgagaaaagctttaatcactgttaaaagtgctgttaaatctaaataagtctcttaggaaaggaggaaattgatcatgccaaaagtagcattatacaaccaaaacggttctactgctggtgatatcgaattaaacgcttctgtatttggaattgagccaaatgagagcgtagtattcgacgctattcttatgcaaagagcttccttacgtcaaggatctcacaaagtaaaaaatcgttctgaagtacgcggcggaggtcgcaaaccatggcgtcaaaaaggtacaggtcgtgcccgtcaaggttcaatccgttcaccgcaatggcgcggaggtggtgtcgtattcggcccaacaccacgcagctattcttacaaattacctaaaaaagttcgccgcttggcaatcaaatcagtattgtcttctaaagtgaacgacaacaacattattgttcttgaagatcttactcttgatacggttaaaacaaaagaaatggcagctgtccttaaaggattatctgttgagaaaaaagctttaatcgtaactgcggatgcaaacgaagcagtatctctttctgcacgcaacatccctggagttacagttgttcaagctaacggaatcaacgtgttagacgttgtcaaccacgagaagcttctgattacaaaagctgcggttgaaaaagtagaggaggtgcttgcataatgaaagatcctcgtgatgttcttaagcgccccgtcattactgaacgttctgctgatttaatgactgaaaagaaatatacttttgaagttgatgtaagagctaataaaacagaagtgaaagatgcagttgaaagtatctttggagtgaaagttgacaaagtcaacatcatgaactacaaagggaaatcaaaacgtgtcggccgctatactggtatgactagccgtcgcagaaaagcgatcgtaaaacttactgcagacagcaaagaaatcgaaatttttgaagcttaattatctgtaaaaagaaggagggaaattcaaaatggcgattaaaaagtataaaccgacctctaacggacgtcgtggcatgacaacttcagattttgctgaaatcacgactgaccagccggaaaaatccttgcttgcgccccttcacaaaaaaggcggacgtaacaaccaaggtaaattgactgtacgtcaccaaggtggcggacacaaacgccaataccgtgttatcgacttcaaacgcgataaagatggtatacctggacgcgttgctacagttgagtacgatccaaaccgttcagctaacattgcactaatcaactatgtagacggagaaaaacgttacattcttgctccaaaaggaattcaagtaggtactgaaatcatgtccggccctgaagctgacatcaaagtaggtaacgcacttccgcttatcaacatccctgttggtacagttgtgcataacattgaattaaaacctggtaaaggcggacagcttgtacgttcagctggtacatctgctcaggttcttggtaaagaaggcaaatacgttcttgtacgtcttaactctggtgaagttcgcatgatcctttctgcttgccgcgcttctatcggtcaagtaggtaacgagcagcacgaacttatcaacgttggtaaagcaggacgctctcgctggaaaggcatccgccctacagtccgcggttctgtaatgaaccctaacgatcacccgcacggtggtggtgaaggtcgcgcgccaatcggacgtaaatcaccaatgtctccttggggcaaaccgactcttggattcaagacacgtaagaaaaagaacaaatctgataaatttatcgtacgtcgtcgtaaaaataaataacggggttgtctacggttcatttcggaccgtagtgcaatcacgaagggaggttccaaaatggctcgcagcttgaaaaaaggaccatttgtcgatggacacttgatgacaaaaatcgagaaattaaatgaaacggacaagaaacaagttgtaaaaacttggtctcgccgttcaactattttcccacaatttatcggtcacactatcgcagtatatgacggacgtaaacacgtgcctgtattcatttctgaagacatggtaggccacaagttgggcgaattcgcaccgactcgtacttacaaaggccacgccagtgacgataaaaaaacaagacgctaagagaggaggcttttaaatgcaagctaaagctgttgcaagaacagtccgtattgctcctcgtaaagcacgtctagtaatggacctgattcgaggtaagcaagtaggcgaagcagtatctatcttgaacctaactccgagagctgcttctccgatcatcgaaaaagttttaaaatctgctatcgcaaatgctgagcacaactacgagatggacgctaacaatctggttatttctcaggcatttgttgacgaaggcccaacgttaaaaagattccgcccgcgtgctatgggacgtgcgagccaaatcaacaaacgtacgagccacattacaatcgttgtatcagaaaagaaggagggataagtagtgggtcaaaaggtaaatccagtcggtcttcgtatcggagtcattcgtgattgggaatctaagtggtacgctggtaaagattacgctgacttcctgcacgaagatttaaaaattcgtgaattcattagcaaacgcctttctgacgcttctgtttctaaagtagaaatcgagcgtgcagcaaaccgcgttaacattacgatccacactgctaagcctggtatggtaatcggtaaaggcggatctgaagttgaagcacttcgtaaagcccttaacagccttactggcaagcgtgtacacattaacattcttgaaatcaaaagagcagatcttgatgctcagcttgtagctgacaacatcgctcgtcaactagaaaaccgtatttctttccgccgtgcgcagaaacaacaaatccaacgcactatgcgtgctggagcacaaggtgtgaaaacaatggtttccggccgtcttggcggagctgatatcgctcgttctgaatactacagtgaaggaactgttccattgcacactttacgtgctgacatcgactatgcaacatctgaagctgacacaacttacggtaagcttggtgtaaaagtctggatctatcgtggagaggttcttcctactaagaagaaaactgaggaaggaggaaaataatatgttattaccaaaacgcgttaaatatcgcagagagcatcgcggaaaaatgcgcggtcgcgctaaaggcggtactgaagtacattttggtgagtacggtatccaggctcttgaagcttcttggatcacgaaccgccaaatcgaagctgcacgtattgcgatgactcgttacatgaaacgtggcggtaaagtttggattaaaattttcccttcaaaaccttacactgctaaaccgcttgaggtacggatgggttccggtaaaggggctcctgaaggctgggtagctgttgtaaaaccgggcaaagttttatttgaaatttctggtgtgtctgaagaggtagctcgtgaagctctccgtcttgcatctcacaaattgccaattaaaacgaagttcgtaaaacgtgaagaaattggtggtgaatcaaatgaaagctaatgaaattcgtgaccttaccactgctgaaattgaacaaaaagtaaagtctcttaaagaagaacttttcaatcttcgctttcaattagcgacaggacaacttgaaaatactgctcgcattcgtgaagtgcgcaaagctatcgcgcgcatgaaaactgtgattcgtgaaagagaaattgctgccaacaaataatcactgaggggaggtcgtgagcatgagcgaacgtaaccaacgcaaagtttaccaaggccgtgttgtttctgacaaaatggataaaaccatcactgttgttgttgaaacatacaaaaaggatcctatttacggtaaacgcgtaaaatactcaaagaaattcaaagcacatgatgaaaataaccaagctaaaatcggagacatcgtaaagatcatggaaactcgtccattatctgcaactaagcgttttcgtctagtagaagttgtcgaagaagctgttattatctaataaagttcggaattctttttccgaagggaggtaacaaataatgattcaacaagagactcgtttaaaagttgctgacaactccggtgcgcgtgaggtacttactattaaagttcttggcggttctggacgtaaaacggctaacattggtgatgtaattgtttgcacggttaaacaagcaacaccaggaggcgttgtcaaaaaaggtgaagtcgtaagagctgttatcgttcgcacaaaaagcggagcacgcagatctgacggatcatacatcagcttcgatgagaatgcatgtgttatcatccgtgacgacaagagcccgcgtggaactcgtatcttcggaccggttgcccgtgaattacgtgaaaacaacttcatgaaaattgtttctctggctccagaagttatctaatgaaataaatgccttactcaaggaggtgcgatcaggatgcatgtgaaaaaaggcgataaagtaatggttatctctggtaaagataaaggcaaacaaggtacgatccttgctgctttccctaaaaaggaccgcgttctagttgagggcgtaaacatggtgaagaagcactctaaaccaactcaagcaaaccctcaaggcggtatttctaatcaagaggcgccaattcatgtatcaaacgttatgccgctcgatcctaaaactggtgaagtgactcgcgtaggatacaaagtggaagatggcaaaaaagttcgtgttgcaaaaaaatctgggcaagtcttagataaatagtatttaaaggaagggaggtctatctcatgaaccgccttaaagaaaagtacaataaagaaatttcacctgctttaatgacgaagttcaactacgactctgttatgcaggtgccaaaaatcgaaaaaatcgtaatcaacatgggtgtcggtgatgctgttcaaaacgcaaaagcaatcgacagtgctgttgaagaattaacgtttatcgcaggtcaaaaacctgtcgttactcgtgcgaagaaatcaattgctggattccgtcttcgtgagggaatgcctatcggtgcgaaagtaactcttcgcggagagcgcatgtatgatttccttgataaacttatttctgtatctttaccgcgtgtacgtgacttccgcgggatttctaagaaatctttcgacggtcgcggaaactacactcttggtatcaaagaacagttaatcttccctgaaattgactacgataaagtaacaaaggttcgcggaatggacatcgttatcgtaacgactgctaactctgacgaagaggctcgtgagctattaactcaagtaggtatgccgttccagaaataatcaatgaaagggaggcgaaatcgtggctaaaaagtcaatgattgcgaaacaacaacgtacaccaaagtttaaagtgcaagagtacactcgctgtgaacgctgcggacgtccgcactcagtcattcgtaaatttaaactttgccgtatttgtttccgtgagcttgcatataaaggacaaattcctggcgtgaaaaaagccagctggtaatccccaagaatgggaaggaggtaattatataatggttatgacagatccaattgcagatatgctgactcgtattcgcaatgcaaacatggtacgtcatgagaagcttgaaattcctgcttctaaattgaaaagagaaattgctgacattttaaagcgtgaaggtttcattcgtgacgttgagttcgtagaagacagcaaacaaggtatcatccgcgttttcttgaaatacggacaaaacaacgagcgcgttatcactggtcttaaaagaatcagcaaaccaggtttgcgtgtatacgctaaatcaaatgaagtacctcgcgtacttaacggtcttggaatcgcgattatttctacatcacaaggtgttttaacggacaaagaagcccgtgcaaaacaagctggtggagaagttctagcatacgtttggtaagaagtttaacaagaatggaggtgttttagtatgtctcgtgtaggtaaaaaactgcttgagatcccttctggagttacagtaacgctgaacgaaggcaacactgtagctgtaaaaggaccaaaaggagaattaactcgtactttccatcctgatatggaaatcaaaattgaggacaacgtgcttacagttactcgtccttctgatcacaaagagcaccgtgcgctgcatggtacgactcgcagtctgcttggaaacatggttgaaggcgtatctaaaggatttgaaagaggtttggaattagtcggtgtcggttatcgtgcggctaaatccggaaacaaacttgttttaaacgttggatactctcaccctgttgagatcgttcctgaagagggcatcgaaatcgaagttccttctcaaactaaagtagttgtaaaaggtacagacaaagagcgtgtaggagctatcgctgctaacatccgcgctgtacgttctccagagccttacaaaggtaaaggaatccgctacgaaggtgaagttgttcgccgtaaagaaggtaaatctgctaagtaagaccgcttaaagtgaagaaaggagtgacctaaggatgattacgaaaactagcaaaaatgctgctcgtcaaaaaagacatgcccgtgttcgtgctaaactttcaggcacagctgaaagacctcgtctgaatgtgttccgttcaaacaaacacatttatgctcaaatcatcgatgatgtaaatggcgttacacttgctagtgcctctactcttgataaagatttgaacgtggaaagcactggtgacagcgctgctgctgctaaagtcggtgaactcgttgcgaaacgcgcttctgagaaaggtgtttctgacgtagtatttgaccgcggcggatacttataccatggacgtgtaaaagctctggccgatgcagctcgtgaagccggactgaaattttaataaaaaaaggagggacacatgattatgcgtcgtattgacccaagcaaattagagttagaagaacgcttagttacggttaaccgcgtagcgaaagttgttaaaggtggtcgtcgtttccgtttcgcagctctagtcgttgtcggtgacaaaaacggtcacgtaggtttcggtactggtaaagcacaagaagtacctgaagcaatccgcaaagctgttgaagatgcgaaaaagaatttgattgaagtaccaatggttggaactacgattccacacgaaatcatcggacgtttcggtgcaggcaatatcttgttgaaacctgcttctgaaggtactggagttatcgctggaggccctgtacgtgcggtacttgagcttgctggcgttgctgatatcctttctaagtctttaggttctaacacaccgatcaacatgatccgtgcaacacttcaaggtttaagtgagcttaaacgtgccgaagaggttgcgaagcttcgtggaaaatctgtagaagaactgttaggataaggagggaacattaatggctaaattagaaattaccctcaaacgcagtgtaatcggtcgcccggaagatcagcgcgttactgtaagaacacttggtttaaagaaaacaaaccaaactgtcgttcatgaagataacgctgcgatccgcggtatgattaataaagtatctcatctagtttctgttaaagaacaataaaaataaattataggctaaggaggtgtcctaatgaaacttcatgaattaaagccttcagaaggttcacgtaaagtacgcaatcgcgtaggtcgtggtattggttctggtaacggtaaaacagctggtaaaggtcacaaaggtcaaaacgctcgttctggcggcggtgtacgccctggattcgaggggggacaaatgcctttattccaacgtcttcctaagcgcggttttacaaacatcaaccgtaaggaatacgctattgtgaacgtagacaaattgaacggttttgcggaaggaacggaagtcactcctgaacttcttcttgagactggtgttattagcaaacttaatgcaggagtaaagattcttggcaacggtaaattagagaaaaaattaactgtaaaagccaataaattctctgcttctgcgaaagaagctgttgaagctgctggcggtacagctgaggtgatctaacttgtttaagacaatctccaactttatgcgtgtgagtgatattcggaataaaatcatttttacattactcatgcttatcgtctttcgcataggtgcgtttatccctgtgccatatgtaaatgctcaggcgttgcagacacaaagttcgatgggggtttttgatctccttaacacatttggcggcggtgcgctttatcagttctccatttttgcgatgggaattacgccttacatcactgcttcgatcatcattcagctgcttcagatggatgttgtgccgaagtttaccgagtggtctaagcaaggtgaagtcggccgccgtaaattagctcagttcacgagatattttacgattgtgcttggttttatccaggcattaggtatgtcttacgggtttaacaacctggcaaacggtatgctgattgaaaaatccggcatatcgacatatctgattattgctttagtactcactggaggaactgcttttttaatgtggctgggagaacaaattacttccaatggagtaggtaacggaatttcgatcatcatcttcgcggggattgtggctagtattccgaaaactgttgggcagatttatgagactcaatttgtcggcagcagcgatcagctgtttattcatattgtgaaaatcgctttactggtgattgcgattttagccgttattgttggtgttattttcattcagcaggctgtacgcaaaatcgcgattcaatatgcaaaagggcaaggtcgttcacctgttggcggaggccagtcaactcaccttccgcttaaagtgaatccggcaggggttattccggtaatctttgcggttgcgttccttattacgccgcgtactatcgcgtcatttttcggagaaaacgatgtgacaaagtggattcaagccaactttgacaatacacatccggtgggcatgacggtttatgtcgcattaattatcgcctttacgtacttctatgcttttgtgcaggtaaaccctgaacaaatggctgataacctaaaaaaacagggtggctatatcccgggggttcgtccagggaaaatgactcaagatagaattacgagcattttgtatcgacttacgtttgtgggttctatattcttagccgtgatttccattcttcctatctttttcattcaattcgctggattgcctcaaagtgcacagattggcggaacatcattgttaattgtcgtcggggtagccttggagacaatgaagcagctggagagccagttagtgaaacgtaattaccgaggatttatgaaaaattagaggactggttttaaccattcctctaaataagagaggacgggggaaatccgaatgaacttagtcttaatgggacttcctggagccggtaaaggcacacagggagaacgaattgttgaggattatgggatacctcatatctcaacgggagatatgttccgtgctgctatgaaagaagaaacaccactcggactcgaagcaaagtcttatattgataaaggcgagctcgtaccggacgaagtcacaatcggcattgtcaaagaaagactcggcaaagatgattgtgaaagaggttttcttctggacggatttccgcgaacagtcgctcaggctgaagctcttgaaaacattcttgaggaatacggcaagccgattgattatgtcattaacattaaagtagacaaagactctttaatggaacgtttgactggacgcagaatttgcagtgtttgcggcacaacctatcatttggttttcaatccgccgaaaacgccgggtgtttgtgataaagacggaggagacctttatcaacgggcagatgataatgaggaaaccgtctcaaaacggcttgaggtcaacatgaagcagactcagcctttactcgatttttattctgagaaagggtatcttgtcaacgtcaatggccagcaggacattaacgacgtgtacaaagatgtgaaagagcttcttggaggattgagcaaatgattatctgtaagacccctcgtgagcttagcatcatgcgggaagcagggcgaatcgtggctttgactcatgaagagatgaaaaagcacattaaaccaggaatctcgacaaaagaattggatcaaattgccgaacgttttattgagaagcagggtgcaatcccatcttttaaggggtataatgggtttcgcgggagcatctgtgtatcagttaatgaagaactcgttcacggaattcccggtaaaagggttttgcgtgacggtgacattatcagcattgatatcggtgctaaattaaatggttatcatggtgactctgcttggacatatccggtaggaaacatcagtgatgatgataaacgactgctggaagtgacagaggagtctttatataaaggcttgaaggaagcaaaaccaggtgaacgtttgtcgaatatttcccacgcaatacaaacgtatgtcgaaaatgagcagttttcagttgttagggagtatgtcggacatggtgttggtcaagacttgcatgaggatccgcaaattcctcattacggtccgccaaacaaaggacctaggctgaagcctggtatggttctcgctatagaaccgatggttaacgctggcagccggtatgtgaaaacattggctgataactggacggttgtaacggtagatgggaaaaagtgtgctcattttgaacatacgattgcgattacggaaacgggttttgatatactgacaaaagtctagatgatgaaatgaattccatgacacatgtttttcattccgcacctgggcagattgtaggtttacaattggtcggaagaaaaaccggctagctgctgtcatcggaaggaagattcatcatcgtgtactaaagcagacggagaaaagcgtacatttcattctccttagaaaaagaatatcaatcattcaccctttatgattgcgtatctccggaagttcagaacagtataaacgaaacagggcgtgtgacaaacggataactgagattttctcttttgaaatttgtcagagagcaagttactgatttgaagaagggagaacacttgaatggcgaaagacgatgtaattgaagtggaaggtacgattgtcgaaacactgccaaacgcgatgttcaaagttgaactcgaaaatggccatacggttttggctcacgtatctggtaaaatccgcatgcacttcattcgcattttacctggagacaaagttacggtagaattatctccatatgacttaactcgtggcaggattacgtaccgttacaaataaagcactccggaaactgaaggaggttggaaacacatgaaagtgagaccatcagttaaaccaatctgcgagaaatgtaaagttattcgcagaaaaggaaaagtaatggtgatctgtgaaaatccaaagcataaacaaaaacaaggataattaataaggaggtgcccagagaatggctcgtattgctggtgtagatatcccacgtgacaaacgtgttgttatttctttaacatatgtcttcggaattggccgcacaacggctcagcaagtcttgaaagaggctggtgtttctgaagatactcgtgtgcgtgatcttactgaagaagaacttggtaaaatccgtgatgttattgacaaactgaaagtagaaggtgaccttcgccgtgaagtttctcttaacatcaagcgtctgatcgaaatcggaagctaccgcggaatccgccatcgcagaggtttgcctgttcgcggacaaaactctaaaaacaatgcgcgtactcgtaaaggtccgcgtcgtactgtagctaacaagaaaaaataagtaagggaggtacctaaacaatggctgctgctcgtaaacaaaacacgcgtaaacgtcgcgtgaaaaagaatattgagtcaggaatcgctcatattcgttcaactttcaacaacacgatcgttacgatcactgatactcatggtaatgctatttcttggtcaagtgccggagctctaggattcagaggttctcgtaaatcgactccttttgctgcgcaaatggctgctgaaacagctgctaaaggttcaatcgaacacggacttaaaactcttgaagtaactgttaaaggaccaggttctggccgtgaagctgcaatccgtgctttacaagctgccggacttgaagttacagctatcagagacgtaactcctgttcctcataatggatgccgtccaccaaaacgtcgccgcgtgtaatttgtttgtatagattttgtgtccctgtcaataatgggttatgatacagttatttatgaaacgaatgcaccgactcgttgcctgagcacatacgggactaaacaatggggaatttcggatggaatctcatatgattctattcgaggtttcgacgttttgaaggagggttttaagtaatgatcgagattgaaaaaccaaaaatcgaaacggttgaaatcagcgacgatgccaaatttggtaagtttgtcgtagagccgcttgagcgtggatatggtacaactctgggtaactccttacgtcgtatcctcttatcctcactccctggtgccgctgtaacatcgatccagatagatggtgtactgcacgaattctcgacaatcgaaggcgttgtggaagatgttacaacgataatcttgcacattaaaaagcttgcattgaaaatctactctgatgaagagaagacgcttgaaattgatgtacagggcgaaggaactgtcacagcagctgatattacacacgacagcgatgttgaaatccttaatccggatcttcatatcgcgactcttggtgagaatgcgagtttccgagttcgccttactgcacaaagaggacgtgggtatacacctgctgattcgaacaaaagagacgatcagccaatcggcgtgattccgatcgattcaatctttacgccagtttctcgtttatcttatcaggtagaaaacactcgtgtaggccaggttgcaaactatgacaaacttacacttgatgtttggactgacggaagcactggaccgaaggaagcaattgctctcggttcaaagattttaactgaacaccttaatatattcgtcggtttaactgacgaagctcagcatgctgaaatcatggttgaaaaagaagaggatcaaaaagaaaaagttcttgaaatgacgattgaggaacttgatctttctgtccgttcttacaactgcttgaagcgtgcgggcattaacacggttcaagaacttgcgaacaagacggaagaagatatgatgaaagttcgcaacctgggacgcaaatcacttgaagaagtgaaagcgaaacttgaagaacttggactcggccttcgcaaagacgattgatctagtttccatgtgaactaggattttcgtgtgttttttaattagaaacagcattccattaaaggaggggacatcacatgtcatacagaaaactaggacgtacgagttcacagcgtaaagctatgcttcgtgatcttacaacagatttgatcatcaacgaaagaattgaaacaactgaaacacgtgcgaaagaacttcgctctgttgttgaaaagatgatcactcttggtaagcgcggtgacttgcatgctcgtcgtcaagctgctgcatacattcgcaacgaggttgctaatgaagaaaataaccaagatgcacttcaaaaattattctctgacattgcaactcgttacgaggagcgccaaggcggatacacacgtattatgaagcttggtcctcgccgtggtgacggtgcaccaatggcaatcatcgaattggtttaatcacatatttttgtgtatctaaagaagggcgggacagtttctaactggatctatgccctttttttagatatcagaactttttatcatgagacagaaaagcagagctatagctgagaggaggtcaggcgcccgtggatcaaaaacagcttatatccgtaaaagacattctattccgctaccgcaaagatgcagtaagaccggcgctggacggtgtgagtctggaggtatatgaaggagaatggcttgctatcgtaggtcacaacggttcagggaagtcgactttggccagagcgctgaacgggctgattttgcctgaggccggagaaattgaagtcggcggcatcaagctgactgaggataccgtgtgggatgtgcgaaaaaaaatagggatggtctttcagaatcccgataaccaatttgtcggaacgactgttcgcgatgatgtggcttttggtttagaaaacaatggtgttccgcgcgaagaaatgattgagagagtagattgggctgtcacacaagtcaatatgcaggattttcttgatcaagagccgcaccatctctccggaggtcaaaaacaaagagtggcgatcgcgggaattattgccgcgcgtcctgatattatgattttggatgaagcgacatccatgcttgacccgattgggagagaagaagtccttgatactgtcagacgcttaaaagatcagggcatggccaccgtcatttcgataacacatgacctggaagaagccgcaagggcggataggatcattgtgatgaacggcggcaggaaatatgcagagggcacgcctgaagagatttttaaattaaatgaagacttggttcgcatcggtcttgatttgcctttctcattccagctcagcctgcttttgaaagaaagcggactggcgttaacgaaaaaccatctgactcaggaagggctggtgaatgagctgtggacattaaaatcaaagatgtagaacaccgctatcaaatgaagacaccgtttgaacggcttgctctgtatgatatcaatgccgtgataaaagagggcagctacgttgccgtcatcggacatacagggtcgggcaaatcgacgctcctgcagcatttaaacggtttgctgaaaccgactaaaggacagcttgagctcgggagcacgattctggcagccggtaaaaagaataaagaccttaagactctgcgaaaaaaagtcggaatcgttttccaatttcccgaacatcagctgtttgaagagactgtgctgaaggacatcgcattcggaccgatgaatttcggtgtaaaaaaagaagacgctgaacggaaagcaaaagaaatgctggggcttgtgggccttccggaagacattttggatcgttcaccgtttgagctcagcggcggccagatgcgcagagtggcgattgccggcgttctcgcgatggagccggaagtgctggttttggatgaaccgacagccggtcttgatccgagagggcgccaggacattatggacatgttctatgcgcttcatcagcggggaaacctgactaccgttctcgtcacccacagcatggaggacgccgcccgctatgctgacgaaatgatcgtcatgcacaaaggcaccattaaagcgacggggagtccgcgtgacttgtttgtaaaaggtgaagagatggccgaaatgggactggatcttcctgagtcggtgaagtttcagagacggcttgaggaggctctcggagttaagtatgaaaaacccatgctgaccctgcaggatgccgcgagcgaaattaaggctttctttcaggaggaaaaggaccaatgatggacagcatgattatcggaaagtatgttcccggatcatcgcttattcaccgattggacccgcgaacaaaacttgtcagcatctttctttttgtatgtatcgtttttttggcaaacaacgtacaaacgtatgctttgctcggtttgtttacattcggggtgatcgccttaacacgagtgccgttcagctttttgctgaaagggcttaagccgattatctggattgtggcgtttacctttttattacacattttcatgacgcatgaaggatctgtcatttttcagcttggctggtttaaagtgtatgagggcggacttatacaggggatttttatctccctccgtttcgtttaccttatctttatgacaacgctgctgacgctgacaacaacgccgattgaaatcacggatggaatggagcagctcttgaatccttttaaaaaggtgaagctgcccgtacacgaactcgcattgatgatgtcgatatcattgcgatttatcccgacattgatggaagagacagataaaatcatgaaggcgcaaatggcgaggggtgcggactttacaagcggcccggtgaaagacagaatcaaagcggttgttccgctgcttgtcccgctgtttgtcagcgcctttaaacgcgcggaagagcttgcggtcgccatggaggcgagaggctaccagggcggtgaggggagaacgaaatacagaaagctcgtctggaccggaaaggataccggagccattctgctcatcatcgtattagccgtgttattgtttttcttaagaagttagaggtgctgctgaatgagagtgaaatgtaccattgcttatgacgggcatttatttaacggatatcaggttcagcctggaaagcggaccgttcaaagtgaattggaaaaagcgctggccgtcatccataaaacggacggcagggtgcctgtcatctcatcgggccgcacggacagcgatgttcatgctgccgggcaggttattcattttgatacgccgctgtccatcccggctgagaaatggccgtttgcgctcaatgccctgctgcctgatgatattgccgtcaaaacagcagagattgcggatgatgggttccatgcacgatttagcgcagtccaaaaggaatatcgctactttgtatatacggagaaacacccggacgtatttaaacgacattacgcttaccattttgcatatcagcttaatgtgcagaaaatgagggaagcttcaaggcacctcatcgggacacatgatttcacaagcttttgcgcggctgataccgcggttcaggataaggtcagaacgatttacgagctggattggactgagaccggagacggcctgcagatgcggatcaccggaaacggttttctctataatatggtcagaatcattgccggaacgttattggatacaggagctggaaaattttctcccgatgatgtaaaagcaatgctcgaagcgaaggatcgcgaagccgcggggcgcaccgcaccggggcacgggctgtatttatggagcgtttgctatgacaactaaaccaggtgtaacattttcttgacagagtctgcataaagttataagatatcatatggtatgtatttcaaccccacgataagccccggaacttattgtgttgtgaaatagaacgtaacagaagtttatgaaaaaatgacagatcatttaggagggaattaaatgcgtacaacacctatggctaacgcaagtactattgaacgcaagtggttagttgttgatgcagcaggcaagactttaggacgtctttctacagaagttgcatctatccttcgcgggaaacacaaaccgacttacacaccgcacgttgatactggagatcatgtgatcatcatcaacgctgaaaaaatcgagttaactggtaaaaagttaactgataaaatctactaccgtcacacaatgcacccaggcggtctgaaatcaagaacagctcttgaaatgcgtacaaactaccctgagaaaatgcttgagcttgctatcaaaggcatgcttccaaaaggttctctaggtcgtcaaatgttcaagaaattgaacgtataccgtggttctgagcatccacatgaagcacaaaaacctgaagtttacgaacttcgcggttaattaaaaaggaggttaccaatttggcacaggttcaatattacggtactggccgtcgtaaaagttctgtagcgcgtgtgcgcttagttccaggagaaggtcgtatcgtcgttaataatcgtgaaatcagcgagcacattccatctccggctctaatcgaagatatcaaacaaccattaactttaactgaaacagctggtacttatgatgttttagtaaacgtacatggaggcggcttatctggtcaagctggagcaatccgtcacggtatcgctcgtgctttgcttgaagcagatccagaataccgcgcaacacttaaacgtgctggtcttctgactcgtgacgcccgtatgaaagaacgtaaaaaatacggtcttaaaggcgctcgtcgtgcacctcagttctcaaaacgttaatcgttttggatggcaaaaaccacaacttcttggttgtggtttttttgtatttttttctcatatcgaagaggttatccgatgtttttctagaattgtttgttatactctattcattaccaataaggagcgcagttataatgaataagttagtcatacataacagcaaggcatgggataaaaaagtcgaaacaggcaatgaatggacggttgcggttgattctcatacaattggtgaagcgaaaaaaggcaattggagcatcagaatgacccccggaaaagatgtgccggcggattggtttccgcccatagacggtctggaggttctttgtctcgcttcaggaggaggacagcaagggccggtccttgctgctgcaggagcggacgtcaccatctttgacaattcggaaaaacagcttgcgcaagacagaatggttgcccagcgggacggtcttacgcttcggactgtcaaaggcagcatgaatgatctgagctgttttgatgatgagacatttgattttatcgtgcacccggtatcgaattgctttgttgatacggttcttccggtatggaaagaagcttatcgcgtattgaaaaaaggcgggtctttagtctccggttttgtaaatcccgtcgtgttcttatttgatatggatttagagcaggaaggcgtactaaaagtaaagtattccattccgttttcggatgaaaaagatctgagtaagaaaaaggtaaaggaacttattgataatcatgaagcgcttgaattcggccatacgctggaggatcaaattaaaggtcagattgacgcaggctttatggttgccggtttttacgaggacaaaggcggcctcgtgctggatgaatacattaatacatactccgtaacaagaagcattaaaatataaaaacggcatcccgtcagaggtgctgtttttttgcggctttttcctgcggacggctgatcacattagccgaaaccggttctattccaatctctctggcccaaaccgacagttgtcccatgtggtgaatctcatgcgcaaggatgtggcggagaatatcttctttaggaaaggtttggtccatccagtccggcttaacaagatccgcccctttgcgggagaccgcatgaatgacatcctcccgatactgttcagacagctttctgagatcctgaatgctcgtatagtcagactcagcgggtaaaacatcatctttacctaaaatggcacgagcccagctgatctcgacatcaatgatatgaaataaagtccgcaagatgctctccattccgcccgtccgggttttcgtcagttcctcccggctcagcttttcacatatcataaaccactcgtcacgcaccgtccaattgtattgaaacagctttttcatcacgtcacctcagctctttattcttccagttaacatgaaactccttcatttgggaggatttccactatcaacaaagcatgctttttcccttttcctttcaaaataacagtaaaaaggagcgtggctggcaatggcagaagtattatctttttcagacgtgaaacggcagaaggattatgagcttgagaagagtttactaaaggagctgtcactgacgcagatcattcagtccgtaaaagcatgtctcacccctttgtttccctttcttcaagacgaaaacggcattctgagtgaaggatgcatagattttgcaattgaagcgtatttattaggcggccggttcggcgtctttggattttatggtgagtctttgcagagggcgaacgcccgttcggctgaagaagaggaagaactgacggccgatttttttgaatatctttgcaattggacgcatgagcaatattcttccgttgaacaaaaagaaatctatgaagcgtcctgccggtttatcaacagctggtggacggaaggatttctgcaaagagaaaaacaatgtaagctccgcatgaggtaatcataatttcttcccttgtcccatacttattaataacggggacaagcgggagggaaagctatgacaaaaaagctgaaatggctcggttttttacttggctttatcatattattgtgtttattccggtttcaattccataatgatgattcatggcggccgtggagcctgccgctgagcgggaaaatcatctatctcgatccgggacacggcgggccggacggaggcgccacgggaggcagtcaccttgaaaaggacattactctcgaagtggcctccagggtcagagactatttgcaggagcagggagctttggtcattatgacgcgggagacggatactgatttagctcctgaagggacgaaaggctacagcagacgcaaagcggaagatctgagaaagcgcgtggagatcatcaaccgttcagaggcggagctttatatcagcattcatctgaacgccataccgtcaccgagatggagcggcgcccaaagcttctactatggaaaatacgaagagaatgaaaaagtggcaaaatatatacaggacgaattgagaatcaatttggagaatacaacgagaaaggcgaaacggatacacggcatttacttaatgcagaatgtaaccaaaccgggcgccctggtggaaatcggatttctgtccaatcccgcggaagcgaaaaggcttggccagcctaaatatcaggacaaaatcgcttcttccgtgtataagggcgtgttgagatattttacagaaaaaggagaccctcccgagtaaggagggtttttcgccgattctacgtttaatatatggtataataccatttgtaaacgaatacacaaagggtgagggttcgatgataagagaagatgaagtaagaaatatagtcggaaacatgcgcgaaccttttcttcatagaccgctgggagaattggatgccattaaagaagtaaaggtcaagccggaaaaacggcatgtcagtgtaaaaattgcattggcaaaaacggggacggctgaacagatgggcattcagcaggaaatcgtatccgttctgaaagaagcgggtgcggaaactgtgggacttcggtttgaagagctgccggaagaaacattggcgaaattcagccggcctgctgctgaaagcgaaaccctgctgaataggaaacatccgccggtctttcttgcggtggcaagcggaaaaggcggtgtcggcaaatcaacggtttccgtcaacctggccatttctcttgcgcggctcggaaaaaaagtcggcttgatcgacgcggatatatacggattcagcgtgccggacatgatgggtattacagttcgcccgacagttgaaggagaaaaactgcttcctgtcgaaagatttggagtaaaggttatgtcgatgggctttttcgtcgaagaaaacgctccggttgtgtggagagggccgatgctgggcaagatgctgaataacttcttccatgaggttgactggggagaggttgactatatcgttctcgacctgccgcccggcacgggtgatgtggcgctcgatgtacacacgatgcttccgagctgcaaagagattatcgtatcaacgccgcaccctacagccgcatttgtagcggcgagagcgggatctatggcgattaagaccgatcatgaagttgtaggggtcattgaaaatatggcttattatgaaagtgcaaaaaccggcgagagagaatatgtgttcggtcaaggcgggggagataagcttgcagaggaattgcaggtgccgctgcttggcagaattcctttaaaacagcctgattgggacaaggaccagtttgcgccttctgtctatgacagaagtcatccgatcggggaaatttatatgggtatcgcccaaaaagtcattgaaaaaacagctgaataaaaaaggggccgggatcaacacggcccggccttttattggctttctttttcagaacttgaagccgcttttttcaattcatcctcgaattgctttttgaaaagcgggctggaaagtgtctctgtaattacatcttctaagtaactgcggaacttttggcttttcaccagctcatagtattttttatccatgccggggtcctgcatgatctgcataaaacttttctgataatcagggtctttcatcaatttttttatgattttttcgtgctcgggctgaagcgtttttgcaaagctctcggcgaactttgagtcttcaaagatggttttccagaactccgccccttttttagaggtgagggttttctctattgtgcctttaatggcattttgatcaatcaccaatgcctcattcatcgcatcatcatttaatatttccttaattgctttttttccatcatctgtctttaatatatcaacaaccatttttttagtctggtcataatccatatccgctgcttggtcttttggagcacaagctgttacagataatacaacaaaacagcttatcaatagcgttttggcttttgacatgcataagctccttccttacttgtacttatttttaatatgattcatcggaatggatttatacataacaaaatatcgctgaacgcgattgtcaggggatgaataagagatgaaaagccgcgggcttgttcgatttttcttttcgattttagctgtgggcgctcttattacaagcgtcgtgggatttgcactgaagtggggggagtacaaggggttctttctgaattttgaggccggtcaaattttctccgttctgatctggtttatcggggtaggcatgattttcagtgtgatcagccagatgggattcttcgtctttctgacggtgcaccggtttgcccttgaaatcctcagatcaaactcgctttggaatctgcttcagctgtttatcattctgtttgtcgcttttgatttaatgtacgtcagatttttgtttttcggtgagcgggatgactcgattgcggggtttgtctggctgccgctggctctgcttgccgtcggcttgctgacggcgtatataaaacaaaagcagtcctcaaaaaatacgttcgtttcatcattatttttaatggtcgttattacagcgcttgaatgggttcctgcgctaagagtgaataatgaggactggctttatttgatgctgattccgctgatgggctgcaatgcgtttcagctgttaatgctgccgaagtttgcccagaggtagttatttcacttctgatgacttgacgtcagtatttgcgatcaggtcgccgactgtcacgtttttcagtcctttttgctttaaattgtgaatgatggcggggagcgcttcttcggtctgtgttgctgaatcagaggcgtgcagcaggacaatgtcgccgccttttatatgactgtttacattttcaatgattttatcaggaccgggatttgtccaatcctgcgagttaacgctgtaatgaaccactgaatagcggtactgctgtgcaatggcaagaacctttttattaaattgtccggtcggcgggcggagtaaatgaacattcttcacacccagctttttaaatgcggtctgggcccgaaggatatctttttttatttcgttgtcctctaggttggtataattcttatacgcatatcccatgctgccgatttgatgtccgtcttttaccatacgttcaactgtgtccgggtgccgttccgcccaagaagctgacagaaaaaaagtggcgtttttaataccgtttgcttttagcgcgttcagaatcggaaccgctttttcatcgccccagctgatatcgaatgttaatgcgacttcgcccgctttcgtctccccttttgaaatagccttcgggccgctatcagttaaaaatacaggaagggggacggctctctgtatataaaaaaagctggctgctgcaaatgcggcaatgataataataagcagctgttttatccttctgatgtgccacacgtagaagtggttcactggtgacgcctccttatcttgtccatgcttgattacatcgtatgccgcggcggagatgaatataacgaaatacgtttcaaaaaaaaacgaaaaaaatacttgctaaattcagccgatgcatggtatattattaaacgtcgctgatggacagcagacaacaacaaaaagcttcggaaacaacttaaaaaaagttgttgacataaaagaagctgagtggtaagataataaagctgcttcaacaagcggtaatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggattttaacggaatataagacctcgggtcttataaacagaacgttccctgtcttgtttagttttgaaggatcattcgattcttcgagatgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagacccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctttttattttatctaccatgtttttgtttatgaagcttataatattccgcagtagctcagtggtagagctatcggctgttaaccgatcggtcgtaggttcgagtcctacctgcggagccattgcttccatagctcagcaggtagagcacttccatggtaaggaagaggtcagcggttcgagcccgcttggaagcttatctaaaatacgttgatctgaagcagtttccgaatgttatggaactgttattttttgtttagttcagtaaaaacctgttgctgattgtaccagttaaggtgtaggtatttagcgcgtctcctgatgaagcctttcttcaaggatgcaaaagagattaacataattaattgttaaacgatattgacttttatcaaaaccttgatataattacttttgtcataatgaacagtataaataacaatacggtttaccgctatctgaagctgtattctggccatgtattacacttttacttgcggaagtagttcagtggtagaacatcaccttgccaaggtgggggtcgcgggttcgaatcccgtcttccgctccattttatcccaacgggatattgtgaaattgattgcgcccgtagctcaattggatagagcgtttgactacggatcaaaaggttaggggttcgactcctctcgggcgcgccataatattttttaaaatcgggaagtagctcagcttggtagagcacatggtttgggaccatggggtcgcaggttcgaatcctgtcttcccgaccattctcaagctttaaagataatatactggttttctttttttctctttttaaaaaaaatgcttgatttatagagaagcaccgtggtatattattaaacgtcgctgatggacagcagacaacaacaaaaagcttcggaaacaacttaaaaaaagttgttgacataaaagaagctgagtggtaagataataaagctgcttcaacaagcggtaatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggattttaacggaatataagacctcgggtcttataaacagaacgttccctgtcttgtttagttttgaaggatcattcgattcttcgagatgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctgtcttaaaccagttcatgatgaactggtttttttatttgaaagatcacatagatatataaagctaatgcctttcaaaggcattagcttttttgtttacattgattttgctttgctgttgtgattttgaagattgtttgattttattgtctcgagtattcttaaactgaacacaatcagcagcataaggaccatcagtgcagtaaacagccagaacgcagtttgtgcgggatattcatctaagctccagccgacggcgatcggaaggagtgaacctcctaatccgtttgaagcgagcagaatactggtagtcgtttctgtctttccgggataaaaatgattcgtgatgattagggctattgcaaacatgcctgccatgaacagccctaaaaagaagcaaagggcaaagccgaaccatacgtttttacttagtgctaatacggtaagtgctgccagaccgccaatgcttatgagacgaagataacggtgatatgtcagcttttctgataccgggcctgttagtaaccttccgatgatcatccccgtccaatacactgtaactgttatcgttgccaaagagttggggatatcccatttctcagagaaaatggaggggataaaatgtacaattgaaacttcactgcctccgtaaaagaagaagtaagcccccgccaaggcaataaacagcaatccgtgtgaccgataaccggtgctttcttttttagtgtcatcggaagagacctcttttcggatgagaagctgatcaatactgccgaaactcatctgcttccatgcgattaaaagtgcaaaactggataaccctaatactaaaaaagcaattgtccacatgtggttgttgataagaaagcctgagagcagaggcatgaaaagcgcgcctaatccgtaggccacttccatcttgctcatggccacagcctgtctttctttaatagcggtgaggatgatcgtgcctacacaggattccaccaatccggcgccaagccccgcgatgctgacgagaagaaagagcagcggccagggcggcaggaaggtgatgaacatttcgcagctgatgagtgccaggccaaagataacgacgtttttgcgcccaagctttttcaccatgtatggcatgccaataacaccgatgagaaagcccatgaactgagagaataccaatacaccgccattactgtagctttgtgaataatgtgtgagtaactcaggcagtacggctcccagaataacaagtgtaaaagcaatcgatccataagaaaaacagcttatccacagcagacgagatttcatcattttatctccttattcgtaaaataatatttctctctactcgtatgacatgacgtttttacaaaaaatccaagtattgttactatatcacataactttttctcgtacatcccttatggtaacgttaacaaattgttaacattttttacaagaaagatcgttgacaatattttcaataattaatacgataaaaagcgaaattctaataatttcataggggtggtatttgtgggaacgaaggaaatcacgaatccagacagcttgtattacagtgttgacgatgtagtaatggagcgcggagaagggatttacctgtacgatcaagaggggaatgagtacattgattgcgcttctgccacatttaacttgaatttaggatacggtaacaaagaagtcattgatacggttaaagaacaagccgataagctgatccatgtgacatcatcttttcaaacagacgccgtaaataaactggcagaaaaactagtagaaatcgcccccgataatctcacaaaagtacaccctaaagtcagcagcggttccggtgcaaatgaaggagctattaaaatggctcagtattactccggaaaaaccgatgtcatctccttatttcgaagccacctcggacaaacgtatatgacttccgctttgtccggcaactcattcagaaaagaacctttcccgccgcaaatttcttttggccttcaagtccccgatccgtattgcagccgctgtttttataatcagaaacctgattcatgcggtatgctgtgcgtagaaagaattaatgattttattgagtatgcgagcaatggaaaaattgccgccatgattattgaaccgatatccggaaacggtggaaacgtcgttccgcctaaagagtattttaaacagctgagacagctttgtgatgaacacgatatcgccctgatttttgatgaaattcagaccgggttcggacggacgggcaaaatgtttgccgcggaccacttcgatgtgaaacctaatatgatgacggtagcaaaagggctcgggggcacaggcttccaagtcgccgccactctgacggaggacaagtataccgggcttccggggtatacgcactccttcacgtacggctcaaatgtgatggccgccgctgccgcgtgtaaaaccatagatatcatgcagcgtccgggatttttggaaaatgtaacgacggtcggtcattatattatggatcgcttagaaacgatgaaagaggatttcgcttttatttctgaggtaagaggcgtcggtcttatgatcggtgtggagattgtaaaagagaacaatgaaccggatgtggagctgaccaattatattgcaaaacgggcaatggattacgggctgattctccggacatcccgttacgggttcggaaatgtttttaaaatccgaccgcctttaactattacacttagtgaagcagaagtgctctgctacagacttcgcaagctattggaggaaatcaagtgagagactatatcatcgggcttggacaatttgtttatcataaggtgaaaagtcaaaaaggcacgctgaaaaaccggctcgtaaacggctattctccgggaggcgacgcccaatttaacatagacgccgctgctgaggaggcggtgctggattatattcaagataagggccatccggttgctttttacacggaggatggcggcctgaagctgattggagaagatccgcaatatattttaattgtagatccgatagacggaacgcgtccggccgccgcggggcttgaaatgtcgtgtatttcgattgcgcttgcttcgtataagccaaacgcaaagattaaggatatcgaatttgcttttttgcttgaattgaaatcgggcgcttacatgtacggtgatatttacagcgacgccattcagtttgaggggtatcagggagaattgccgaatttgagcgaagtgcgggatattaaaaatatgttttggagccttgagtttaacgggcatccggcacagctgatgacggatgcatacggtcatctgattgaccggtcagccaataatggcggggtttttgttttcaacagcgcttcttattcgatttcacgaattatcacggggcagatggatgcttatgtggatatcggcaatcgtctgctgaaagatgatccgaagctgctttcagattttcagcaggtcggaaacggagaggtgctgcatttgtttccttatgatattgccgcaagcgtctttttggcgaagaaagcaggagtggtcattacggatgcatacggccggtctttggacgaaacgcttctgacagatttaagttatcagaaccagcaatcatgtattgcggcatcaacgaaggagcttcatcaaacattgttagaccaaatccgctggggcagaaaggaagagaaatatgaaggcgttggtctggactcctaatgataagcttgaatatcaagaggtggacgagcctcaaattcggaaatccaatgatgtgaaagtgaaaattttcggcaccggtatctgcggaacggatttaaatgtgctgaaaggaaaaatgaatgcaacccatcatatgattatggggcatgaatcggtgggagcggtcgtggaaatcggaccggacgtgacaaatgtaaaagtcggagaccgcgtcgtgatagatcctacgcagttttgcgggaaatgtcattattgccggagagggctgacgtgttattgcgaaaccttcgaggattggcagctcggaatcggggcgcacggaacgtttgcggaatattacgtcggagaagacaggttcatgtacagaattcccgattcaatggaatgggagcgggccacattggttgagcctctctcctgtgtgctgaatgttgtggacaaagcttcgattcagccggaggactcggtcttggttttggggtcggggccaatcggactgcttgtgcaaatgatggtgaaaaaactggcgcgattgacggttgcgactgaaataggcagtttccgaagcgaggcggcgagccggatatcggattatgtctaccaccctgaagcattaaccgtggatgaagtgaaacggattaatcaaggaagaaaatttgatgtaatttttgacgcgatcggcaatcagcttgattgggcttatccttttattgaaaagggaggcagaatcgtgccgatgggctttgatgatacgtatgagatgacagtcaggccgtatcagctgctgtcaaacggcgtaacgattgtgggcacaggtgaagcccgtcagatcatggaggctgcgttagcatgtgcatccgaccttccgcagctctatgattttattacggaaaagacggaactgaagaattatgaagaagccattgatcatctcatgggcatcgacccggtgacaaaagaaagaaaggatatcagcgcaataaaaacgattcttgtgtctgatccggaacttttataaaagcggaaacggctccagtgagagccgttttcttttcttttttatacggtcttgcacatttctttaaagtttaatatgatactctttgttaaccattcctttcctcaagacattatactctgagcgtgtccccttttccccgtaagcttgcctcatattccccagataaaaatcaatgtttccaactgataaggtgcggatttttatagtgaaaaggagtcgttatcatttgaaagattatacgttacagcagcaatggttcgggaatgtccgtaaagacattctggccggtattctggttgctctcgctctgatccctgaggcgatcggattttcaattattgcaggtgttgatccgatggtcgggctttatgcatcattttgtatcgcgattattatttctatcttcggcggcagaccgggaatgatttcagccgctacgggttcaatggcggttgtcatggtgacattggtggctgattacgggctgcagtatttgtttgcggcaaccattttgacaggtattattcaatttattcttggtgtcagtaagatagcgaaattgatgaaatttattccgcgttcggtcatgatcggatttgtgaatgctttggcgatcttgattttttctgcgcagctgccgcagttcaaaggagcttcatgggtcatgtacgccatgcttgtcggatcactggctatcatatatcttttgccgaaggttacgacggctgtgccgtctccgctggtggcgattattgtcatgacgatcattgcggtggtcttccatgcggatgtccgcacggtcggtgatatgggcgggattacaagttcacttccgcatttcttgataccggatgttccgtggacgtttgagacattgcggattattttcccgtattcactggcgcttgcattcgtcggattgcttgagtcattgctgacggcccagatcattgacgaaatgacggatacggatagtgataagaacaaagaaagccgcggacaaggcatcgccaatattgtgaacgggtttttcggaggcatggccggatgcgccatgatcggccagtctgtcattaatacgaaagccggcggtcgcggccggttgtcggcttttacggccggagcgtttttaatgtttttaattgccgtattaagcggtatcgtcgtgaaaattccgatggctgcgcttgtggccgtgatggttatggtgtccatcggcacgttcgactggtcatcgattaaaggtttgcggaaagcgccccttactgattcgatcgttatggtgattaccgtcgtgacggtcgttctgacaaatgatttatcgaagggtgttttcgcgggtgtgctgctaagcgcgatcttttttacggcgaaaatttctaagctgaagattgtgtcacattccgaacagaaagatgtcagaacttataaggtaacgggacagatcttttttgcttccgtgtctgaactgatgaatgccatcgtttatgatgaagacgtgaaacggattatcatcgatttgactgatgcccacgtgtgggatgattctggagcggctgctcttgagaagattgtcgccaaatgtaaagaatacggaattgaggctgaattaaagggattaaatcagaaaagccgagatttaatgaaacaaatggcatagaatttgtgaagtccggatgaatatatccgggctttttttcggttaaatttgccggtgtgcattgttataatgaatgagacttgaaaaccgtatataggagacttgcatatgatgtggcttcagaagttgaaccaagtgttggggagaatcatgccgcttttgactccgtctagtgtggcggcgggtgtgctgttatctcagcatatcagctggatggccggcgctgtgccgtggatatttgcatttattacatttacgggcagtctgagtgccaattttcaatcgctgaagcgcagtatcgagaagccgctcccgatgatcatggcattgtttgttctgcatattttcatgcctgtttttgcatggggaagcggccatctgattttcagcggtgaccctttaactgtgacggggctgattatgggtgtggtgattccgaccggaattacgagtttgatttgggctgcgatgtataagggaaatgtcggattgacgctgtctattatcctggttgataccgtactttctccttttatcgtaccattaagcctgtctgtcctggccggggcgaatgttcagatggatgtgtggggcatgatgaaagggctggcggagatggtggtgattccgtccatcgcagggatgatggtcaaccagttttccccgccggtaaggactcaggcgataagccggtcactgtctcctttttcaaaaatctgtctgatgattgtcattgccattaacagttcggaaatcgcgccgtatgtcacgcacgtggatatcaaatttgcgggcatcgcaggcacggtattttttattgccatgacgggttatgccgtggcttggctgatcggaagactgatgaagcggagccaggatgaaatcgtgtctctgatttatacggggggcatgcgcaatatcagcgccggagccgttctcgccgtgtctttctttccgtctcaagtggcggttccggtcgtcatcgggatgctctttcagcaaatccttgccgctttgttcggctatttgctgagacgctttgagcttaagccggtcgtgatcaagtatgaaaaaaaccgctcagtcacgtgagcggttttttccgtacagccagcttagtgctgaattaaattgtcgtttgaacgcttcttgatggtgcacggcgccctcttcgatcgtgaatgagagctgagattgagaaaagcctttttgcctcaggcttttgtacacgtctttattttgtccgatcatggtgttttggatgttacatttttgctctgcttcacggctgccgacagacataaagatacgctgccgtgccggccgcaaaggtgcggagcggacataatctgctgatttttcataccagaaggaaccggaaatacagccgattctgccgaatatttcaggcttttgcagcatcgcgtatatcgaaaacagtccgcctaatgacgcaccgatcagtcctctcgtttccggatgcgcagaaatgtgatgcgtatcttcaacagtgggaataatgacatttgtcagctcctcgagaaagagcctccctttgccgccgaaatcatgaaacgcagggctcagggaaggcgcgggccacggtgtgtactcatcgagtctgtcagccggtttgatgccgatgaaaatcaattcgggaagtgttccgttcgtaaattgggattcaagcttatctatctgttctaaaaacaaagaacccccgtcaagtacgtacacacagggtaaagcccctgtttgaaccgaataggaaggaggaagatacacagtgcattcccttccgtttatcgggtgttctgtaagggtgcctctcatgcgtccatcccctttttttgcttaaacagaagaaaaaagaaataaggaacgccgagaattgcaaggataattcccgccggcacttctgaaggctgaaagaacaatttgcccgcaaagtcggcggatatgacgaggagcataccgaccagtccgctgaccggtaatgagtatctgtgctcaatcccggcgagcctgcgggaaatatggggcgcgatcagtccgacaaatgccatgctgcccgctgcggttacacatgcgctgatcaaagcgatgcaggcaatgagcaaaatggttttttctttattggttgaaacaccgaggcttttcaccgtgtcctcatcgaaacgaatggtatcaagcaatgacgttttcgccataagaagaggaatgaacaagatcagccacggaaggattgccgtaatggtcatccagtttgccgaccagatgctgccgtttttccaaaccatcgccatctcataatcctgcgggtccatttttaatgatagaaataaagacagcgcgctgaatccggaattcatggcgatcccgacgagaataattctgcccgattccagatgcccccggtgccaggcgaaaatatagatcagcacggccgccatcagtcctccgatgaggccgaagacaggcatacccatcgcagaggcaagtgccgtcgcttcagattgtccctgaaacagaagcataaacgtgacgattcccgctccggctcctgcattaatgcccaaaataccgggatcggcaagaccgtttttggtaatggcctgaataacagctccggctatccccaatccgagtccgatggcagcagccatgactatgcgcggcagcctcagctgaaacagcaaaatgtcatattgcggattcggatggatgcggaaaagcgtactgagcagttcacccggctttgcggaaaaagaaccgcttgtcatgctgaaatagcttacgagcaatatgagagcaatcagaatgatataaattcctgccattttacgcaccacgctgatcccctccttttcttttaatcaaataaagaaagaaaggaacaccgatgatagaagtgacaacttcaataggcgtttcaaacggataattgatgaatcggctcgcaaggtcgcaaagggtcagaaagacgccgccgataatgcacgcgcatgggatcagcctgctgtagtccgatccgacgagaaaacgtgtgatgtgcggaacgactaaaccgacaaaggcaatttttccggcgagcgccaccgagcttccggtcaatatgacaacagccgccatcgccatgagtttgatggttcttttctgctgtcccagactttttgaaatgtcgtctcctaatgatacggcagtgacctttttgctgagaatcatggccgtaatgattccgatcgcaaaaaacgggacggccagtttcaaaaaatcagggttcatttgatgcagtctcgcactgtaccaaaaactgagatcctgcgaaatttgaaaataaatcgaaagcgcagccgacagactgctgagaagcatactggtcaccgttccgataatggcaagctgcaccggggtaaaaccgccgggaagaatggaggccagcccgaaaacaagagcggcgccgaatgcggaaccgataaacgagtagatgatcatttcaatggatgtcgattgagggagcaataccatgcaaagggtgatgataaaagcggagccgtccgacacacccatgatcgaaggcgaggccagatagttccgtgtgattccctgcatgagcgctccggaaacagcaagggcggcgccgataaacatagcaccggcagccctcgggattcttgaatgccatatgatctgatggtcggtattctccggattaaagtgcagcaatgcggagaacacggtatggatgtcaagctgctttgcgccgtataaaacggaaaggagcagtgacagaacaatagcaatcggtgaagcaatgataataatgtgtgtccgccgttttgcatacatgtgaaaaacctactctttattagtcttgagtcaatttgtcagccgcaacctgtaagaagctgattttactccacgcggttccgccttgggctaatggatcaatcgtattgacgtatacatggtcttttttgactgccttcaggctcttccagatcggatttttctctaagtctttcaaagcgtcaggcttatctgcgttttcgtcatcagaaaattgtacgaagatatggtcagggttcatttcgcttaatttttcaagagaaatcagttcctgcgctttcgccgctttgacttcgtccggcgccttcaggcctaaatcaccgtaaagcgtggagttgaaataaacttgttcaggataaatataaatattgccttgtctgattctgatgaccagcgcgtttgactgtttcgctttgctgttgatctttgtttttgtctttttcaggtcctgttcgtaatctgcgatgatttttttcgcttttttctctttatctgtaagctgggcgagcagcatcatgttttctttccagtttgatgagatatgagagacagggatcgtttcagcggtgccgctcaattttttcaacgttttttccgggaatttggttgatgccagaatgacgtccggctgcagctcaagaattttttccatattcggctgcattttttcccccgttgatacggatttatctgtaatatctttaaacagttccgggaatttgccggagaaagaaattgctcctgccggatgaacgtcaagcaatttggcgtcttccattgattctacgctgcctgtaatggcgattttgtcagtcggcgctttgacttcatatgtttttccgagatattcgattttctttttatctgaagaagcgtcctttcctttacttgctgtatcagttgtttctgagcttccgcaagccgcggccgtgaaagccaaaagcaaaatcatgaaagcgaatgccaatttcttcatctattgttcctcctgttcaattgataactattatcaattggaattatagagaatgaatagggataagaccatggataatttccggcattaccatggacgatcttcggataaaatggaaatgctttgctcgatcatccgctgatgtccgcttggagaatattcaatccacgggtcagatgaaatgggaaacacgcgtttattgctgacggcactaaggttctgccatatcccggactgctgaatccgctgaaaatagcgaagcgtttccggttctttacaagtgaaaagcatgatgcagtcagcctggcaatccgccagcatttccaaggaaatcttttcgtcaggagcaaatgattccggttttgcggaggcaaagtccaaatcaccgaagaagacttcctcaatactgttgttatgggcgatgtacatattttctttatatacacggacaaataagaaccgctggtgccgcacatgtttaagagcatctttcgctgaatgggtgagactttgataagttttaagccagtgccgcgcttcctgctcttcattcagatatgcggctgtgcgaagaaactggtctctccaattctcttgagccggaagataaaaaacttcagtgatgtcattcaggcgctgtttttcttcttcactgacagaatcgagactgaaaataatgtccggggcagcttgagacagcgtatgcaggttctcttcccaatttgcattatagcggtaagcgctcaggtggaccggaatatcggaagagaattgtttgtaataataggccgtccatttcgggtgcagcgccgcagcgtaaggcacgtgatgcagaggaatcagatgccccatcgtttcttttccgtacgcggccatttttgtgcgcctttttttcatgtagcttgtaggtgagctgccggtatgttttttaaagatgcggctgaaataaaattcgtcctggtagccgatttgatgagcgatttcccgcagtttgcagcttgccttggccatcagttttttcgcattggttatgcggatgtctgtgatatattcagttacgctctgcccgtatagttttttaaaggtttcactgtaatgcttgggactgattcccgccatatgagcgagctgggtgagcgtgatttttgtgtcggactgagcatgtatgaattgttttgtctgttcgatcgccgctttcgtattattttgatggcatacttttgcggcataaaggtcgtacatcagctgctgaaagtcggcggtatatttcattttctgcaatccatccgccgatcgcacgttttcagaaagtgattgaagccggcttgtcaaatgatcaaccgtttgtaaattcatttgctgaagtccgtggaagatgtcttccccgttatccggaagcatcgcttcatcatctgaggaataggagaaaacacggagtctgacgatatacaaatggatgccgcctgacgatataggggcaatattgaatgtctcatcacaaggacagatgtagagcgtttccttctgcagcggaaagctgtctgttccgatatcaatttgtccctcgcctttcacatgaaagatcaatacgggggaatcagtgagctgatgctctgacagaaggtcggctgtttttttcacggagatgatatcaatgggctgaaagaataatgtgtttttcatgagaaaccaccttttaggaaacattcatttaaatgataacagttatcatttaaattgtaccaaataaatgaatgttttcctataaaaagcggaaatgtgaaatgcgtcaaaatgttacacgtgtaacacgaatgttgtcagtatatgaggtattgttttcttagagttttgaattggtccagccggcgttgatatgtgccggtgatgtcttcaatggaagcgcctttttctatttttttgcgtacccagccgttaccgatcagcttgtcaaaagagcctgtcggcaagaatgaaaagtcattcggatataagtcatgcatggttttcagaatggagagccctgtttttgccgcttcaaatgtgtttctgtttgttacgtagacttgtacgccgtggcacagcttgccctggtgtttggagaagctggggatgaatgaagcggctctgaaggtgacgcccgaaagcttgagactgttcaggcgttcttcgagctcggtgcttttcatataaggcgcgccgataagttcaaacggctttgtcgtgccccttccttcggatacgtttgtgccttcgattagtcctgttgccgaatatgcaaatatgctgtccggggtcgggatattaggcgaagggaggacgaacggcagaccggtatcttcaatcgtcatcgtccgcttccagcgcttcatttttacgacggtgaggtcagcgccaatatgaaactctttattgaataaaagagcaagctcaccgatcgtcatgccgtgcttcagcgggatcggatacagtccgacaaatgaagcgtaatccggttcaagaaccgggccgtccggatttcgtccgccttgcggattcggccggtccaagacataaaaaggaatgcctttttctttggccgcttccatggcataggccattgtataaatgtaggtgtagtaccgggttccgacatcctgaatatcgaaaatcagcacatctgtatctttcagcatgtcaggcgtcggtttcctcgtctccccgtataggctgtagacgggaagccctgttttttcgtctatataggatgtgactttgtctccggcctgagcatcgccgcggacaccgtgctccggtccgaataatgccgtcaggcggatgtctggcgcctcatacagcacgtcaacgctgcttttcaatgatgcgttcacaccggtcgggttggtgatcagcccgaccctttttcccttcagttcctgtttataatctttcagcaggcggtcgatgcctgtttggatgcttggtttcttggcggtatgaaggtttctgtcagaagccgccgagactgccgtcatagcactgatgacgacaagtccggcgagaagtgcagccgtatgtgttttcataatcagccctcctgtttaaagcggttttccggtcttcagattgataccgaaaccataaggatacagtgtcgttcccggatgcgtgactgaaggaatgtcagcgggcagcctgccttgcggtgttgtctgtccgaatatcgcttcaatgcctgccggaatgtttggctggaggaattgtccgtctgtatatcctttaaagccgtagactgcgataagggcttcagcttcttcaaaattcgcggcgtcgtaaggattacgcaggctcatcagcacaaagggtttttggttcgattgtgcggctttcatgacggcccgcggaaatgcggtcgtccacttgccgggatctgtgacggaatcgtcaatcacgccgtcgtttacgacagggtcattttttacgacataggagcctgtaatcacgtaatccgcgtcggataccagctttttgtgttcatcatgaaatgtgcgctcggcgaagttcattttactgatggttaccggccggatttttttcttcttgatgagctgccgaatggtttgttccattgccgctgtttgatcttcataaggagcggcaatgagaacgcggctgttctttttcggtttgaatgggagcgtgcggtttttgttttgtaagacggtgacggatctttccgcgatttgtttttcagctttcaggtgatttttgctgccgacggttttctttgcttttgcaatcttctttttcagatttgtctctttcggtgcgggatatatccctcgttttattttcagggaaatgatgcgttccgctgatttgttaatttgctgcagcggaatatcccctttttgtaccgccttttttaacgcggaatgaacccgggcaaagcggttttccgtttgcagcgatgtcacttgggccggcatcagggcaatatcgactcctgcttttactgccatgacgaccgcctcttcctgaccgaaatgatcggcaatggctttcatatttaatgcatccgtaacgatgacgccgttaaatcccatttcctcacggagaagatgagtcatcacttttttcgagagtgtggcgggtacgaggatgtctgaaccgtccagcttgcttttataggttgtatcgtcaaaagcgggaaattgcacatgagctgtcatgatcatatcagctccggcctgaatggcctgccgaaacggataaagttcaatctgacgcagcctttcttgattgtgggtgacaagcggaagaccgtagtggctgtcgacatccgtgtcgccgtgtcccgggaaatgtttgacggcggcagcgacattctgcttttgctgagccttcattgaggcaaggccgagggaagctgtcagatcacggtctgaactgaacgacctgacgccgatgacagggtttccgggattattattgatatcgagaacgggcgcgaaattcgtattaatgcccagtgctttcagttctttcccgataatggcgccggtctgggacgcgtaggctgtttttctagcagccccgagcgccatattgcctgggaaatgagtgccctcaccaagtctagttacgatgccgccctcctgatcaatgcttaataatagcggaatgtcagggctcgccttttgaaaggcatctgtcaggcgtaccgtttgctcagtgttttttacattttctgcaaataagataacgccgccgaaccggtacttttgaataagccctgcgacttcgtcattcatttgggtaagagcctcaggtgatgactgcccctttttttgccaatttcgaaaatcaggcatgagcatctgccctaatttttcatctaacgtcatacgggataccgcttgttccgcctgtgacggaatgtccggttttgttgatgcatgatgcgtgccgaatacaatgaacaacagtaatacagctgagatgaaaagtttcatgatggtgccctcctgccgtcatagtttggacaaaagacatgggttgtcattcaatggcttcataaatcgcttttatgacgctgccgtagcttccggtcgggaaaagatccccttcaaaaacattcgggttttcaccggggctgacgacgggggaatgctttttattggtcaaaagtgcgatccccagcttataagcgggatcaataatcgtgatggtgccggtccatcccgtatggccgtatgcctgcctgcttgcataaggtccgaacatccactccatatccgggctgccgtttttccgccagccgagagcgaaagtcggatcagaggatgccgccgttgtgaacaaatcggccgttcttttattgaagagagaaacgtgtttataactgcctctgttcagcatgacttgaagaaggacggccatatcatcagctctggaaaacagcccggcgtgaccggacacccctcccattgagtaaaatgctttttcatcgtgaacttccccctgcagcgtatatgtcctgatgtgagggaaatggatgactccgtcacgtgtgttgcctaaacgttcagtagctgcgaatgctttttctttaaaacctttttgcagcggattgaacagtgtgtgcgtcagtttcagcggtttgtacagttcttgttccgcataggtatcaagggtttttccggttatgttttcaatgatgcatccgagaatcatgtaaccgatatcgctgtatacgtgttttgttcccggcttgtattcaagcgggatctgggtgagaaaacggattgttttatcccgttcttgtgaatataaagggcctgcggtgtccggctgatagaaataaaagcttgccggcagaccggattgatgctggagcacatcgatgacgcgtatacggtctttttcttgaatcggatcgctttttctgtctttgaaatcaggaaggtaagccgagactttttgatacacatcaagctttccctggctgacgagtcgctgtagtgcaaaattggccgcgtacatttttgtattggaagctaaatcaaacatggttgatgttttcatttttttcggacgggataaaagggtgttcccgtcatattttttgctgtagccgtatgctttctttttgatcacccgtccgtcctttacgacgatgaggacggctccggggaatcctgctgcgatgtctttttcaatcatttgatcaacctttctgagctttgctgcgtcgtataatttggattgggcttcggctttgtgctgcggcagaaaagagaggctgatgaccattgtgagtatggcggctgtcagtgttttcatattctgatccctcccggtttattcaaattcagcagccatgtcatccttaaatccgaacgcataagtgaagacaaagcctgccgcgtaagagatgaagagaccgatgatatacaaaacgatttgagccggctgtacgagaaacgagagcggaaggccggagacaccgattgaaaaagtcgccacttgaaaatgggcttgaaaggcgccgccgattcccgcccctaaacacgccgtcaaaaacggccggccgagcgggagcgtgacgccgaagataagcggctctccgattccgagcagaccggatggaagtccgccgccgatcgctctttttaatgaggctttttttgttttcataaagatggcgaaggccgcgcctacttgacccgcgcctcccatcgcgagaatcggaagaagcgggtcatctccgattgatcggattaattccaaatgtacgggagtcaagccctgatgcaggccggtgacgacaagaggcaggaaggcggctcccagtacaaaccctgagagcactcccccgacattcagcagcgacaataaacctgatgtaatcagatcagaaataaaaccgcctgcagggataaaaacgacatatgtcaccagcccggtgataagtaaagacaatgtaggcgtgacgataatgtcgatggattgatggacgtactttctgataaaccgttcggtataagcgataaaaaccgcagcgaaaagaacgccgattaatcctcccctgccagggagcagattctctccgaacaaactgatattggcgatctcagggttaaggatcaatatgcccgcaaggccgcccatcgcgggtgtcccgccgaattccttcgccgcattgatgccgacaaggacgccgaggtaagcgaacaagcctgaaccgataaccgttaaaataagtgcgatttgggattctttcgggagccagccggcctgaatgacggctttcgtaataccggtgattaaacctgatgcaatgagtgcaggaataaggggaatgaagatgcttgatatttttctcagaaacaatttgatgggtgtggtgttttttctgttgagatcggcttttttccgtgaggcggcttcttttaaatcaatgttttttccggatggcataagttttgcgaaagcgtcggcgacatgattgacgacacccgtgccgagaatgatctgcagtgtttcggcttcgacgacgcctattaccccgtcaagccgtttcagcgcctcaatatccgttttgtcccgatctaaaggtgtaatcctcaggcgtgtcatacagtgggtaaagcctgaaatattcgatgaaccgccgcaattgtccaggatatctttggccagtgactgataaaatgcctctttgctcatggagatcctcctttttctgtacgatttttcccggggagctatgcctgaaacgcgtcctaaaagcgcctgcgccgaacatgaaaacggcgcgggctcgtaaaagcacaatatttttctccaaagaacgatcagcgttctttttctcttgaaacgtgctgttcaatggctttatcaatgaatccttctgattctttgagcagtgccttcgcgtgtgtttcgtccgaattcgtcttcagcatgacgattgccgttttgacatggctgtctgcggcctcaagcgtttcttttgccttgtcgtacggaacgcccgtgatgctttggataatgccgattgcgcgttctttcaatttttcgttgctgacatgaacgtccaccattaaattttcgtacactttgccgcttttaatcatcacggccgtggaaatcatgttcagaatcattttatgtgccgtcgcggctttcattcgtgttgaccctgtaatcacttcggggccgacaatgacttcgatgctgtgatcggcaaaggtgctgatcaaggagtccttattgcatgtgagcgcgacggttttggcgccgattgtttttgcatatttcagcgcaccggccgcatacggcgtgcgcccgcttgccgcgatggcgatcacggtgtcttctgcggtaagcccgatcgttttgagatcgagagcgccggtttcctcgctgtcttctataccttcagccgcttgcaaaaaggcgtctgcccctccggccatcagaccgatgacggtgtcgggacttacgctgtatgtaggcgggcattcaaccgcatccagtacaccgagtctgccgcttgtgcccgctcccgcataaatcagcctgccgtttcgccgtaaggactgatgggcgaattgaacggcaatctgaatatcgggcagcacctgctgaacggcttcagccactttgaaatcctcttcgttaatgatgcggagaatttccattgtgtctgcctgatggattgaagcggtctgcggatttctggtttctgtggtcaatctgtgaatgttaagccggtctgtcatgattgtaccctcccaagtcgttaatacttgaagtatatgggcttctgaatagatgtttcaagaaaaatcggcagggatgagatgaataatcaagcgctttcacaaaaaatgatgcagaatgtgctgttcaccgatcgggccgatcctgcgccgccctttgtcaataaaaccggaagaccggtacaggttctttgcacgttgattgcgatggtttacagcaagcacgatttcatcacaccaaggaaagtaatttgcgacaaaagcggggagctgcagcatcgcttgtttggcataaccttttccctgatgcggcgcatgtaatgacagcgcactcagcaaaatggcagacacattgttcgaatacggagcaatggtttcttttgaggtatgtaaaataaaaaaaccgacggggcggtcttcttttaaaatgactgtcgggtagcgatcccggatgacaagcgcctgcggcaggacatctatcggcagagctgtgaactttttatcttcttcactcagcacaaacccgttcagcccgtctgcatgctccggtttataaaaggacagggctacatccatgatatctactctccttttttataattgatccaattcatcttctgatagaacacggcagcctgcccgttttaaaagagcggaagtgatgccgtctccgagtattttttttcctgagaaagtgccgtcatagataaagctgctgccgcaggacggactgttttctttaaggatgaccgttgcggcgcctatttcttttgcgtatgctaacgttttttccgcgccgtccatatataaagctgtaacgtcttcgcctgatgccgttacgattcttgccgttccgttcagcacgtcttcacccgtgccgccgatgatttccgccggttcgcggggagtggtgaagccgcccaaaagttcggggcagaccataacagctttcttttcttctacgagtctgcggattttttccgaagcggcgtgagagccgttatatctgcattcgataccgccgagacaagagctgactaagatcatctgtgtccattcccttcaatattttgatactttcatcataaatgaaataagagaggagggatgagtttttcagttaaaaaacgggtaaaaaagtttgaaaataaaaaaaataatttttctctttacaaatggggtacaacctgtatataataacttttgtcagctcgacgcggacacagcggcccgttggtcaagcggttaagacaccgccctttcacggcggtaacacgggttcgaatcccgtacgggtcatatggaggattagctcagctgggagagcatctgccttacaagcagagggtcggcggttcgagcccgtcatcctccaccatatttgccggcctagctcaattggtagagcaactgacttgtaatcagtaggttgggggttcaagtcctctggccggcactgttttccaaaaaaatacggaggggtagcgaagtggctaaacgcggcggactgtaaatccgctccctcagggttcggcagttcgaatctgcccccctccaccatttttgggctatagccaagcggtaaggcaacggactttgactccgtcatgcgttggttcgaatccagctagcccagtctcagacaccttttgcataaaggtgtctttttttatcggcattttgtttcggtttttgattgttcatcagatatactatttttaagctgctgttaaggcagtatattctgtattttccatctacaccctgcctgaaatttggtaaaataaatgtaataaaaaaatgaaaccttttaaaacaatcaacgtatagatacagaccggtgaagggcagaggtaagataaaacatggaaaacctgattaaaaaaagaatcaagcaagtcaaaaaaggcgatcaaaatgcgtttgcagaaatcgttgacctttataaagataagatttaccagctttgctaccgcatgctcggcaatgttcacgaagcggaagatattgcgcaggaagcttttatcagagcgtatgtcaatatcgacagtttcgatatcaacagaaagttttcaacgtggctttacagaattgcgaccaacctgaccattgaccgcatccgcaagaaaaagcctgattactatctggacgcagaagtagcgggagcagaagggctgacgatgtattcgcagatcgccgcggacggggttctccctgaagacgccgtattgtcattggagctgtcggacacaattcagaaaaagattttaaagctgcctgacaagtacagaacggttattgtattaaagtatattgacgaactctctttaattgaaatcggggagattctgaatatccctgtcggcaccgtcaagacaaggatacacagaggcagagaggctcttagaaaacaattgagggatctttaagtggggtgatgaaatgagctgtcctgaacagattgtgcagcttatgcataagcatcttgatggagatatccttcctgaagatgaaaacgtattaaaacaacatttgcagtcatgcgggaattgcaaacggcattttcatgaaatggagaaatccgtagcactcgtccgaagcacatcgcatgtcacggcccctgctgattttactgccaaagttatggcgaatcttccaaaagagaaaaaacgcgcttctgtaaaacgatggatcaaaactcatccgatgattgcagccgcagcggtttttgtgattttaatgggcggcggttttttcaacagctggcataatgaccacaatttcagtgtgtccaaacagccgaaccttgtcgtgcagaatcacacggtcaccgtccctgaaggcgagaccgtaaagggcgatgtcacagtaaaaaacggcaagctgttcattgaaggaaaagtcgacggcaatgtgaccgtcgtcaacggagaaaaatacatggcctcagccggacaagtcaccgggcagattgaagagattaaccaattgtttgactgggtctggtacgaactgaaatcggcgggacagggcgtcgtaagcgctttggacccgaatgaagatgagtaaagcgtataatcgctttactctttttttgtgcaacgccgcgccggctcatttcacttgagaaatcaaaatgtggtataatgagcacgctatatgatgtacatattgctcatgcagcacaattcataacggaaaaaacgaaatgactgaattcttggaggacgaggaaatggcttttgaggacatcccatttttgcaatacctcggcaatgccgttgatattctccttgtttggtatgtgatatataaattaatcatggtcatacgcgggacgaaggcggttcagcttttaaaaggaatcgtcgtcatcgtattggtccggatggccagttcatatttgggactcagcacgcttcagtggctgatggaccaagcgataacatggggatttttagcgatcatcattatattccagcctgagctgagacgggcgcttgaacagctcggacggggccggttcttttccaggagcggaacccctgtggaggaagcgcagcataagacaattgaagcgattacaaaatcgatcagctacatggcgaaacgccgcatcggcgcactcatcgccattgagcgcgatacgggaatgggcgattatattgagacgggcatcccgcttaatgcgcaggtcagctcggagcttttgattaatatcttcatcccgaatacaccgctgcatgatggagcggtcattatgaaaaataacgagattgctgcggctgcctgttatctgccgctttctgaaagcccgtttatttcaaaggagctggggacgcgtcacagagcggctgtcggcatcagtgaagtgacggacagcttaaccattattgtatctgaagagacgggcgccatcagtgtggccagaaacggagaccttcacagagaattgacggaagaagcactgaaagaaatgcttgaagccgagtttaagaagaacgccagagacacttcttctaaccgctggtactggaggggcaagaaaaatggataaattcttaaacaaccgctgggctgtaaagatcattgcattgctcttggcgctgctgctttacgttgcggttaacaacaaccaggcgccgactccgaaaaagccgggggaatccttttttccgacatcaacgactgacgaggctacgcttactgatattcctgtaaaagcatactacgatgaagcgaactatgtcgtcaccggcgtgccccagacggtaaatgtcacgattaaaggctcgacaagcgcggtgaaaaaggcgagacagacgaagaattttgagatatacgccgatatgaataagctgaagaccgggactcataaggtcgaattgaaggcgaaaaacgtatcggacggactgacgatctccataaacccgtcagtcacgacggttacgattcaggaaaaaacggctgagagttttcccgtggaagttgaatactacaataaaagcaaaatgaaaaagggatatacccctcagcagccgattatcagcccgaaaaacgtgcagattacaggttcgaaaaatgtgattgataacatttcacttgtcaaagcatctgtgaaccttgaaaatgcaaatgagaccattgaaaaggaagtgaaggtgaccgtctatgacaaagacggcaacgcacttcctgttgatgttgaaccgtcagtcattaaagtgacggttcccgtagccagtccgagcaaaaagcttcctttcaaaatcgaaaggaagggaagtcttccggacggggtgagcgttgcgagcattgactcgaatccgagtgaggtgacggtttacggcccgcaggatgtgctggattcacttgaatttattgacggcgtatctcttgatttaggcaaaattgataaagataccgatatcaatgccgatatcccgcttcctaagggtgtcactaaggtatcaccggaaaaaatcacgcttcatgttaaagtggacagtgaagacaaaaaggattttgacaatgtcgcaatcaagacggtcggactgggaggctcacagcagattgagtttctcgaccctgaatcgcaggcgataaatattacggccaaaggctctcccgccaacattaaggcgctgaaaaagtcggacattgaactgtatgccaatgtctcggacttggatgacggagagcactctgtaaagcttgaagtaaacggcccgcaaaacgtcacatggtccctgtcaaaagacacggttaagatcaagctgacttctaagaaaaacacaagttcaaataaaaatgacggcggctccgctgattccggcaataagaacggcacaagcggagacgcagacaaagacaagaacaagaaccgggaagacgacactgacagcgatcagaataaaagtcaaaaccaggatcaaaatcaagaccaggatgaagacggatcaagcgctgattcttcttcaacagaatgaaaaaggagcgatacaaaatgggcaagtattttggaacagatggtgtaagaggtgttgccaacagcgagcttacgccagagctggcctttaaagtggggcgttttggcggttatgtcctgaccaaagataagcagcgcccgaaagtgctgatcggccgtgatacacgtatctccggacatatgctggagggagcccttgtcgccggacttttatcgatcggagctgaagtgatgcgcctcggcgttatttctacgccgggggtatcctatttaacgaaagccatggatgctgaggcgggcgtcatgatctccgcttctcacaaccccgtacaggataacggaattaaatttttcggaggggacggctttaagctttctgatgagcaggaggccgagattgaacgtctcatggaggaaccggaagataagctgccgagaccgacaggcgcggacctcgggcttgtgaacgattattttgaaggcgttcaaaagtatctgcaatttttaaaacagacggcggacgaagattttacaggcattcatgtagcgcttgactgcgcccatggtgcgacatcttccattgcgacgcacctttttgccgatctcgatgctgacgtatctacaatggggacgtctccgaacggattaaacattaatgatggcgtcggttctacacacccggaagcgctgagtgctttcgtcaaagaaaaaaacgccgatatcggccttgcgtttgacggagacggcgaccgcctcattgccgttgatgaaaaaggaaacatcgtcgacggcgatcagatcatgtacatatgcgcgaagtatttgaaatcagaaggccgtctgaaggatgataccgtcgtatcgaccgtgatgagcaacctcggtttctacaaagcgcttgaaaaagaagaaatcaaaagcgttcaaacggcagtcggcgatcgctatgtcgtagaagcgatgaaaaaagacggctataatgtcggcggcgagcagtcagggcaccttattttccttgattacaacactaccggcgacggtcttttgtccgcgatcatgcttgtgaatacgctgaaggcgtccggcaaaaccctttcagaacttgcggatgaaatgaaaaaattcccgcagctcttagtgaacgtgaaagtgacggataaatataaggtagaagaaaacgctaaggtgaaggccgtgatttctgaagtggaaaaagaaatgaacggagacggccggattttagtgcgcccgtcaggcaccgaaccgctcgtacgcgtgatggcggaagcgagaacaaaagagctttgtgacgaatatgtcacaaaaatcgtggatgtcgtgcggacagaaatgggagcggagtagcgaagtttataagcagagagcgaacaagacaagtgcgatcagcataaaatgatagtaaacatgatgccggggcggcaaaaaataattgaccgtccttggcacatgctgtaaaatcaagcttgttcagcctttgtttttcacttgcaggaaaggcgggattgtttgcatcttttataattacagcgcccgaactaagcgcccgaaaaacggcttagttgacgaggatggaggttatcgaattttcggcggatgcctcccggctgattcatttagatcacagccgtaaggatttcttcaaaccggaggggcgactctccgaacaaagggaaatcacatgatcttccaaaaaaacatgtgggaggggacgattgaaagtccccttgtaatttgactttcttcgtctccttttacacctttaggaggaagaaaatatgtgtggaattgtaggttacatcggtcagcttgatgcgaaagagattttgttaaaaggattagagaagcttgagtaccgcggctatgactctgccggtatcgctgtggcgaatgagcagggcgtgcatgtgtacaaagaaaaaggccgcatcgccgaccttcgtgaagtggtggaccacacggttgaatctcaagcgggaatcggccatacacgctgggcgactcacggcgaaccaagcttcctgaacgctcacccgcatcaaagcgcactcggccgctttacacttgttcataacggtgtgatcgagaactatgttcagctgaagcgcgagtatcttgaaaacgttgaactgaaaagcgacacggacactgaagtagtcgttcaaatgatcgagcaatttgtggcgggaggactcagcacagaagaagcgttccgcaaaacactgactctgttaaaaggctcttacgcaattgcattatttgacggtgaaaacacagacaccatttacgttgcaaaaaacaaaagccctctgttaatcggccttggagatacgtttaacgtcgtggcatctgacgcgatggctatgcttcaagtaacgaatgaatacgttgagcttttggacaaagaaatggtgatcgtgacaaaagacgaagccgtgattaaaaatcttgacggtgaagtcatgacacgtgcgtcttatatcgctgagcttgacgccagtgatatcgaaaaaggcacataccctcactacatgttaaaagaaacggatgagcagccgcttgttatgcgcaaaatcatccaaacgtatcaggacgaaaacggcagactggccgtggcgggcgatgtcgctgacgccgtggcggaagcggaccgcatttatatcgtggcttgcggaacgagctatcacgccggtcttgtcgggaaacaatatattgaaatgtgggcaaacgtaccggttgaagtgcatgtagcgagtgaattctcttacaacatgccgcttctgtctaagaagccgctctttatcttcctttctcaaagcggagaaacagcggacagccgcgccgtgcttgttcaagtcaaagcgctgggtcacaaagcgctgacgattacaaacgttccgggatcaacgctttcccgtgaagcggattacacattgcttctgcacgcaggtcctgagatcgcggttgcatcaacaaaagcgtatacggctcagattgccgtcctcgcgatcgttgcgtccgttgcagcagaacgcaacggcgttgatatcggttttgatttggtcaaagaattaggtattgcggcaaacgccatggaagccctctgcgaccagaaggacgaaatggaaatgatcgcgcgtgagtacctgactgtttcaagaaacgctttcttcatcggccgcggccttgactacttcgtgtgtgtcgaaggcgccctgaagctgaaagagatttcttacatccaggcggaaggcttcgccggcggcgagctgaagcatggaacaatcgctctgattgaagaaggaacaccggtctttgcgcttgcgacacaagaacacgtcaacctgagcatccgcggaaacgtgaaggaagtcgcggcccgcggcgccaacacttgcatcatctcgctgaaaggcttagaagacgcagacgacagattcatcctgccggaagtcaaccctgcgcttgctccgctggtttctgttgtgccattgcagctgatcgcttactatgcggcactgcaccgcggctgtgacgttgataaaccgcgcaaccttgcgaagagcgtgactgtggaataatatatttaacccctttggttattagccagaggggttttttaatgcggaaatgagaaatgcatactctttgcgattgtaaagaaatccccttttatatattgaaaaggagtaacacctgctttataatacgagatgcattccggttaaaatccataaatgtaatcattagtaaatcattttgtgtatacctcatcggaaagtaaacacctcagcagttttcatcatgaatatcccattatataaacctaatcaatcgattacacttccatattatgcttaagactttaaaatcccttttgtatttcccgactcctgatccattatgaatacctagaccagatatgaaaatcacaacatttttacaataatccggttcaattcttaaaaaagtcctgacaacaatgataggagtggaatgatgtcaaaccttttagaaatcagaaacatcagcaaatcttttggtcataaagctgttttaaaggatgttacattcaatgtgcctgccggatcaattgtcggttttatcggtgataacggcgcaggcaagtcaacaacatttaaaacgatattaggattaatctctcaggatagaggtaaagtgaaaatctttggtaaagagaatctggataaacatataaagtttaaagaagatattggggtcgtatttgatgcgatgaatcttcccgcgcaccttacgataaagcagctgaatcatgtatttaagaaactgttcgacgcttgggaccaagatcaattttaccggttggttcattctttctctttacctatggataaaaaagtgaatacattctcgcgcggcatgtcaatgaagttatctgtagctgttgctttgtcgcataatgcaaaattattacttctggatgaagcaacgggagggcttgatccctcttcaagagatgatctgttaaatgaattaaaaagctttgtgagtaaaagcaacggaggtattttactttcatcgcacattatgactgatgtcgagaagatagccagccatatcattatgatgaaagatggcgaaattttattaaatgaagagaaagataaggttcttgaaagctataccgttatagacgttgatgaaggtcaattggctgagattgacgaagatatcgttctagcaaaaaggaatcatggatcttattggagtgtgcttgtatcggatcaacagaaattgccgaatggcgtaacggccaacaccatttccatagaagaaatcagcgtctttttaacgaggagtgaaaacattgagaggtctgttactgactaactattacttggtttatcggagtttctttgcatacacggggttggccatattggtatcagcagtcattttttattttggggatgcttcaatgcatcgttttgttgctatgctgattattttgtttgtcgttatgcccgcacttgaggttataaagtatgagagcaagtcaggctatgacaggtatgttctgactttaccggtcagcagaacaaatattgttcaaagtcactatttcttttatcttttgattgttgtgatcggagctgtaatatcttatggtattttccttgtatacagcctgggttctgatgaaccaattgacggtatatttaatattgtctcttttggaacgttcatcgttctctttgccggtgcaatcgtttatcctcttctctacatgataggcccggaaaaatccgatgctatcgtgattggaggggcaatggggggactttttgctacctttggattgcaaagtgtcgttgggtatgcagcagaacaagtaccgctgtcatttttgcacataaatccttctttatatgtcccgattatatatctcatgatcggcgttatcttatatatcatttcatttttcatcgccgcagctatatatcataaaaaagaattttagcagctgatcaatttataataggataagtgtgtttccagcctttactgcaaagtttcacagtcttggctatcccagagtaaaaggtgaaaaagctgacaaatgatgccgtcagcttttctttatgtgtttttttaaaactcctcatactccgccgggtcttggccgtttatccgtccgtcggggcgggtaagcgagtcgatgatgctcatgtcgttttcatcaagggagaaatcaaaaacagagatgttttcaagctggcgctcgggcgatgctgattttggaatcgggatggcgcccagctggatatgccagcgcaaaatgacttgagaaatggttttgccgtatttgtccgcaatctgtccgagtttttgatcgttcaatacttcgccggcgcgggataacggactccatgattctgtcacgatgccctgttcttcgtgccattggcgctgctgctgctgattaaaagcgggatgcagttcaatttggttgatgcctggctttacaccggtttcacgttcgagccgttcgatgtgctcaggcaggaaattgcagacgccgatggatcggatcaggccccattttttcgcatcaatcagtgcctgccatgcttccgtgtagcggtcttgtttcggattcggccaatggacgagatacaggtcatagtagtccagaccggcgcggtataaagattcttggatggtttgtacagctttgtcatagtcatggtagcgcccgggcagcttggacgtcacgtatagctgttctctcggaacagagcttctgcggatggcttctccgaccgtcccttcattttcatagttataagcggtgtcaatcagacggtagccgatatcaatggcgctggtaatggcatgaacgccattgtttccattaagagcgtatgtaccgaagccgatcgcgggaatgcttgtcccatcaagcagtttcttttgcggaattgccccagtcatcattaaatccctccttgttttctactttaccattattcttacaaatgaaacataataatggaaggaaatgagatgatccgcacatgaaaaaagctgacggagaaccgccggctttaaatttgaaacatccatgctacgacggggccgaagaccgaccctaacacggcgcagagcgtcatggaaacagaactcatggagaccgttaattctccgtactccattgcttttgaggtgccgagcgcatgggaggcgctcccgaatgcaattcctttcccgagtgagctgcggatgcggatccacttgagaagcagcggtcctaagataacgccggaaaaccctgcgatcatgacgaacacgactgtcatggaagggacaccgccgataccggacgcaatctgtatggcgacaggcgtcgtaattgattttgggataattgacaaaatcaaactccggctgatgccgaacagctctgcaaatagcaggccgctgaccattccggagaataaaccggccaacacgccgccgatgatcggaaacatatacttgattaacacccggcgctgcttataaagcgggtatgccaaagccaccacagcggggccgagcagtgaattgatccattgtccgccgatcatatagtctttatacggaatatgaaaaacaagcagcacggcgataatgaaaatcgtagtcgtcaaaaccggtatgagaaaggggtatggaaagcgcacatataatttcaccatagccagataggcggcggccgtgaacaaaattataaggattgcgatacatgcttgctgcacttctttttctcctttctctgattggctttatgctctaacagctggctggcgtaccctgcggcgatcattgtgacgatggtgctcagcacgatgatcagaaacagagcagccccgctggcggaaaacagtgacgggtaattgatgacgcccgtcatggccggaatgaataacagcggaagaaaagacagcaaaaatccggctccgtcttcaatcattttgacgggaatgatcttaaccgataaacatatgatcagcaggatcaaaccgatgatgcttccgggaatgggcaggtgaaagaactgctgaacggctcccccgataaaggaaaatgcgaataaaataatgatttgcaagatgatgcgtatgactttcacaacgatgctgttctttggagaagagcagcttccccctttcttgatgtttctataagtttctttacttttggcacatatatttgtactatacaaatatatgtatgcaaaatctttctatatgttttctgagtaaatgtgcatatgtttgtattatacaactaatgttgctgttgtcaatgtaaggagtgaggcgtttgtcaaaacaagatccgattgaattaattgaatatgaactcaccactttcatcaggagagctgtttatcttgataactccgaccgtaaaatcggacatctggaaagggctgcgtatttgttattacggcagctggatgaattcgggccggcgcgtgtgaaggaattggccgaatcatttaagctggatatttccacattatcacgccaggcagcggccttggagtcgaaagagctgatccagcgtttttccgatccttctgacgggcgggtcagtctgtttgcgattacgaagcttggcaaacagaggttaaaagctgataaaaagatgcgtcttgagcggtatcatcgtatgcttgacgattggtccggcgatgaaaaagaaatgttcggccggcttttgctgcggctgaatgaggcatttatcgattaatgcatgatttttgccgggttaagcaggattatggcgtatacaagggagaatggaagagagtaaggctttacgccattctgcttagcaaaaataatattggatagggggcggaaaacgtttctcctgggaaataatgtttctcggaggctgcggcatttattatctcaatattcacaattcaataaaaatgaaagcgctttatttttagtccgttggttcagagtgtaaggtgtttgcctgaaaaaaacaattgtattttccacgaaaatttattatgatggaataaggaaattggagattatataacgataggaagatagaatatttccaatattgcgggaaatgaagagtgagttaggttcaacaggtgcaccttctgcttcattatttcacatatatcagagctgttaagaggaggaagcgaagtggcaaacaaagaattaaagagaggcttaggcgctcgtcatatacagatgattgcgctgggcggcacgatcggtgtcggtttattcatggggtcatccagcacgatcggatggaccgggccgtctgtcctgctggcttatgcgatctcgggtatctttatcttttttatcatgcgtgcgatgggcgaaatgctctatgtagagccgagtacagggtcgtttgcgacattcggccataagtatatacatccgttagccggctatatgacggcgtggagcaactggtttcaatgggtgatcgtcgggatgtctgaaattatcgccgtcggttcgtatatgaaatattggtttcctgatctgccggcatggattcccggcattatcgccatggccattctcggtgcggcgaatttaatttcagtaaaatctttcggtgagtttgaattttggtttgccatgatcaaaatcgtcaccattattctgatgattgtggccggaatcggaattattttcttcggtttcggtaacggagggcatgcgatcggattatctaatttatggtcgcacggcggtttctttacaaatggtttttcaggatttttctttgctttgtctttggttgttgcggcctatcaaggggtcgagctgatcggaattacggcaggggaagcgaaggacccgcaaaaaacgctgcgaagcgcgattcagagtattatctggcggattttaattttctacatcggtgcgattttcgtaatcgttaccgtatatccgtggaatgagcttcactcactcggcagtccgtttgtttcgacatttgcgaaagtcgggattacggcggcggccggtctgattaactttgtggtgattaccgctgcgatgtccggatgcaacagcgggatattcagtgcgggacgtatgctttatacgttaggcgtgaacggacaggcaccgaaattctttaagaaagtttcttcgagcggtgtgccgatattcggtacgcttgcggtattaatcggacttgtgatcggtgtcgtgctgaactacatcgcgcctccgaaaatctttgtttatgtgtacagcgcgagtgtgctgccgggaatgattccgtggttcgtcattttgatcagccatctcggtttcagaagagcgaaaggcgctgagcttgataagcatccgtttaaaatgccttttgcgccgtttacaaactatttgacgatcgctttcttactcatggtattgatcggcatgtggtttaacaaagatacgcggatttctttggttgtcggggtgattttcctggcgattgtgacggtcagctattatgcgttcggtatcggcaagcgcatgcctggtgaaaaatcgaaaatagaagacgctgtataattcaaaaagacacctctcttacaggggtgtctttttcggcttgtccgcgagtggtatactggttaaaaaaagcagaaccgggggaaacatcgatgagtcattaccgtacgttattatttgatatagacaatacgctgctggattttaccgcttcagaaaccgatgctcttcaaaaattgttccaaggttcaaagctggagctgacggcagaggtggaagcccgttataaagcgttaaatcaagggctgtggaaggcgtttgaagagggggaaatgacccgcgatgaagtggtgaatacacggtttgcccttttgtttaaagaatacggccttgaagccgacggcgtgctgatgaatcaggcgtaccgccaatacttagaagaagggcaccagatgatagacggagcttatgagctgattgaacggctgagtcctttatttgatttatacatcgtgacgaacggcgtctcaagatcacaatataagcggctgggcgactccggtctgtatccgttttttaaagatgtgtttgtatctgaggacacgggttttcaaaagccgatgaaggaatactttgattatgtatttgcgagaattcccggtttttctgccgggcacgggcttattatcggcgattcattgagcgcggacataaaaggcggtcagatggcgggaatggatacgtgctggtttaatcccggaaagaaagcaaatgagtccgggattatcccgacgtatgaaattcattcgcttgatgagctgtatgatgtgctgaacgtggaggttgtcgctttatgatttctcaatatatgtataatataatttatatcaagttgtctcgggaaggattattatgaaaaatctttcttcaattagtacaagagtgctcatagagaaaaccattatttgtttttccttatattctattatcagttctatttttaaaacgccaacttttacggcttcggaatccgcttacctgctgattatcaccatttttttagtcgtcaacgatcatatcagattaaaatacctaagcggtcagtattcttttagatattatgcatcttttttagtaagtaaccttttatcaggcattttattgtttaaaattaactgtctcggttctcaaatatataatatttttttactgatcgagattattgtaacaactcgtaaactgccctggactgtagtaagtctgcattttattattttttttacagctcttaaagcagcagggaccagcgggaaagatatattgatgtcctatttagtgatcatggctattatttatctgtttagaaacgtactgctcgaaaaagcaaaaatacaaacattaaataaagaattacaaagtgtaaacactaaacttaagaattattctcaaaaaattcaagagttaactatttctaaagagcggacaagaattgcacaagagcttcatgattccctggggcattatttgatcgcattaacaatgaatcttgaattcgccgataaaatagtaagtaaaaatcccggcgaggctaaacaagtcatcaataagtcacatgatttatcgaaggagtgtattattaacctgagagaagctgtcgctttgctcaatgaccctgctcctcaaaaagggcttctgaaatcgatcaatgagatttttgaaaattttcagcaaacaaatgaaataaaattcgagcttgatatggacaataaagtagagtcagctgatccagatatcaagaattgtctctataaaacagtacaagagtctataaccaacgggataaaacatggaaatgctacgtttttttcaataaaaatacgtaagtcttttgaaaaaatctctatatcgataactgataacggaacaggatgttctgaaattaataagtcaaatggaataaacggaatagaaaaaagatttgccgcacttggaggagaggttgatttttattcagggctagattcaggatttactgtggaagccgtaatccccgagatagcagatctttaatcggaatgtgaggaggtattgatatggatattatcattgtggatgatcagcaaattgtcagggaagggcttaaaatgattctgagtctgcacgaggaaattaatattgtaggcgaagcttctaatggtgaacatttattagatttgctaaaacagataaggcctgaaatcattttaatggatataagaatgcccgtaatggacggcattgaagcaacaaagctagttaaagagagatatccggatattaaagtgattatcctgacaacctttaacgatagtgaatacatttttactggactgaaaagcggtgctgatggttacatactgaaagattctgattcacaagaaattattgattccatcaaaacagcatgtgaaggcaatattctgttaaatcctaaggtaacgctaaaagttgtaaaggctctaaattcggtagaacataataaagagcttgttcaagaaaataatgaaaaggaacagctggtgcaattgcttactcccagagaaaaagaagtcgctaaacagattatggaagggaaaagcaacaaagctataagcgaagcactgtttattactgaaggcacagtcaaaaattatgtatcaagaatactggaaaaacttcaaatgaacaaccgaacggagcttagcttatatttacaaaagcatatgtgattcaacttttttccttcaatcagaaaggaatttcatcaaattcctttcctccattttcttctgaatatatccggacttacaccttccgtatatgactaaagtaacgatgcgattcgtaactaaagtaataaggtaaatgagtactatagtaaattctaaaaatattccattcaggttaaaataaaagaaccgaaataccacgaggggtgttttaattatgcttgaattaaaaaaacttaccaaaaaatatgatgactttacggcagttaataatatttcgctgactgtagaagatggagaagtattcggactattgggtcctaacggtgccggcaaatcaacaatggtttctatgattagcactgttcttgcacctaccagcgggacaattaaagtagataataaatcacttaaggaaaaacctattgagataaaaaaaataatgggggttgttccacaggatttagctttatatgaaacgttaagcgccaaagataacttgaacttcttcggaagcctttacgggctgaaagggaaaaagctaaaagaaagaactgatgaggttctggagattattgaactgacagataaaaaaaatcaaaatgtatcagagttttccgggggaatgaaacgccgggtcaacataggcgtggcgttaatgaataatcctaaattattaattcttgatgagcctactgtaggaattgatccgcaatcaagaaatcatattcttgaaacagtaaaaaggctgaataaagaaaaaggaatgactgttatttataccagccactatatggaagaagtagagtatctttgcgagaaggtggcaattgttgatcatggatctcttattgctttaggaacgaaagaagaactcaaggaaaacttaaatgcttgtgacactttaactgttacttttaagggtgctgatgaagaggcactcagccggataaacagcattacaggaattgataaagtgacggtagatcataaacaaatttcaatgcttgtatcgacgaaggaaagaaacatcattgaaattgtagatgatatcaaaaatctggggatcgacctcactagctttaagtacgaggaagtaaatttggaaagcattttccttcaaattacagggaaaaacctaagagattagtaggaggaggctatcttgagaaaattattcaacttattttttcttgattttaagctgttaacaaaaaataagtcattttatttaaagctgatgctgtttccatcactgctaatcctcatattgggcagtgtgttcagtaattcagattcaaaaatcgaagcatttgatgtagctttttactcagcagattcaggagagagtgtttctttaggtgatgtcttaaaggataaagtttttaagaaaggagatctcaaagatatcattcatttaaaagaagctgagagctacaatgacggtgaaaaattagttaaagaaggaaaggctgcagcttttatctatgtaccggaacactttacgaaagccgttatgaacaacgggaaaacaaatatcgatttaattggagataataataagaccatagataaaaatattgttcaggctgttttggagggctttacgaaaagcgtgaaaacaatgagtgctgagcaacaagaagtaataaaacatatcagccccggcggcagcgtaccaaaagaaaaaatagaaaaaatgatgaacgatttggccgataatgacgggatctccgctgatatcccaaaagcagcgacaaataaaaatgcggttcctgtcgattccatgcagtattattcaattgcaatggttgttatgttttccattatgacggcttttgtgcttgttcatagcattgttgatgagcggcagaataatacgctgttcagaattaaatctacaccgactttaaatattcagtatgtgcttggaaagttgacaggtattatttttgcgatcttaatgcagatgactgctgttattctgataagctgggtcgtattccgaatgaactggggcaacttgtttgatatttttgttattacggtagtatacgcatttgctataggcagcattgtattgttttggggttttaccgctaaggaccacgtggcggtgtccagtatggcttctccggttctttatatttttagttttttgggaggcagttttattcctaagaacggactgcctgatagcttgagggttgtccaagagatcataccgaacggtaaggcaataaactcttatttaaaagtcaaacagaatattggccttagcggcatgtatattgatttgcttgagctaattggtattggtctcatctttgtctttattaatattatggtattcaacaggaagaaggtggcgtagtagtgcaattgattgccatgattaaacatcagctgaagctgatgctccgaaatagattagcaatttttgcaactatttcagtgccgttaatccttacatttttgttctctttttcccaagatacggatagcaaagagaacttgtatatagccaatgctgataaaagcaactatgctgcaaagctcattgaaatgataaaagagcataaaaatattaaagttataaagctaacggaaaatgaaataaagaaaaaagtcgatgatcaggatattccttttggggtcgttattgaaaaaggttttggaaaggaattggcggacaatcacaagataaaaatgaaaatcatccaaaactatgagaacggcagcggaacattgttagagcagctggtcaaaaatgaggcgggaactcttaaaaaggtagttaaagattcgcaatatatgtctgcgcagttgcatacggactcaaaagatatagaaaagaacattttcaagaaattgaaaaacaattcaggaatagaagtgaatgacaaaacattaagccagggtaaacatactcaggataatgcgaccgtgagattaattggttttcttgtaatgtttatttggtttgttgttattcaagggttaagaacacttattgatgaaaaagagaataatactttcagccgattactaagtacgcctataaactatacaaaatatgttttatccaaaatggctgctacttatatttccggaatcattcatataatcgttataatacttgcgggaaaatacttactcaagatcagcataggtcataacatctttgccatcgctgttatgctcgctgtttatttatttgcattgacctgcattacgatgattatggttccatttatgagaagccaaaagcagtttacttctgccgcatcgatcataattgcagtaagcgggatgataggcggttcctttttctcattggaaattgctccaaaatatatgcaggttatttctaaatttacacccgaagcatgggcaatacagtctttaaacaacattatctttagtaagagtaccttaggaactgaatggcttccgatcgtaatttttgcaagtgtcggcttattaagtattattgtatctttcatcttgataagcagggagattaaaaaagaaaattaaatcaacaataatcggataaaattaacagatcaaaaaggacgtgaggaaattgggtatggaagaactatttggaatggctgaattaattataggtgtactcatgaatgtatttatcggtaaaatcgggcaagttgcttttggaaaagataacagaacaacaaggatcattttaagagtaataggaatcttcctcatcatcaacggagtttcaagagcatttcatatataaaatgagatagtaaaaacatccttttcagggtgtttttttatcgggttattacaaaatttctgaggtgaattatgaaaaaaatattttgtcttccgtatgcagggggatcaagtgcaatatactataaatggagaaggttaatgagtgactctttaacaatacatcctattgagttaaaaggaagaggtacaagaattaacgaagatttttatgaacatatagatgaggctgttaatgatatatatgatctgataaaggatcaaatcagggagtgtgattatgctttattcggccacagtatgggaggccgattagtttataagttatattgtaaaattgctgaaatgcagcagaagaagcccaatcacatatttttttccggatgcggcattcctaaaacgaaaaaagcagaggggatgattcatgctttgccggataatttatttttgcaaagaatcatggatatgggcgggacttcggaagaactgttacataacaaggaattacaacaattatatcttcctattttaagaagtgatttcaaaatgttagaaaaggatgttatttctgaaaataagactgttatggactgtgatataacagtgttgcatggtattaatgacaagacgataagctcagatttaatatgtaattggggacattatactttagggaaatgcaatttttatacgtttgaaggaaatcacttttttattcatcaattttcgaatgaaataactgacattataaataaaaccttgagataaattgttgattgaaaaatcgggagtgttactttgtcccggtttttttatgttaatacgaaaaataaaaactgggttaatgtgcttaggtgtttttccctgctaattgacaactcttaaatatttgtataatatttcttaaagatggctagttcttcttcattatcctttttttaaaaaaagtgtttatacgggtctatatcattaaaaaatggtttttgctgccgataaataaactgtcagactacaacaacaattattggtgagcgttattgcctgtgatgcagtttaacataaaaatccaccgaaagcctctgctgttttaattcagtgaatgaattgaattttgatatcaagtgaaggagtttttgttatgacaaaaagtataaagggagataaaaacagtattggtgagttaaaaactgaagagcattttttagtgggaagtaaatcttctaaagaaaaaagaatgaaaaatcttacatataaattgtcacagcaattaagcgataagctgaatgtatgctgcaatggatcggatgaacgtctgcatgtcgtattaacagcggcactgactttgttaataaatcaatatacagaaagacaaaatattgtaatcaagactcctgttttcagaaagaacagaacgattgattctgagcaagaaattttgactcttaaaaatgctgttcatggtgaagacctattaaaagagatcatacataaagtcgaattcaccgtagaacaggcattggaaagcccccaaaataattctcgaacaagtgataaaatgactggccttccttttgatgtcatgatagtccttgaaaatattcaagaatacatacttaatcaagaaaatcccgctattcatatcctattttcgtttataaaccagaaacaatacatagagacagccatacactataacgaatgcctctattctcaaaatatgataaaagatttgtcactgcgatttcagatgatccttgaagctatgataactcctgaaaatatcagagtgaaagatatgagattcctgaaagaaaaaaataagcaaaagaaaatctttggctgggaagataattattcgaaaattggaacaatttcggaggtgtttgagcagcaggctgatgaatattcggataagactgctttggtactagaaaactcttcaatgtgttacgcagaacttaatcaccgtgcgaaccagctggcacggtatcttcaggagtgcggagtaaaacggggagaccttgtcggaattgctttagaacgctcttttgatttgtatattagtattctggcaatattaaagtcaggcggtgcttatgtgccgttagaccctcaatatccgaagcaaagactatcattcttaatcgaagattcaggtgtagagttgctgattacaaacgaaagcattcagtcacaactcccgcctcacggggacggcgtaatctgtttggatggtatgaaagaagaaattgaaaagatggatggatctaatattggcataaaaggttccttggatgacctggcttatgtcatgtatacgtcaggctcaacgggactgcctaaaggagtaagtattgttaaccgcggtgtgattcggctggtgaaggagactgattatgcggtatttgatgagaatcaaacgtttctgcaattagcttctgccgcttttgacgcttctaccttcgagatctggggctgtttattgaatgggggatgtctggctataatgcctccgggaataccgacggctgatgatattgcagaagctgtaaaaaaatataacattacgactctttggctgacggccggtttattttctctagtagttgatcagcagttagaatcattaaaagggcttcagcaattattggtaggcggagatgtggtttccgttccgcatgttcaaaaagtattagcacttggaaaggtacaagtaattaacggatatgggccgacagagggaacgacctttacctgttgtttcccggtccctcatgattggaaaggcagtacgcttcctatagggaggcctatttctggtacagaaatattcattttagattcgcaattaaaaccggtagcgcctggtattcctggtgagctgtttattggcggagatgggctggcgcgagagtattggcgacggcctgatttaacgaaggaacggtttatatcacaccctttcaataatgatccttcagcacgtctttataaaacaggagacttagtgcgttatttagaaaatggcgatgtggagtttatcggacggcgggacgagcaagtcaaaatccgcggttttagaatcgagcttggggagatagaagcccgattgatcaatcatacagaaattaaagaagcggcagtaacagtaaatcataatggtgatgatgatttatatatctgtgcttattacacttcaaatcataaaatcgcaaagattgaattgcagcactttctgagagactttcttccggaatatatggttccatcgtactttaaacaaatggataacatgcctttgacggtaaatgggaaaattgacagacgggcacttcctcgacctgatatatctcaaatgtccgaaacaaaatatgaagcgccgacaaatgaaacggagaaaaaactttcggagatttgggaagctgtacttggcagggaacgcgtcggtatagatgaaaatttctttgaaatcggcggtcattcattaaaggcttctatgttaatttcccgcatcagaaaaacattcggcacggatataaaggtgaaggagctttttgagcagcctaccatcaaacagttgagccgtcttattcaaaagcgggataaacagaattatccggtcatcagtaaagcgagaaagcagtcttcttatcaagcgtcatctgctcagaaaagaatgtttgccctttgggagacggataaagacagtatcgtttataacttgccgattatgattgaactaaacggaaaattagatgtaaaaaaagccgaatcagttctacaagagattattggcagacacgaagctttacggacaagtttcgatgttgtaaacggcgatgtggttcagattattcacgatacatgggagctcgaatttgattatcagaagctgccgtctgatgggatacgaccatatgtgaagcagtttatcagaccctttcatttggacaaagcaccgttaatcagagccggactcataacgtatgaagaccggaatctgctgctgttagatgttcatcatatcgctgcggacggtgtatcggttggaataatccgcaaagaattcaatgcgctgtatgcggatcataaactaaaacagccgccgctgcaatataaagattattcagaatggcaagtaagctcaggaacaaaagaggcgttaaaggaacaagaggagtattggcttaagcggttaagcggagatctgccgattctcaatctgcagactgattacgagcggccgagagtcaaaagctttgaaggaagccgagtcagctttacggccgatgaaaggttaacatcaagcttaaagtcggtggcgaaagaaacaggaacaactttgtacatggtgctgctggcggtatataatatcatgctttcaaaatacagcggtcagcaggatgtgatcatcggaacggcagagtccggaaggtcagacaccgaactggagaatacggtggggatgttcgtcaataccgtcgccataagaaattttcctgaggaacataaaacattcagagcgtttttagaagaggtcaaacatcatacgttaaaagattttgagaatacagattaccaatttgaaaatattgttcaaaaactcggggtaaaaagagattcgagccggaacccgctgtttgatgtcatgtttacttttgagagtaaggattacggattcggaggaaatgaagagacagcagaatcaaatttactggtatctgaggtcaatatatcaagatttgatttaacgttaactgcaatggaaaccgatgaaggcgttaacttccaattggaatattgcaatcatttattcaggaaagacacagtcgaaagaatgggtgctcattatacccggcttttacaacaggttgtatcagaaccggacacggcaatctgcagactgaatatgataacggatgatgagaaacataaactgctttatgtattcaatgatacagcagccgacttcccgcataataagacaatccatcaattgtttgaagaacaagcggaaaagacaccggaaagaatagcggcagtgtatgaaaataataaagtaacttataaagaacttaacgaaagatcaaatagtctggcgagaatactaatgaaaatgggggtgaaaaaagagtcaatagtaggtattgttgctgacaaatcattagagatggtgttaggcatattgggtgtgctgaaggcgggaggcgcatttttgccaattgatccgggatatccttctgagagaatcaaatacatgattgaagacagcggttctgacattttattagtgcagaatagtcaggctgacaatattccgtttgacgggaaggttattgatttaacagatagttctctttacaccggagatcggcataacctgccaatgatgagttccgcagaacatcttgcttatgtcatttatacttctggaacgactggaaaaccaaagggtgtaacgatccggcatatcggaatcagtaatctcaaaagtgtctttgaacatgatatgaatatcaattaccgggataaaattattcaatttgcaagtttttcatttgatgcatcagtgtgggaaatcagtatggcactgttgaccggagcggaactacacatcctttcaagtcaagtcatcaataattatacattatttgaagagtatattaaccggcatgacattactgtagccactttgccgcctgtatacatcaaccatataaatataaacggattatcagctttaaggctcttaattactgctggttctcagatatctacaaaatccttgaaccggatcgtgaataaaatagactatattaatgcctacggtccaactgaaacgacaatctgctctacaatgtggagatactcagaagctgagagggcgatggcaaagaccattcctatcggtaagccgatcagaaatctgaaagccttcataattgatcacaacaacaatcttgtgcctattggtttagcgggagaattgtgtgtgtcgggtgacagcttagcaagaggatatctcaataaagagaaaatgacgcgtgagaagtttattgatcatccatttgagtccggaactaaaatgtaccgaacaggagacttggcaaggtggcttcctgacggaaacatagaatttttggggagaattgataatcaagtcaaaatcagaggcttccggattgaaactgatgaaatagaaagccagcttctgaaaataagcgggataaaagaagcagttgttatagataagtgcgaccttcacggtgacaaatacctttctgcatttgtaaccgcagaatataaaatatccggagcagctttgagggagcaattgggtgacattttgccgcaatatatgattcccggtgtcatcatccaggttgaacagctgcctctcacaccaaatgggaaaattgacaggaaagcacttgcagaaatagaagagcctaaacatataaaggagcaccttgaagcaccccgttccgaagtcgaacagattctggtaaatgtttggtcggaagttctgaaaattgatgatattggtattaatgataattactatgagctgggcggagactcaataaaatctatactgattgtatcaaagcttcaaaaatacagtctcagtctagaggtaaaagatcttttgcagtatccgcaaataaaaaacctcagtaaacacgtgaaattatataaagctcaaacagatcagagcccggttagcgggagaactgaactggcaccgatacaaaagtggtttatagagaatgactttgcggacattcaccactttaatcaggcattcatgtttcaagtgaaagaaaaaattaatgaacacgctctggcaaagacatttgaattattagtaaagcatcatgatgctttgaggttgatatatacagccgaaaatgacgaaataaaacaagaagtcagagatgtccaagccgcccgggatacttttactctggacatatatgatctgcttgctgatacggattacaaaaatacaatagaaaaacttgccgatcagttacaaagcggaatggatcttgaaaaaggacttttaatgaaacttggtttatttcgaacaatgaggggcgattatctacttattgctatacatcatatggtgattgacggagtctcttggagaattctgcttgaagatatggagcaggtctacaacaatctgcaaaaaggagagccggccgttcttccgccaaaaacggcatcctttcaagaatggacacgtaaattggcggaatatgcaaacggaagtgagataagaaaggaacttcggtattgggagaatatcgagaaaacgaagattaaagaaattccgagagatttcaataaaactgacagtgtatttaaggaaagccgcaccattactgtcagtcttacaaagcagttaactgataagctccagaggaatacaaatgcagcttataacacacagattaatgacatcttgctttgttcactgggaatggcagtaaaagaatgggcgggacttgacaaggttttaatcggtctggaaggccacggaagagagaacatattagaaaatatttcaatagaaagaaccatcggctggttcacctcactatttccgatcgtgctggatatggagcacagtgatgatctgccttattgcataaaaaatacgaaagagtatttaagaagaatacctcataaaggtattggttacggaattattaaatacttgacggcaccggcacataaaaaagacatcagttttacgataaagcctgagatcgggtttaactatctgggagaaatctctcaaaaaaagcgggctgtttttcagcatgcagatatatcatctggtacaagtgtttctttatctaataaaaaattgaatgccatcgaaatcaacagctttattatggacggtcaactgcagttggaatttaactatagtacgaaagagtttaaagaagaaacaattaaaacattaaccgaatcctatataaaccggttaatcgatattattcagcattgcggaatgaaaaaaattcctgaaaaaacaccctttgactatggagatctggatttatccatcggagatttggagcagattttatcaagcggaaaagagatagagaaaatccactccctgactcctatgcagagcgggatgctttatcatgcattgcttgatccgttttcacaagcctattttgagcagcttacattttctttatccggtcagcttgatattggcagattaaatacagcttttaatatgctgatcgagaagtatgaaattttaagaacatgcttttttcatgaaggattaagtaagtttaaacaggctgttctaagagagagaaaagttaaaattgaatttgaagatatcagcactttctcggaatatcaaaagaaagtccggcttaaaaatgtccagtttaaagacaggggaacgagattcgatttgacgaatgattgcttaataagagtaaccgtattaaaaactgatgagaaagaatataaactgctgttcagttttcaccatattattatggatggctggtgtatgagtttaataatgaatgatataaaaactatttatacgtcattaaaagaaggaagagagacagtgcttcagcataccgagccttacagcacctacttagaatggctggataatcaggacaaaagtgccgcattagaatattgggggattatctaaatgaatatgagcagcaagccggtattccaaagttctgctgatgagggcggtttcaataataggaagaaaacattcattattgatgaaacatgtacttcgatgttgaaagctgcagctgatcaatatcacattactttaagtgcattgattcagactgcatggggagttcttttgcagaagtataacaacgtggatgatgttgtttttggtgcggttatttccggaagacaatgcagagtgcaaggcatagaaaaaatggtggggttatttatcaatgcggttcctctgagagtaaaaggcgatggtgatacggtatttatagcattagcccaaaagctgaacagtgactttatcaaagcgaatacatcatacggttacagttctttagcggatatacaagctcttacaaagatgaaagagaaactgatcaaccatatgttggtttatgaaaattatcctgttgatgactatggcaaggcggtcgataatacaactgatgctttaaggattacagatatggaagtgtttgaacagacgaactatgactttgggctggttattattccaggcagccaaatcaaagcagagatgacgtataacaataatgtttatcgtgaagatatcattaatcgtataggtgttaatttctgtcatgtgttaaagcaagtggcaactgatcctacgcgtgtcctgaaagacatcagcgctgtaaatgaagaagagcgcggaatgctccaggattttaataagcagtcctctaattatacggtgaataaaacgatacaagacctttttgaagaacgagcggaaaagacacctggccaaacagcggctgtctatgcaggaaagcatatcacttataaagagctaaacgaaaaggcaaatcaagttgcaacattattaatggaaaaagggcaggaaaaaacagcattacggctatgatgatccgtccttcagaatattcaatgattgggatgctgggaattttaaaaaccggaagtgcgtttctgcctattgatgatgaatcaccggtcagtcggataaatcatattttaaaagatagcaaagctgatatcctcattacagatttgtgctttttagctgataaaaacattgcggcggaatgtttggatattacggataaatcgatttataccagccaaaatacatcaaaccctgatgttcagtatgatctcgaggacgaggtatatgttatatatacctcgggtacttcgggaaaaccgaagggggtgaaggtgaaaaataaatcattagttaattattcattatgggtatgtgatcaaataaacataaattctgacagcaggtcgttagtgacgtcaaaatatagttttgacttatgctataccagtatatttccagttttatccggtggcggacaagtccactttgttgataaagaagtgtatcttcactctctatcattaatagaatatattcataaaaatagtattacatatcttaaaatgacacccactttattttcaacattgatggaggatgttgacatgctggcgtcttgtcctgatttaaaagttattatactgggcggcgaaagcataaacatcggcaacgtcaaaaagctcgctgaaaaatgcagatggatgaagtttattaaccattacgggccgaccgaaagcactgttggctgtattgcacatagcattgatctagatcatattcaaaactgtgaaatatacaatagaataggaagaccaattcacggtattaatatctatattgtggatcgttcagatcaactggtccctgtgggagcacctggtgagatttgtatcagcggggtaggtttagcatcgggatatgtcaataatgaagaattaacgaatgaaaaatttattgataatccttttcatcgtggagcaaaaatgtacaaaacaggagaccttggcagatggatgccggatggaaatatagaatttttaggccggattgacaaccagatcaaaattaggggttttagagttgaaatcggagagatcgaaaaccaactattacagctggaaggtataaaagaagcggcggttgtttatatagaggagaaatatctttctgcatatattactggggacattgagatggaaggctcgttcgtacaggagaaattggcacaggttcttccgaagtatatgattccgagtttcataatacaactgaaagagttgcctcttacagctaacggaaaaatcaatcgaaaagagctgcctcttcctgacttgcaacggttgtcagtacctcaatacgaagctccggcaaatgaaacggaagaaaaactagctgaaatttggaaagaaatgcttgggcataaacggatcagtataaatgaagatttcttcgaactgggcggacattctttaacagctgcgttcactatttcccgcatcagaaaaacattcggcacggatataaaggtgaaggagctttttgagcagcctaccatcaaacagttgagccgtcttattcaaaagcgggataaacagaattatccggtcatcagtaaagcgagaaagcagtcttcttatcaagcgtcatctgctcagaaaagaatgtttgccctttgggagacggataaagacagtatcgtttataacttgccgattatgattgaactaaacggaaaattagatgtgaaaaaagccgaatcagttctacaagagattattggcagacacgaagcgttacggacaagtttcgatgttgtaagcggcgatgtggttcagattattcacgatacatgggagctcgaatttaattatcagaagctgccgtctgatgggatacgaccatatgtgaagcagtttatcagaccctttcatttggacaaagcaccgttaatcagagccggactcataacgtatgaagaccggaatctgctgctgttagatgttcatcatatcgctgcggacggtgtatcggttggaataatccgcaaagaattcaatgcgctgtatgcgggtcataaactaaaacagccgccgctgcaatataaagattattcagaatggcaagtaagctcaggaacaaaagaggcgttaaaggaacaagaggagtattggcttaagcggttaagcggagatctgccgattctcaatctgcagactgattacgagcggccgagagtcaaaagctttgaaggaagccgagtcagctttacggccgatgaaaggttaacatcaagcttaaagtcggtggcgaaagaaacaggaacaactttgtacatggtgctgctggcggtatataatatcatgctttcaaaatacagcggtcagcaggatgtgatcatcggaacggcagagtccggaaggtcagacaccgaactggagaatacggtggggatgttcgtcaataccgtcgccataagaaattttcctgaggaacataaaacattcagagcgtttttagaagaggtcaaacatcatacgttaaaagattttgagaatacagattaccaatttgaaaatattgttcaaaaactcggggtaaaaagagattcgagccggaacccgctgtttgatgtcatgtttgtacttgaaaatgcagattacggtattgaaaatcacttggatccaaatccggaagagcatattcaaaccgagatcaatatttcaaaattcgatttaacgttaaccgcgacggaaattgataaaggaattaagttccacttggaatactccagtcaattatttgaaaaagaaacagccgagagaatgggtgcccattttacgaagcttttacaaagtgcagctgccggcctagatcaacctttaatgaaactggatttgattcctgaacaggagaagcacacattgctccatatattcaatgacacggcagctgaatttcctcggaataaaacgattcatcaattatttgaagagcaggcagaaaaaacacctgaacgtattgcggctgtccaagaagatacgctattaacctataaagaactaaacgagaaatcaaacagcctggctaatcttttgagacaaaaaggaattagagaaaacagcattgtcggaatcatgacagagagatctcttgagatgatcatcggaattatcggggtgctgaaagcagggggagcgtatttgccgatagatcctgaatatcctgatgaaagagtaaattacatgctgaaagacagtgatgcaaacattctcctaattcaaaacggattgtcaggtggtattacattcaataaagaaattttatcattaagtgatcctactctatatatgcataacagaagtaatctgccgaatgtcagttgcccggaagaccttgcctacatgatttatacttcagggactacagggctgccgaagggcgtcatggtaaaacataaaggcgtggtaaattatattcattgggcaaataagatatatgtaaatgatgaagatattgattttcctctgtattcttctatttcttttgacttaacggttacttcaatttatacaccgcttatttcaggaaataaaattattatttatgagggaccggacaaggctcttctgatcagaagaattatagaagaaaataaagcggatattattaagctaacgccgacgcatttgagattgctggagaatgtagatttaagtacgtcaaagataaaaaaaataatcgtcggcggggaagagctgaaaaccgggcttgcaaaaaagatacacggtgcatttaacggtcatgtcaaaatctacaatgaatacggcccgacagaggctacagtcgggtgtatgattcatcaatatcatattgaaagagacaatggcaatgcagtatcaataggcaaacctgcggataatactaagctttatatattaggaaaacaattggaattacttcctttaggggcagccggggaactttgtgtcagcggagaaggacttgcagacggatataaaaataaagcgggcttaacgtcagaaaaatttgtagataacccctttgaacccggggctaagttatacagaacaggggatatggcaaaatggatgccggacgggacaattgattatttaggaagaattgatgatcaagtcaaaatcagaggatatcgtattgaaacgggagaaatagaaaaccggcttctgaaaatgagtcacataagagaggctgttgttgtagcgagagatgaccaacatggggataaatatctctgcggttatgttacttccgacaaaaaaatagatgtttatgctttaaaagaaaatctgtctaaagaattaccgttatatatggtgccaagttatatcttccagattgaaaaaatgccgttaagttcaaacggaaaaatagatacgaaatcattgccgattatagatattgcggatgtattggagtctgcatatgaagcaccgcgaaataaaaaggaacaaattctcgcatgcgtatgggagaaagttctggggatgaaatcaatcgggattaactataactattacgagatcggcggagactcaattaaatcaattttagtagtttccgaactccaaaaatacggcttaaaactggaagtcagagatttaatgaaatatccgcacataaaagacttgagtgctcacgtaaaatcagctgatatacaagcagatcagtcgattgtagaaggagacgttgatctgacaccgattcaaaaatggtttatagaacagagatttgaacaagaaaaccactataaccaagcctttatgctttacaaaaagtccggcatagaagaaaaagcaatcgaaacggcctttttggaactggtgaggcatcatgatgccctcaggatgcagtttaaaaaggaaaacggtgaaattaagcaatggaataggggcattaaacaggcaaaagaaacatttactttagaagtatttgatatgacacaaacagaagatccagccatggcaattgaatcactggctgaccgtatgcagaacgaattgagcttggaaaaggggattttaataaaactggcggtatttaaaaccaaaaacggagatcatcttctattaaccattcatcatatgatcattgacggagtatcttggagaatcctattggaagattttgaaacagcttatcttcaaacagttaatgggaacaaggtggagctggaaactaaaacagcatcgttcaaagaatgggcgcgtcaattgaaagaatatgcaaacagcaaggctcttcaaaaggaagctgggtactgggagaccatagaaacggctattattgaacctcttccaaaggatttcattgccgaaagctgctcttatgaagatagtaaagaaattaaaattgaattaacagaggatcaaacaaaaacacttttaagaaatacaaatgcagcatatcatacacaaattaatgatatattgctttgctcactgggacttgcagccaaagaatggaccggcaacgagaagatccttgtgaatcttgaagggcacggccgtgaaagtgttataaaaaccccggtccatcgcacaataggttggtttacgacaatatacccaattgttctcgatatgacggaaagtaatagtttatcaagctccattaagtatacaaaggaaatgcttagacatatccccataacgggattggttacggaatactcagatatttgtcggactcggttcatcttcaattaaaacctgatatcagttttaactacttgggtgaatttggccaagaagatcgcagcaacctatttcaaatatcacctttgtccgccggaacgagcatatctggaagaaataaaaagacacatagtatagaaataaatggatatatcatggatggcaggctgatgtttacgttcaattacagtgcaaaccaatataaacgagagacgattgagcaatttacgaaagcctatcaattgaaaataaatcagatcatagaacattgtgtgaataagaaaatatctgagaaaactccatgggattatggggatcccgatcttcaaatagaggagctaaatcaaattcttgcaagcggtgctgaagtagaaaaaattcattctctttcaccgatgcaggaaggcatgctgtataacgctgtgattgaccatcaatctagcgcttatttcgaacaaagtgaaataacagttgaaggaaatctgaatacagaagttctcagtgacgcattaaacaggctgattgctaaatatgaaatattaagaacgtcatttttctataacggtttccgtgtatttaaacaagccattttaaaagaaagaaaactaaacattcaatatcatgatatcagccaatgggaggagcagaagaaggatgcctttgtagggcaattcaaggtgagagacaggaatactccgtttgatctgaacaaagattgtctgatcagagtatcggtgatcaagctgggaagaaataaatttaaagtcatatacagtttccaccacattattttggatggctggagtgtcggtatcctgttaaaagagcttatggatctatatggtgacgtggctgaagggaaaaaactccttcaagaatcacctgtaccgtacagtcgttatcttgaatggcttgatcagcaggacaaggaccgtgcatttgaatattggaaggaatatctttctgcatatgaacaagagatctcatttccggaactggaattgaaatctgacgagtatcagcatgatcaaaaactgggagcgcttaacggtgaaaccgccgctaagctgaaaaaaatcgctgagtcaaacagcattacattaaattctatcgttcaaacagcatgggggatattgcttcagaaatataacaatacaaatgatgtggtatttggttccattgtttcaggcagaccgagtgagataaacggaattgaaaatatggtcggcttatttataaatgcagtgccaatcagagtgaaaagagaatgtgatacatcatttatttcattggctaaacaaataaataaagactttattgaagcgaacgaatacagttattgttctctggcagacatacagtctttgacaagtatgaagaataaattaatcaatcacgtagtcgtgtatgaaaattacccgttgagtgaggatcttttccaagattcagcccgttcgagtgtaaaaataactgctgaacatgggtttgaacaaaccaactatgatttagagcttttaattgctcccggtgacgacttgcatatgaaaatcacatataacgccagtgtttacagtaaagaaacggtaagttcaatcttagataacctggttagcatcttacagcaggcagcggctgatcatgaagtaatagtttctcagatcgatatggtaaatgagacagagaaacaaaagctggtgaaagaattcaactgcacggaattatcatataagaaagaaaagacgttacaagagctcttcgaagagcaagctttaaggacacctgatgcaatcgctctggaatggaacggagacttcttgacctataaggagctgaataataaggcaaatcaattggcaagagccctcagggaaaacggcatcaaagagaatgttgtggttcctattttggtaagaaggtctttccgattgattataggaatattaggaatactaaaggcagggggatgctacttaccgcttgatcctgattatccggcagacaggatcaattatatgctgaaagacagtaaaagcggcctgctgttaactgaagaaggacttccaaatgaattaacgtacagcggaaccatatttaacatagattcagaggatttattacatcagttggagacgaacattgatgttattaacagggccgaagatttagcatatgtcatttatacgtcgggatcaaccggaaaaccgaaaggggtcgccgtagagcaccgtgccgttcataactttattaagggaataacagacaggatcagcttttcacaagacaatgtccttctttcggtcaccacgtgctcatttgacatattcggattagagtcgctgctgcctttaactcaagggctgaaagttgtcatagccggtgaagcggaacaaagagatccgtacttgttaaacaagatcgttgttgagactgatgtcaatactattcagcttacgccatccagattaaagctgatgctaagtgcagaaaacagtacggagagtcttcagaaattgaagaccatcatggttgggggcgaggtatttcaacgggaattgttatttgagctaaaaaaatataaaaatctgaagatctataatatgtacggtccgactgagacgacgatttggtcttctgtgaaagacttaaccaatgaaaatagtgtaaatataggcaagccgattgcgaatacacagatatatatagtagatcatgatggaaacactgtaccgctcggcagtactggcgaattatgcattgctggagccggaatggccagaggatatttaggaaaagaagatttgactgcgcaaaagtttgtagacaatccgtttgttaaaggaaccaagatgtataagacaggagatttagcaaggtggctgccaaatggtgaactggacgttatcggaagaatggacaatcaggtaaagatcagagggtatcggatagaattgggagagattgaaagcatagtaaaccaacatgaaaaagttaaggaatgtgtagctgccggaaaaacaaattccgcaggagtccaagatttagttctgtattatgtggcagaaagcactgtatatccttcagaatttattaagttattatcacctgtgcttcctgagtatatgattccgcagatctttatgaaaattgaccaaattccgctgacagcaaacggaaaaataaatgtcctggcactgcctgaacctgttatagatagaacaggttttgaccggccttttgaggaagcggtaacggatgtacaaaaaagtatcagccgtgtttggaccgatgttttaaaaatagaagagcctggaatacatgataacttctttgaagcaggcggtaattcaatcaaaatcgttgcagtttataatgagcttcagaagctgtatccaaaacaaattcaaattgctgacttgtttgcatatccgactatttacagattgtccgaatatatagaatcagctatagcctttgcggagatagcagtgtccttggaaaaagaaatcattcctattactttaccgcttgaatacatctcggaatcaactggacaaagtcatacagccatgcacgaatatgcggtaaatgcgaattattatgatggtttaaaaacaatatgcaatacctacaaatatgatatttctcatgttttattagcgggttatgtatttttattagctgatgtcagccagcaaaacttggttcatatccaattttcgggtcatggagatgatcggatgagtcagctgtcttttgatctgtctgatatcgagaattttcacgatattattcgtatggcgaaggagcagattgagaatcaagaggattcacaatacgatttgaatactcactataagaaatcaagttcggcccaagatgtttttcctcttttttatattagtaatgaatcaaaaaaagagtactcagaattatatgatctggtttttgcagttcatgaaaagccatccgaagcagaaatcgtttttatatataaccatcagaaactaaatgagcacaaaatgaaagatttattttataactacatgaatttgattcaagtgattacagcagacaaagcagacaattcaatataaagcggccggttctgccttacattttgctgatcggcagaatgtaaggcaaatcaggcattatagggactttggaggtatttaaatgtcgaaaataggttttttattttcaggacaaggatctcaatatgcaggaatgggcaaacgtttatgtgacaattttattatcgctaaaaaaacgtatgacgaagccagtgatgcattgggatttgacctgaagaaattatgtatagatggaagtgccgctgagctatctcaaacagaaaatactcagccggccatcctggcaacaagtattgcacaattcagaatctacatggaagaggtcggaaaagaacctgaatatatcgccggccatagtttaggagaatattctgccttggtttgcagtgacgttttggatttccaggacgctgtaaagctggtgagagccagaggattattaatgaaagaagctgccgaacaagggaccggagcaatggctgttatcaggaacctggatgaaagaatagcagaagaagagtgcgaatctctctcttcaagaggaaaaacgattgctgtttctaactacaatggatataaagatgttgtggtatccggagaagcggcagcagttgaagagcttagtgaaactcttaaagccagaggagcagacatttttaaattaaatgtaagtgctgcttttcattctccgatcatgggttttgctgcggaaaaattcagccatgagttaaaaaagtatgatctcagaactccaaaatacaaagttttatctaatgtgacggctcttccatattcagataaacagcaaatggctgacatactgggaactcaaatcgtaaaaccggtaaattggatgggaatcatgaagtatttagaagcaaatcatactgatactgtgattgaatttgggccgaaatctgtattaaggaatcttgtaagaaacaatatcgctgacatcaaatcgtacagctacgacaaagaagaggacgtgaagattataaaagagactcttttgaacgaatctgtttcactgcaagccggtttttctattatctcgagaagtttagggatcgcggttgctactaaaaattacaactggaacaatgaggaatacgccaaaggtgtaatcgaaccatatgaaaaagtagctgccatacaggctgaacttgaaacatcaggtcgtcagccgtcaagagaacaaatgcatatggcagtagaaatgctgaagtcagtgtttcgaacaaaaaaaacccctataaatgaacagaaaaaaagatttaatcaattattttctgaaacaaacacaaaaaaacactttgaagactttgaagtttgacaggtatgatcacctatctagtgattctcagcgaggtaaaaaaatgaaaacagactttataagtttaagtaacttaaaagcggccgcttttacaaatcaaactcctaatgtaaagaaacaaaaaaacgaggaagggaccaaagacatttccggagatgacattgccattgtcggtttatcatgcagaatcggcgaagccaatcacgtaaatgaatattgggatttacttttacaaggaaaagagttcatcagagacattcctctgaacagaaaaaaagatgctgaccagtcattaaaaaacagcggaaccaagtacagtaaagatgcagcctatacaaaaatagcctatatggatgagattgataaatttgattgtgactttttcagtatccttccaaatgaagcaaagttgattgatcccagacaaagattatttattgaaacggcctggaacgcattggaagacgggggttacggcggcggaaaattatgtgggacaaatacgggagtatacattggactcagcagtgacggctcaaatgaatacttcagattgcttgaaaaaggagatcaatcattactcggactggctaccgcgggtaacattaaatcagttatcgcaagcagactgtcatatatcttggattttaaagggccagcaatggtaatcgatactgcatgctcttcatcgcttgtcgccctccatacggcttgtcaggcaataagaaataaggattgcgatatggcattagccggcggagtgaatataaaagtattcccaaagacaatagaggagagcaggttaaatatcgggaattcttcatctgattttgctgtaaggactttcgatgattctgctgacggcacgaatagcggcgaaggagtcgctgccgtattgctgaagccgctggcccaagcgattcgtgatcatgaccagatctatgcagtcattaaggggagcgctgttaatcaggacggcagctcagtaggaattaccgctcctaacgcagcagctcaagaacaagtaatagtagatgcgtggaaaaatgcaaaaatagatcctaaaacaattacatatattgaagctcatgggacagggaccaaattaggggatccgattgaaataaatgcgttacaacgggctttcagaaaatatacagaccgaaaacagttctgtgcagtatcttcagtcaaaacaaacatcgggcatcttgatagtttggcgggaatagcgggtttaattaaagcggtaatggcattaaagcataaaaaaattccgccaagtttacattttaaagtgccgaaccgaaatatcaattttcatgaatcgcctgtttacgtcaatgactccgtttcagcatgggagagcagcggagtatacaggtgcggcatcagcagttttgggctgagcggtacaaactgtcatgtcattttagaagaggcacccgcagttgaaaaagtcgatcaatccgttttatctgaacatatttttactgtatcagctaggactaaaacatctctcgcgcacttgcttacagatcatattgattatttaaagagagaaacagatgtgaatctgggagatatatgttatacagcaaacactgggagattgccaaacaaatacagactcgctatggtaataagctctgtcgcggaactgctggaaaagctggagtttttatcatgctctgaatggaaaacgtatcgggagaaaaatatatactttcaatcgataacaaatcaaacaaagtttataggaaaaacgcatacagacagtgtgcagaatactcaaacaataaaaaatgtgattcaaagagtcagacaagacgtctctaatattccaacctctgacttacatattttatgtgaaatgtattgtgatggggcgaatattaactttgaagatctttatagcgagatgaattttcaaaaggtcagcttgccgacatacaaattcagcggaaaaagattatgggctgagctggctgcagacggcccttcagccgatgagaaaaaacaatctttattgagcaatcttgcagtgcagtcactgaatctggaagtgtatatatcccatttgaatgtcactgattattggtttttaaatgaacataaagtgaatgattcttacgttatccctggaacggtttatatagaaacagctagagaagcgggaagaaaatacttcggcgaacctgtcggcattctgttaaaagacgttacgttttcaaatcagttaaaggtaaaagcaaatgaagttaaagaagttcatacgatcataaagaaaaaggacagcgttttagagtttagtgtgataagtaagaccggcgataaatggataaaacacgcggaagcggtcattgcgaaagaagaaccggtacgggaaacatatgacattgaggatttaaagaaaagctttaattctgtttatgtcattcaacgtaataatcatccattgacggaaataaacaccgatgaatacaagtcggtttatcatatagaagataccaatagaccggaaagcatcgttcaagtcggaggcagatggaaatgcaccaacgcaatctacagagacgacgacaggcttctatgtgaattggaattgccgaaagaatatgagagtgatttcgttcagttttcgcttcatcctgcgatgatggattgtgccgttaatgccgggacattcacaatagataacgaaacctatctcccttatttttataaagaatttaagatttatggctctgcttctaaaaagttttacagttatatcaagaaaaagagccgaagcaacggggaaacaggaacgtttcgcatcgtcctgctgaatgacactggagaagttttcggtgaaatcaacaattacatcgtaaaaagggtgcataaagcagctgaaaagactaaaagaaacaatatatatcataagctatcttggataagagaaagcgatcaatcacacgagatgcgagaaattcatcatcctattttattatttaagaataatggctgcagtttatccgaggaaatcattcgaaggttagaactggaagggaaaactgtgattgtcgcggaacagggtgactatttctctaaaatcggaagccatcattatactgtcagtgattctcaagaagattatgactgtcttgtaaaagctcttcaaagtgaaaaggtttctcagattgtccatttgatgtctatcagcaatgagaaagacaaaaacatatatcagcttcagaaaaaaatatcctcaggggtagacagtttattttatttaacaaaatcacttgtagaaaatacaaaaaataacatagaactgatgctgtttgcagaccttgcacatcaagtaagcggtgaagaaccagacattaacccgcataacgcggcatttttcggttttggaaaagtaattgaaaaggaatattcgcgtgtaagtgtcagatgcatagatttggatcaaaatcttatggcggaaagcatcttgtttgaaatcaactcaaaaaaacagtcagagcttgtcgcttacagagaccggcataaatacgttcaagagctccagactgaagacttatccgtaattcgggaagggaaaataagcatcagaaagaacggtgtatatgttattaccggcggtatgggcggactgggattagaaatggccaagtatttatcatcaaaagaaaatgtccaattaatcctcattggacgctccgagcagcagatcaacatggagaagggaaacaacaagaaaatcgatgctctaaaagaaataaaagaaagcggttctaaggtagattactataaggcggatgtcgcaaatgaaagtgaaatgattcatgtattcgaggaaataaagagtaaatacaatacaatccacggtgtcatacatagtgctggtgtttctggagatgggtttattttcagaaaggaaaaaaaagtgtttgataacgtgctcagaccgaaagttaatggaacatggatattaaacgagctgacaaagcatgagcatctggatttcttcataatgttttcttctatcacagcacttgcggggagtatggggcaggctgattatactgcggctaatgcctacctggattcctttgcagaacgcagacagcgaagaagaccggatgaaaaaacagttacgattaattggtgcggctggtcggatgtgggcatgcttgccgaatatattgaagagcgtcaaaaggccggaaacgaacataaagatgaaaacggctttaagacgattacctcagctgaagcgatacgtgccttcgatgaagtcatgcaaaaggacatccggaatgtgatcatcggggaaattgatcatcgggtactggaattaaatcaagatcaaattcatttccgattatctccggatattttgacttttaaggagcaggcgattgtaaaaaaatctgttgagtcgaaaaccgatcagacatttagcttcagcgatattgaaaataaactaatgaaagcttggataaaagttttaggcttagaacaaatcagtataactgataaattttatgatttgggcggagattcaatatccgcgatatatctggtaaaagaaatagagaaagaatggccttctctcattgatgtttctgatatttttacgtatccctccattaaggagatgtcaacctaccttgaatcccacttcagtgatcagaagtcttctgaccgaatccctgaagaagacaatgaagatgacctggatgcaattttgaataagctggcatccggagagatggaagtcagcgaagcaaatcaaatatttcatccagaccgaaaataactgaattgggcctgtaagaatatattcgcaaaatggatattggcaggctgcgaattgaatgaagaaaaagcagcctgcctatcctatcacattattacgggaactgaattccattttaaggtaaaaatgtagatcttattacccttcctatcaaaaattttcttagaaagaaagcgggagtgatccgtaatgaatagcgttcaatcttatatatttgaacaagtgaaacagcataagctaagccagaaagaagcaaagcgaatgctaaaagaattaaaggctgcaagcagcaatgaagatattgctatcattggaatttcctgcagactgccgaaagcaaacaatacagatgaatactggcagaatctgatgaatggagaagactgcaaagcggaatatccaaaagatatgatcaattacattaaaccgatcgtaaacaataaagggtttactgattttctcggttcaggatatctgacggaagaacaagcagataactggaaacctggcggatatttagaagacgtagacaagttcgatcctgaattttttaatatttctcctaaagaagcaaaggccattgacccgtctcacagagtattgctggagacggtatggactgcgattgaagatgcagggtatgcaggggacaaaatttatggaagcaacacatcgctctttgttggaaaagaccatgtcaataatacgttgtaccgctacattacagaatcagaatcgacaagtatgacgggcaactggccgggtttgatggcggggcggattaattatttattaaatttaaaaggaagttctatggttttggattctgcttgcagctcggggctgcttggtgtgcatcttgcctgtaatgctttgaaaaataaagaatgcgatatgtctattgtcagcggaatttcattaggattctttccgcgcttcaaaacgtccaaaaaatcaatgatggaatcagtaagtgataaagtacactcatttgataaagacgcagacgggacatttttcagtgacggagtagctgcagtcatcttaaaacctttaagtaaagccaagcaggacggagatcatatttatgctgttatcaaagggagtgcagttaataatgacggggcctcaaatggattgacagctccaaatgccatcgcccaggaagaagtactggttcaggcatgggaaaatgctcaaattgatcccgaaaccattcaatatatcgaagcgcacggtacaggcacaaagcttggagatccaattgaaataaaggggatttccaatgcgttttcaaaatatacggacaagctgcagttttgcgggatcggatctgttaaatctaatattggccataccgttgccgtttcgggtttggcgtcacttatcaagatcgttctgtctatgaagcatcaagtcatccctccgagtattaattttaaagaaccgaattcattgattaactttgtgaagtcacctgtatttgttacagacaaagcccatgaatggcctaaaaataactcaccgaggagagcgggaatcagttctttcggctttgtggggaccaattcacatgtagtgattgaagatgctggagatgaggttgaagaggtcattcctgcaaatgaaacatttgagatatttactttatcagctaaaacagagaattctttaatgaaactcatcaaggaatataatgaattctttaaaaaaggaactcaaaaaaacgtaaaacatatttgctatacagcaaacacagggcggggccattacggctaccgattggctctgattgtaaaaagttacgaagaattaaagagaaaaatcggcaggcttgcagggcataacctgaatgaaatatcagaaaaaggcgtatatttttctttccataaagttggttctgatagaaaacagattatggatgaaggagaaatttccttatctgaacatcgcaaaatgaatgctcaatctgacaatttgatacatgacattcttactgaaggggatgaatatttactgctaaaccttacggaaatttgcaacctgtatgtcagaggagcaaaagtagaatggacaaaaatgtacaaggatgagcgcagaaagattgtcagtcttccgacataccaatttgaaagaacattatgctggggagaagtaaaagacagaagaggtcaagcgccgcatcagaaaaatatcagtcacccgctgattgaccagtgtttggctgattcaatgaatgagacgatctattcaacgacatttaatgtgaataaggattgggttttaagtgaccataaaatcatgggggcttgcgttattccgggaacgacttatatcgaaatgggaagaagagcaagtgccgcttactataaaagcaatcaattagaattacgagatattatcttcttcactccgttaacagtaaatgaggatgagaataagattgtacacacaatcattaagaaaaagaaagaatgtattcaatttataatagccagtcaggaaggagaaacctggattacacatgcagaaggaaaagcgtttccattaacagactctgtatcaatgtttgatttagactctgttaggaatgacagtaatagagagaagataaaagtcaattatgaaaataaaaatggtttaatcagcaaagtctttactttcggaccgaggtggctgaacttcaaagaagtcatactgggccctgatgaacaattggccgaattaaaattggctgatgaatttacagcagatttaaaagacgtctttttacatcccgctttgctagataatgcagtgaacgtgtttattggagaagatgatgacgatagtacattccttcctttttcatataaaagcgtgaagatttactcaagaatgccgcagcatttttatgcatttgtcaaaaagaacgcaagcagtaaagagacaaagctgtgtgatattcagttaatagatacagaaggaaatgtttttgcagaaatcaccgattatgtattaaaaaaagtaaatcggattaatgccctttttgaagaaagttctgaatcactttatcaattaaaatggatggcgcaagaagcttttgaagaagaaaaaacagaggtaacaggtcctatactgttatttaaagacaacatggaaatttataaatctatactggaacagttgaaaattcatgacgatgatgttattgaagtggagtttggggatgaatttcagaagataaatgggcggaaattcctaattagcggatcagaagaagactatgttcaattattgcatagcataaacgatcaaaatatcagcagcattatacatatgtcttctatcagccgccaaggaacggaatcattaacagatttagaagacatgcagaataaaggcgtatacagcctgttccgcttagtccggggattaagtaagaataagatgaaaagcaatattaatttgcatcttatttctgatcttgtgacagaagtgtccggagaagaaaatacaatcaatccattgggcgccgcgttgtttggtctgggacgtgttatttcgcaggagttccaaaatgtttcatgtaaagcaattgatattgatgaacatacttcaccggaaattattagtgaggagttaagaacaaaagggaaacactatcaagtcgcctttagggatggtaagcggtatatcagtcggttggatacggttgaaccgataaaggataagaaacacggcggtatggagattaaagaaaacggtgtctatatgattaccggcggcaccggcggaatcggtttggagatcgcaaagcacctggctggaaaacataacgtcaatgctgtattgctcaatcgctctaaactgcctgatcaaagccgatgggacgatatcattgctgatggaacggatttaaagctttgcagaaaactgaagtccatcagagctatcgagtcaatgggttctaaagttgattgctacagctgtgaagtttctgacttaaacagcatggagccggtaattgaagaaataaaacagaaatacggtacgatcaatggcgttttccattgtgccggagttgccggggacggtttcctctttagaaaagaagctaatatttttaaagaagtgctcgctcctaaaattaatggaacatgggttatcaatcatttaacgagagacgtagatttagatttcacgattttgttctcctcaattaattctattttcggaggtgccggacagggagattatacagctgcaaatgcttatttagattcctttgcttatatgcaaaacaaacaggggaaaaacacgctgtcaattaactggccggcttgggatgaggtcggcatagctgtcgattatggaattactgatgagagctctattttcagattattgacggtagaaagggctatttccgttttagaagaaatagcatcgaataagcttactaatatcattccaggtacattaaatatgaagctcctcgcttttgcgaaggatgaattgtcttttgaattatctgagcaaatcaaaaacaaattaatagataaaaacaggacaaaaaacgaagcagaaaaacgtcgaagaacagatactgaagatatagtgctgaaaggaaagggagaactttactctgataccgaaaaaagtattgcgcaaatgtactctatggttttggatatgcaagagctggatttatatgaaagctttagtgccatgggcggcgattctattatggcaacccaactgttaaaactgataaatcaacaatatcctgacattgtggatatatccgatatatttacatattcctctgtagtggagctatcagagtatattgacaagcagctgaataaagatcatcagcaagaaacggaagaagatactgctgaaaatcggcttgagcaagaactcaacaatctatttgacgacctggagaacggcaaaatcaatatacaagaaggattgaaaattctagaaaactagtttcggaaaaggggaaaattaatgaagaatacagaagaaaacaagactgcaatcataatcggaggcggtattgcaggaatggccgcgggctgttacttgcaaatgaacggatacagcacgaaaatttttgaaatgggcttgctgccgggtggtttatgtaccggctggaagagaaaagggtacttttttgacggttgtatcagctggctggtcggttcaggacctaacaataccttccataaattttggaaagaactgaatgtaatacaaaatatggaattcattaatgatgaagaatttgcggttgttaactttagaaatggtgatacatttacgctgtatgctgatgtagataaattagaacaggagtttttaagagttgcacctgaagatgcggaaacaattaagcttttaactgatggcattcgagttgtttctgatgtagagctggatttggataaagcgcccgaactgttcgatttagcagactttgaggccttcaaagcaaaggctggcccttacatgaaagtaatggggcaatggggaaaagtgacgatcaaagaattcgcccagcgctttaaaagcagttttgtaagagaaaatgtaaatcgtctgttttggtttaatgtagatacccctatatcttactttatggctactttaggctgggctaatagcaaatcttcaggacatcctgtagaaggttctctgcaattcgcaaaaattattgaagccagatatgttgaattaggcggtgagattcaatataaatcacctgtttctaaggttttagtagaaaatgataaagcgatcggaatagagctgaaaaacggacagtgtcattatggagatatcgtcatttcagcagcggatggctataaaactatttttgaaatgctggatggaaaatatacagatgatgaactgacattttgttatgacaaccttaaaacaagtgcaccgcaaatttatgtcggattgggcgtatcaaaaacgtttgaaaaatatcctcattatttgagtctggaattagaacagcctcttaacgcctatggctgtgacaacgttaaaaacatatttgtgaaaatatataacgaaaatccttcattcgcgcctgatggcaaaacgagtattatcgtgtatgcgaaaacttctgctgaatactgggagactttgcaaaaaaacaaccgcgaaaaatatgaagaagagaaaaaagcaattgcgaatgtaatgattgatgaattagacaaatggtttggtgaaattaaatcaaatattgacgtgactgatgtatccaccccatatacgatcagaagatacacaaataatagaaatggaagctggcagggctgggaaaaacagatggaaggcatcatgcacgagaaaaaactgaaacgttcacttcccggacttaaagacttttatatggttgggcattggagtcaagtgggaggaggtcttccgagtgttgtcttacaggccagaaatctggtgcaggtgttatgtaaagaagatggaaaggtttttgagacaaaaattaactaattcaataagctgcttcaattgaagcagctattctatatatccatgatgcttctcatattttatatagaatcaaaatcgataggggtgattaatcgtggatgatatttcgattataaaacaatatgtattggagcaagtaaaagagcaaaaaatggacagggaaatggctttgcgcattttaaaaggattatctgataagtccaagaaaaatcaatttgatattgccattatcggcatatcctgccgtttctcaaaagccaataatgcaaaagaatactggcaaaacattatgaaccgtgcctcatgcatccgggacttaccggagaagcggcggaaagatattgatccattgctgcccagtgcgaatgagaattcttattttagagcgggattcttagatgaaattgataagtttgattcatcatttttcagaatttcgccaagagaagccatgcttatggatccgaaacaaagattgtttttggagacagtttatcacgctattgaggactccggttatgcggggaacaagttacaaggttcgaatacaggtattttcgttggacatgatcatagcggtgacttgaagttttcctatgcttccctagtaaaggatgcggatatgattgcaatgacaggtacttatcccggcatattggcaagcaggacctcctacatttttaatctgaaagggccaagcttggttgttgatacagcctgctcttccggactcgtttcggttcatcttgcttgtgaggcacttaaaaatgaagaatgcagcatggctattgcgggaggcgttaatttatttctgagacctgaaaatataggtacgatgagcgaaatagaagcggaaaacgctaaaatcagcatttttgataaaaatgcaaaggggaccgcatggggtgaggggatttctgctattgtattaaaacctttacatagggctatagaagacagagaccacatatatgctgtcattaaagggagcgctacgaataatgacggggcttctaacggaatcactgctcctaatgctgaatcacaagagaaattgatttcacgtgcctggaagaatgcgaatattagtccggaaactatttcttatattgaaacacatggaacaggcacgattttgggagaccccattgagatcaaagggataacgaatgcgtttaagaaatataccgataaaaagcagttttgcggtataggttcagtcaaacccaatatcggccatacagtcggggcatcaggcatggcgtctctcattaaagcatgcatggctttaaaagagaaggtcatccccccaagtatcaactttaatgaaccgaatcctttaattaatttttcgaattcacctgtttatgtgaatgacatgataagaaattgggaaaaaggagagacgccaagaagagccggtgtaagttcgtttggcttcagcggaaccaactgtcatattgtattggaagaagcacctgaaataataggtgagactgaacagagacaggtaaaagaggtattcactctgtctgcaaaaaataagtccgtcctgaatgatatagcatcaaagtatcttcattttatctcggaagaaaacaatttgaatctctctgatctttgttatacagcgaatacgggaagaaaacatctggagaatagagtgtgttttctcgtaaaagacatcgaagatctgaaggaaaaacttgaaagtctgctcgaagcgccggttcagcaagaagaagctgcattttcttataagaccgatagagatctaagtaccgctgctggaaaaaaacttaaggcttataatgcaggcgggagaacagatgagagtcttctgattgatataagcaagctctatgaaaaaggtgcagagatcgattgggaaatgttatatgaaggagaaaaaagaagaaaaatcagcttgccgggttacgcatttttgcgggagagacattgggtgaaactgcctgaaaaattaccgataagcaatgcaccagataacccttcagtcaacaagcctcaaataataagactgagtggcagggaagacggctgttattcagaaacagagctaatggcaggacaaatttggggaaatgcccttggaatcaatccgatcgatgttacatccgatttttatgaaatgggcggagattcaatcatagcaatagaaatcatcaactttatcaataaacagcaaggaacggagctttcagtttcagacttgctaaagcattcgaatataaaactcttctcagcttatttggatgaatattctctgaggaagacaaatgatgtgaatgtgattcccaaagcaggcgatttagagtggtatgaggcctcatctgcacagaaaagaatttttattctagatcaattaaataaaaacagcacttcttataatatcccgttctttttaatgattgaaggagagttggacgataaacgtttagaagatgcgtttaaaaaattaataatcaggcatgaggttttaagaacgtccataggtttaagggacgggcagcttgtgcaaatcatagaaaaagacgtccgatttaaaatggatagaatcaagacctccgaagaagaattagagagccttatgtctaattttgtccgcccgtttgatgtagaaaaggctcctttactgcgtgcaggattagccgagattagtcatcaaaaacatcttttaatgatagatttacagcatattatagcggatggggcgtctatcccgatcttccaaagggaattgataaatttatacgaaggcaacgaactgccgtcattgaacattcaatttaaggattttgcgatatggcaaaatgaattatttcatactgaagaaatgaaaaaacaaaaagatttttggttaaatgagtttaaaggagaaattcccgttctcaatctgcccgcagatttttcaagagaagccgaacgagatgatcaaggtgaacgaatctatttttatgcaggaagagagctgactgccaagttaacagaattaaacgcaaaacaaaaagtcacccttttcatgactttaatggcttcatttaatgtgcttctccataaacttactggtcaagaagatattattatcggcacacctgtagccggaagaaagcataaagaattagaaaacatgataggaatgtttgtaaatacgctggcactgagaaataaaccatctgccgacaaaacattcaaagaactgcttgaagccgttagggataatgcgcttctagcttatgaaaatcaagattatccttttgaagagcttgtagaccatttgaaccttgagagggatataaaccagaatgctcttttcaacgttatgtttgtccttcagctgatggataatccggcaattgaagtaaatgggctgaaatataagccgtatctttatgaaaacaaaacagccaaatttgatcttctgcttcaagcatttccttcaaaagaggatatcaagtttgagttcacttattcatcaaacttgtttaagcgcacaactgtagaaaaattctcacagcgattcttaatgatcctcaatcatattgttgaaagtcaagatggactaatcggggagattaacattttagaagaaaatgaacgacgcgaaatattgagttacagtggaagatcactgagaagcagaggcacagatgcatctatctgtgagctttttgagaagcaggcggaagcaacgccgaatcaaatagctgtgtctgcacaagacggaagcttaacttatagtgagctgaacaaaaatgcaaaccggcttggaagagcactcattcaaaaaggtgtcaaaaagaatgaagcagtaggcatagctgcagaccgaaccactgattttatcatcggaataatgggaattttaaaagcaggagcagcttatctgccaattgatccatcatatccgcaagaaagagttgagtatatgctcaaagacagcggggcccgtttgttactgacggatcgcaacaatcatggtcaaaggtacggagtagaaagtgtttgtctgaatgaattggaaacagttccagacgacgggaggaatgttaaaggaggaacggaagggcatagccttgcctatatcatctacacttctggatcaacgggacacccaaaaggtgtgatgatcgaacataaaagtatagcgaatttaacagaagccctgcatgaacgtatctactgcaaacatggcgggcagcagaatgtagcgttgttggcacccttttcttttgacgcttctgtcaaacagattttttctgcactgcttttaggacactctctttacatcgtctctgaagaagccaggcatgatatcacgaaacttgctgaattctatatccaaaataaaataactatttctgatggaacaccagcctatctcagcctgctctctgagtctccgcagtgtggccgtataggtgtaaaacattttattataggcggcgaagtgcttaaacctgaagaagtaaagcgtttctataaagtatttaaaaagaatgaccgtccttatataacaaatgtatatggaccgacggaatgctgtgttgatgctgcagcttatacgataaaccaggataatatttccaatataaagagaatccctatcggcacaccgataaaaaactgttctatctacatactagataaacagcagaagcctgtgccgccgggagttatcggagagttatacatcggaggggaaggagttggacgaggctattgcaatcgtgaagaactaaccaaggctaaatttatcccggatcttgttcattctggtgagaaaatgtataaaaccggagatttaggcaagtggaatgaggatgggaatatagaatttgccggaagaatcgaccgacaagtaaaaatcagaggatttagaattgaactggatgagattataaacagactgctgtctcaccgcaatgttcaagaagcggttgcgattgctcacaatgatcagatatatgcctatacagtatgtaaagatacgcagccgccttctcagctaaaagaatacttattggaatatctgccggaatatatgatcccgacagtcattattggcatagataaaattccgttgacgaacaatgggaagactgatgtaaaacgtttgccgcttccagctgaaaataatgccgagctgcatcactttattgctccgagaaacgagattgaacgaatcgtcagtgaggtttggtccgacattcttgaagtttctaaaatcagtataaaagataactttttcgttttaggcggagattcaattaaagccatacaagcagcggtcagaatggaaaaattcaatcttaggctggaagtgaaagacatctttcattaccagacaatcgaaggagtttcgaataaagtcagttatataacagcggcatctgataacagtgtgataacgggagaagcccgtcttgtgccaattcaatgctggctggctgaaagccataatgatactctgcaccatcggaatctttcttttatgttatacagggaagccgggtttggcgaagatattgtaaaagacattttcacccggattattcagcatcatgacagtctgagaacagtattcaaacgtaaaggcgatagaatggtacaggtaatcagaggcctgacggacggcgacttgtttgactttcatctgatcaatgcaataaacatgccgcaatcagttttaaaaatgaaaataaatcaaatacaagccagtatggatctgactcacggcccgcttgttaaattggcactcattaaggaagcagatggggaacatctgttaatcgtcattcaccaaatgatcattgatcatatgtcttggagaatactgcttgaagattttaatacagcatatcagcaagttaaaagtaacgaagacattgtattaccaaataaaaccgattcgtatttaaaatggtctgattatctctataaatatgctgaaagtgaacggctgttgtttgagaaagagtattggacgaaaatcgaaaatgtttatgctccgtctattccggttgatattcaggggcaaattgccaaagtcaaagataacagacaagtgtacaggcagtttaatgttcgggaaactgaaaatataatgaatgcgattcaaggacaagatcatttcactattgagactgttttgctcacagctttaggtttgacagtaaaacatcaaacaggcagtaatacatctctcgtgcacttaggcaaccatggccgcactcatcagagtgagaagcttaatatctacagaacagtaggcagattttctgcaatctatccggtggctttggaggtctccgattctgatcatatcggttcgagtttagataatgttaactcgaccttagccaatattcctgatcaagggataggatatggtattttaagatatttaaaacaagatataaaagagaaatcaaaaccagacatttcatttaattatatgggcgaatttgataatgaactgcacacagaaagctttacggtatctccgctttcaaccgggaatgatataagtgaagatgaaatttggaattacaagtttaagtttattgtgttggtaagagagaaaaaattgagcattggaattgaatataatcaaaatcagtactataagagtactgtagaaaatctgctcaatcagtatatgcgttatatcaaaaaagcagcagaaaccatttaattaatcggaggttaacgtaaatgaccaattcagttcagcaagataaacaagtaccgaagaaatatcctcaggccgcagtcatgcaaatggtttcagggctggggttttccctggcagttaaaacagcggtagaattggatgtattttccgcctttcaaaatggaccagcttcagcggaagcgatagctgaagcccttgaattgaacccctctgccttattcaggctcttaagagcgctggaatccgtcggtttggtcgcccaagctcaaaatggctattatgatgtaacagagtatggtgccactttgatgcctgggaaagcaaaatccattgagcctttggtagaatatctgctgcatgaaacagtagtgcagtctatgtttaaaatggattatagtatcaaaaccggcaaatccgcttttgaagccatttatggtgataaatggtatgagaataatagtcttgatcaagattacttaaaaacaatggataaggcgatggagatttattcaaaaatgagtctgccatccatattgaaagcttactcatttgaaaagtttgatgttatcgtagacgtcgcgggaggaatgggccagttaataacaggcattttaggtgtggctcctaaatcaaaggggatattgtttgatcttccaaaaacgatacaaagtgcaaaaaagcatttagcatcttcagagatgagcgaacgctgtcagtttacggaagggagtatgtttgaggaaattccttccggcggagacttgtatgtgataagcaaagtgttaaacgattgggatgatgagcatgtggttgctattcttgaaaatatagccggtgccatgtctgatcattccaagctgattatagttgaaaatgtgcctgaagcagacaggctgtcccctgaagaagcttttcgtgatttattatttttagtatgctctgcaggcggcagagtcagaaagataaccgagtttgaacaattgattgaaaaagccggattaacactattaaatgtaattcagactccgagtaaatacacaattttggagtgtggaaagaaataatgttatataagctatctcctttaggagatagcttttttatataaaaagttcaccaatttgactgattgattctgtctatctattgatttctctgataaaatgaaacttataatatttaacataattataaatttgaaccacaaggaggaagaaacatgaaaaagagactcgttatgctatttgccgcggccgccgctgctttgttgcttgtgagcgggttgtgggttccgtcagcgtctgcggcgccggctcctgctttaacacaaatccgtattatcggtgtgacgtctgacggtcagaattaccaatgggaaaatatcggtccgaaccaaatcagcgcatcaaaaccgatgaaggggacaacgggttatttagccgtatatttccaagggtatccgaacaataatacgatccaggcgtttaacaacggaacgaatattacaaatcttacgtcaaaagcgctggaagatgaatatacgaaaaacggcaatatcgttacaggctatattaaatattacagcgttcctctttcttatgtcagttcaggaacgttctctttctccgcaacggggctgaacgggccgtacacgccgttaagcagcggatttttctccattcaggtacagagttaaaacagccgcccggtgctttcatgtatagtttttctctctttccgggaagctattcctaaagaaaagggagggcttacatgatggacaggacactcggatatttgcgcgagtcgctttcgaaccacttggagcatgatgtgtgccggggggtttataaaaagcttcaggtgaagcattatgcaaatgagggcgagttcgtgaaagatctaaatgatctggaaatggatgcgctgaatcaggtgcttgaaaaggaaatcaaatatgctgagaacgagcaggatgagaagcgcacgatggaattgaatgaagtatatgagcttctattttaaagagcctcccggcggccgggaggctttttattgtttcggaaccagtttacagaatcatccaaccctttgtataatggatagttgtgaaaaacacagacggaggagaaacatgaacgaaataaaaaaacagacggttcttgagttgtcatcggttgaaaaagctttggtttatctggtgccgccattattggggctggtcatcggatggtttctgccggtcattacgaagtgggccgtaacattggattggctgccttttcacgggccgctggaaataatcgcttcctttcacggatggaaggctgcggctgcaaccgccgttatcggcttaattgggggagtgtggctgacgcgggcagcttttaaagaaagtcttgtggcagtcgtgacggacagcggggtgtccttaaccatatataatgaagaaagcgtgttttcgaaagacagcatttccggtgtgtttacggatgggaagtatcttgttttattaggcactgaaggacaggagctttttcgggagaagcttgagccggcggttgaaaaagcggctgatgcgtttcgcgcgcatgggtatgtctggctggggacggaagatccttttaaagaagaatacaaacggtgggtgccggacacgccggatttggagcccggggcaaatgctcttttaaaagcgagagaaaaggcgctgaaagaggaggaaaaggctgatgcgaaagagctgaaagcggaaatatccaaactgggcattaccgtgcgggagaaaggatcgcgccaatattggcggatctataaaacgccgtctgcataaaaaaagctgccgccgtttgatacggccgggcagcccgggcacagattatttcttcttgtcatcataatattgaaccgggtacatggagccttcggataccattttgttatcttcaatatcttcgggatgcgggttgcctgctttgttgacggggaatgattcaatatcctgcttcccggagagcgatgttttcatattgcggataaagttcatcaccttttggcggtttgatttatctttgagcaggtaggaagtcactccgacagtcgacacggcaagtcctgaaatgagcagtttttgtttcacgataaaaactcctttctatttatggcttgcagtagttattcccgcttaacggctgtttaaacatcggaaggttaattttggcttgccgctttaatgcgataaagattgacaaaactattttcagaataatattataaatatatgatagcgctggagtcatattttaattgaaaggtgttaactttatgaatcaattacatcgcagaatgggaacgtttgcactcatgatggtcggacttgggtcgatgattggctccggttggttattcggggcgtggcgggcggctcagattgcgggacctgccgcaattatttcctggattatcggtatgatcgtaattttgtttatcgcactttcttacagtgaactgggttcaatgttcccggaagccgggggaatggtaaaatatactcaatattctcatggatcatttattggatttatcgcaggatgggcaaactggattgcgattgtttccgttattccggtggaggcggttgcgtctgttcaatatatgagctcatggccgtgggactgggcaaagtggacaagcaatctcgttcacaacggcacacttacgggagaggggctcggcttcgcatccgtattgctgattatttactttttactgaattattggacagttaacttgttttcaaaagcgaattcattgattaccatctttaaaattattattccggggctgacaatcggagcgctgctgtttaccggttttcacggcggaaacttcacatccggttcaagcattgcgccgaacggctgggcgagcgtgctgacggcggtggccacatcaggtatcgtatttgcgtttaacgggtttcaaagcccgattaacatggccggagaagcaaaaaatcccggcaaatcgattccgattgcggttgtcggttcgctgctggtcgcaaccgtcatttacgtcctattgcaaatcgcatttatcggtgcggttgaaccttccatgatcgttcacggctggagtcacctgaactttaactctccatttgccgatttggcgatcgcattgaatatcaactggcttgtcattattctttatgcggatgcgttcgtatctccgtcgggaacgggtatcacatataccgctacgacgtcacgcatgatttacggcatggaaaaaaataaatatatgccgagcattttcggaaagcttcatccgctgtacggcgtgccgcgccaagcgatgattttcaacctgatcgtatcgtttatctttctgtttttattcagaggatggggcgtgcttgctgaaatcatttccgtagcgacgctgatttcttatatcacgggtcccgtgacggtaatgacgctgcggaggacggcggcggatttgtacaggcctctccgtctgaaaggactcagcgtggttgcaccgctcggcttcgtgttcgcgtctctcgtgctgtattgggcgcgctggccgttaacagggcaggtgctgtttatcattttgatcggccttccgatttatttctactaccaagcgaaagcgaagtggaaaggattccgcagaaactttaaaggcggcgtttggatggttgtctatctgctcagcatgatggtcatttcatggctcggaagtgaaaaattcggcggtctgaacatcattccgtacggatgggatatggggctgatcgcaatcgttgcccttgccttctatgcgtgggcgctgaagagcggattcaagactgagtatttgaaagacgccaaagcaatcaacgatcaattaaaaggcgggcaggcggaagccgctgccggaaaagaataatgattgataaaaaccttgcggtaacgttcccgcaaggttttttgatcaggcaaaaaaacatgggttcggcatcatctccgaacccatgctggctttatgatttatattcttttttaaccttttgaaatatatccgcatagttggtgaacacaccggttacgccccaattcagcagacggcgcatgtccgtctcgctgttcacggtgtaagggtgaagcagtaggccgtggctgcgaatgtttcggacattttgagcgttcagcgctttgtaatccggtccgattccgacggcatatgttttgatgtctgttaaatctgcgtcagtcattgaggtcatctgttccgcttcaagcaattggacggcgggaagtttcggatcgagctgtttgattttcagaaggctctccctgctgaaagactgaatgataacttgtccaagtttcgcatgcttacctgccaatttgtattttttcagtgaggcgatcagtttttcttccatacccggatatgtttcgggcgcctttgtttcaatataatagtttgcatgtctgccgaaccgttttaacacgtcatcaagtgtgggaacgcgaagtccggcgtattgcggttttgctttttccggataggccttattgaaccaagaaccggcgtcgagcttttgaatctctgctaatgtatgatccttcacccagccttgtccgtttgtggtgcggtccagtttttcatcatgcatgacgatcagcttgccgtcttttgtcatttgtaaatccagctcaatatagtcagccttcattttttgcgcagtttcataagaaaggatcgtgtgctccgggacataccccgaagcaccgcgatgggcaatggttaaaattctgtcaggagacaagaggtttccttttcccgccgccgatacaggcgtgacgatgaatgacaataaaccgaatgaaagcaataccaaagcaaacaacttatgtttccgcatgttttcttcccccttaaaaatcaatatctgtctctagtgtagaaaatcgttgtaaatgctgtactgcaaaaatattaatcttttatgttgttttcttacacatgctccgcccgcttgcctgtattccacgtcatagccaagaagacgatggacagcacgcatgaggagataagcatgataaagccgccgttccagtcaaagcggtctacgacataacccatgatggcgttggcgaaagcagagcctccgatgtagccgaaaaacccggttaagccggctgccgttcccgccgcttttttaggcgcaaggtcaatggcctgaagtccgatcagcatgacaggcccatagattaagaatccgatgctgatcagcgcgatattatcgatgagcggatgaccggcagggttaagccagtagaccaatacagcgataaatacgccggccatgaacagcacgccggccggtgcgcggcggcttttgaaaaatcggtcgctgatccagccgcacaaaatcgttcccggaattcccgcatattcataaaggaaataagaccatctggaatcttcaggagagaaccctttcgcttccgtcaaataagtcggcgcccagtcaacgacaccgtaccgcacgaaataaacaaagacattggcaaatgcgatataccacagaaatttattattcagcacgtatttgaaaagaatttctttggtcgtcatctctttttcctggtctttgaacgcatgtttcggatagtcattccggtattcttcaatcggcggaagcccgcaggattgcggcgtgtcccgaacgagaagaacaatcacaaatgaaatgacgatggcgataatcgccggaaagaaaaatacgcttttccaagtaacaaacatggcgatgccgagagtcacgagcggggcgagaatacctccgcctatgttatgggcgacattccatatcgacattttcgttccgcgttcactgatggaaaaccaatgagccatcgtccgtccgcaaggcggccagcccatcccttgaaaccatccgttaataaacataaaaataaacataatcgtcacgcttgacgtgacccatggcatggaaacaaataaaatgttgacgacacctgacaaaaacagacctgtcgcaaggaaatacctcgggttgcagcggtcagacaccatccccataataaatttgctgaagccgtaagcgattgatacggccgcaagcaccaagccaagttccccttttgaaaacccttgttcctgaaaataaggaatagcgaaggcaaagtttttgcgaagtaaataatacccggcatacccgatgaaaatccccaaaaatacctgcagcctgagccgtttataggccgcatccgtctttgaatcatccaatctctcaatatgcggagccggcttgaacaattgaaacatcatatcctcccctttgctgaacgtctatcatgatgtatgtatgactcctttccttgaaaatgacaaaaagaaccagaaatcacccttatgaaagggcgcggtttcctggttctcctcatctccatccaaaaatcattaacttgtatatgatagcgctttcttaaattatcacagtctggcgtgaatgtaaacgctttaaggaaagttttcatttttttgaataaataaccggagggaatatcagccggagcgcgaaagatttgatgtactcgattttgtactcaggcataagatgtgttaggccgaactaagaaaagcgaagggagtgcatctgttgattgatgaattggattttgcgttcggtgttctgccgctttgtatcatcatcctgtcagtcgccggaacgtacctgtttaaaaacgcgttcattatgccggctgccgctttagccgtttgccttatatgcacctttaccatattgaatttctcgtttatcgggtgggccgtcgtgtacacgctcgtctctttcgcgttatcgcatattacgatggtggtgatcagccaaaacaaaaaataggatcggcggcagccgatccagctatcaaaagcagagatgcgttctctgctttgttttatttatgaatgtgcaggaattccttgatgaccgcggtctgttcttctttcggatagcttctgtacagatggctggctaagcggacggggtcaccgaagaagtaccgctcatattgtgtctgtcttgttccaaaggggctcatggtcaaatcccatgcgaggcggaacacttttacccggtcctcagcgttcaattcggccgcctgtaaatattggtcaaggtctcctctgatgtcggaacggaacgctttttcagtcggcaaagtcaccattccgcttgccccgatcagctggatgatttccgtgaagcgcgggtagatgtcagggaaaatcgcgctgaccacgcgaagcggagtgacactcggacgcatataaccccattcgtctgtttccgcatcattctccgacttttccaaaagggctttcatcgtttccagaccggtgatgatctcagccatcttggcctgaatatgctgatattcccccacatctatcgcatcgacaagcgtttgggcgaggcccaggagaaactccgtctttacaatttgtctcgtgataacttgatgaaatgcgaaggcgttaaaagagcttttcatattaaaatcaaaagccgcctcgtaattattataaaaaaatacgcgttcccaagggaccaaaacgtgatcaaatacaacgatagaatccatttcttcatatcttgagctgagcggataatcaaacgatgattttccgagtacgaaagattccctgcagatgaattttactccttttgtattggaagggattgaaaaagcgaacgcttcatccgattcaaaatacatcttaggcagagaaaccacgagcacttcatccgtcaggccgccttgtgtggctaaaatccgcgcgccgtgtatgataaggcctttttcatttttatcgacgacttttgccgagataggtgtcggcgatacgtttacacccatttgtgaacgattcacctgaggggtgataaacgtgtgcgtaaaagaaagatcctgtgcggcagcgcgttcgtacagcgcttgaacatgttccggaaaacattgatcacggtctttcaaaagcgcggcagaggaggcgaagctcatcagcacggtattcatataatccgggcttcgtcccatcattccgtgcgtgtgtctggcccaatgttcgaacatgtttcttcttctttttacgtcttctttcgttttcggctgcaggtatgaaagcccggcccgttcttttttaccgggaagactgtaagtcatttgatctttcatgtccggtttcgtttgcaaatcataaagagagcgcttcgtttccagaaggcccttaaatgcgggatgttcagaaatctgtccctcgatcttttcaccatcaagccaaatctcatttcctagctgatttaatcggtcaatgaacattttgccattaatgatacccatcatgtcgcccttctttctttgcagatccactacctcattatattgaaaacgaaattgggtgttccggttatttccaaaggggaagagccttttttgataaggggggtgaagggattgcatcataaaaaaaccccttaagcagaggggtttttaactgatcatgtctttgtatcgttgttcgaggacaaagtctatcattccggtgatacgggtgttttcagatttttgtctgaaacggtcagacacttggattttccttgaaaacggaaatacagcaaaaatccaaacaaggccggccaggccaaaaaccatctgcagagccatttcaatcaaatcattaaaatgagtgctgaaaaaaaagatatataacgtgatgaatgtgactgtacatacgattttgacagtatgttggaaggtgaggagcggttcagtgaaacacattttcatttgattcagtgtgagcgaatcttgtttcattaaatatgtaagcagttctttgtcattttgacttcgcggaatcaaatcattttctattttttgaacggtgtccttgtatgtctgcatatcaatcttcatacgaatcctccttaaaaaataactccaagaatactcattgagcattcctggagcaaggagctgcctgttcaattatagaaatagtgataaaactgtgctgaacaaggctgcagctcctcctaattcaggtgctaaaacgactaaagcaccgatccctacaataacaataattcctgcgcctgcaatagccatggtattcacgacagaatcccaatccggagagtacacctcttcggaatccggcaatctgaagctcttttgttttattttaaatgtaatggtagttgttagtccagtagtagcactgtcaccgaccggaatatcaggtgtataaattttaaattgaatattcagcgatcccgcagccggattgacatacacttctaaataaccgttgcgcactgacaagctcagactgttaagcaggttttgatacgaatcaatttgtgatgctgtaaaagagacttgtgaatctcccatcagaccggtaatataagctcccggtttgccatttgtaatggtaactgtgttgggagaaccttcgcttggcactgttgccaaaagtgaagtagataaaagaatatccatttcaggtgatgcataaatggtttctgtcttgtcgaattcaaacatggcattcgcaagattcgatatattttctaaagcaggaatggttgttaaaatgtccgtcagtgtgcgcagtcttgcatcatacacgggatcagaaggcggatggacgctgcttgcacccgagtcttttccggagtatccgtctttgtcaatggcgacttttcccgctccgcttccgatcgtgccttcataaaattgatcaaaagcccagtttttcggcatcgggtatccgaggttgccgctgaatccggtcgacatgttagccgtaaagctatatttggtcagacctgcttctgacgtccggatacaaatgtttctcggcccgtataccccgatttcatatttcggcgcagttgagaacgcctgcattttcataaaagctgacttgatttcttggaagtaagggatgattttatccgtgacttcataatcatacgcatcaaaatcgacggcaaagtaaatggtcgttcctgacggaaaacctaatcttcgggcggctgatgcagcgctgtacgcatctctcgttccttggtcttttacaaaataagaagattcatagccgccgtcctgataaatcggaaacacgcttaagccggcattgaaaatcgcggaaagttcttttgacgttaacgctttcgatgtcagtccgctgctagtccgcacattcccggtcagatatcttcccacgatcttatagccattctcacgcaaagttttagccgtatctgccgtcaaaatggcagcggtgtcacaagctgaagcagcccgcgttgtgtcgcctgagcttgataataaagctttaatcgtcggcatgtccgcataacctgtctgcggcaggcacataaattcttggaaagctttcactgccgatacaactccgacgccgtattttccgtcgaattcaccggggtcaaatgatttcccattacagtaaagcgcgtattgaacaatcaaaacaaagcctgtccgtgaatcgccgggagtcaaggtaggacataagctggtcgttccgttcccgaaaaatccattggcgacgcttgtgctcatgccttcttctttttgcagagcatagatgagggccttgtttgtatcgcgggcatataagccgtcacaaggcatcaagccgatgtagtcattgtaatcccggttcaggttctgctggatttggcggattcttttgtcgcctcccgctactaaccgaaaagcgctcatatccagcaaagccttcataatgagtgccgtgacaatgccgtcttgcttagtaagtccggccgctttttgaaactcttttacagcgctttcggtattttcatagaaaacgccagaaaatccgcccgggttaaaccctttacaccacagcgccccctgcagaatgtaattcatgtttgtcggcttagaatcgggagcctgctttttcaacggtttaaacaatctttgtgtcgtcggtccgaagttatcggctggttctgaaataccaagctcaatttgaagcgcccgtgtcagaccgtaaatggtatcccagcctgtttttccgttttccggcaccttgttgtacccgtgtctgcctttgtacgtctcattcagccattgttgtgtttccaggaccatttcgtccattgcaatccctccattacgtgtagtgtgcgttcattcataggtggcaaacgtatgacagtttgtcatgggtgcaggagtttgtccgaggacagccccatcatacaaacgccgatagagaggcattgataggaaaagatctctctatgacaattgatacaaaaacagcaaaatggatagcgctttaaagtaactttatcacttaatcaaaaataacaagaatcataagtagtagtcatatagtcattttcagggctgttttcatctctccctgcagtcaaaatggttagttggacggatttatgattagctatattgtcattaacataaatagggtaaatagttacaggaaggaaggattttctcgatgaaaagcaaaaagatttttaagtcgctcatcattatttttactcttttaatcagcggaattggttttatgggtttttcttctccgcaaaaagcagaggctaaagactggcttcatacttataaaagcgggtatttcactaactatgtgatcaatacatatcatcctaaattcactaagacgacaaaaaagtacagcttgagagccgtgacttttaaatccaacagtaaagggaagggcacgtataaaatatacgttcaaaagcaagtcaacggcaaaggtgcctggaaaacaatcaaaaccgccaatgcaaagaaaaatggaacgacttattttgaaacacctttgttaaaaaaaggagattcatacagatttaaaatggtcaatcaaggttcgaaaaaacgtgtcaattatagtgcgagttggattgtattcgcttcataattttgattttcagcttataatgttttagctgccgcagctgcggcagctttttattttctccggagctcaaccgccagggagaccgcatctgtctcttcgggcgtacgtttgtattcaccgcatcattctggattatgcggaaaggtacatcgtttcaatgaaaagccgatcccgggtccttttgatttgtttgaaaatgttctgatataaaaaaggcgtgccgcggtgtaaaatggctatattgataaaaatggaggttgagatggatcaagattatatgactgagcttgtctcagtccagctgaagaaaatccggtcggagagaggctacacacaggagaaaatggcggatgtgatcggcctttctaaaaagtcgctggtgcagattgagaaagggcgggcgcttgcggaatggccgcacgttgtggcggtttgcgcgcttttcagatcaagtgaaacactgcaatccgtattaggagatgatccgctggaggtcattgaaacggttgctcaccgcacaattgacaggccgaaggggaagacgatgggcggcaaggtgtggtggaaagccatcgagaaaaaaggcgagttccgcttgcagcagcatttgatttcccatcattaccgcatccttgattcttatgatgatctgtggttcagcagttttgaaaaggcagaagctttggagcggcttgatgagctgtttttggaggcggaggaagcgaagcgctgacgcacctccggttgatgtattttctgacaagtgagaaaatatgtataaattccagccaaaggagagattcgaatgaagcctgaagatatcgtccgaagcggcccgaatcagtacatatgcaaggaaggaatcgcaaaagaacttccggggctgctggagacattcagaaaacccgttattgtgaccggaatcaaatcctatcaggcgttctccgattacggcggcggttcttcctgggatgtgattcagcacaaaggatactgttcacctgaggcggtgcgtaaggtctgcgggcaggcggaagacgcggatgtgatcatcggtatcggaggcggcacgattttggatttggcaaaagcggcggcagaccggcttgatattgaggctgtgatgcttccttccattgcggggacgtgtgcggcaagtacgccgttgagtgtcatatatgatgagagcggcaattttatcagagttgattatcacaagcgttcaagctatttgacgcttgttgatccgctgtttttgctttcctctcccattgaatatatgaaaagcgggatcggtgatacgctggcgaaatggtatgaggccgaggcggtcatcagaaatacggaggaagcgccgcctctgatggcgcaggcggggctgagacaggcggaatatatgcgtaatctgttattgcgttacagtgaagccgccgtcgtaagcatggagaaaggcgagctgtccgtgccgttcatccatacggcggaaacgatcattatgcttgcgagaacggtcggcgggtatggcggccgtttgtgcaggatggcaggggcgcatgcggtccacaacggcctcagttttcttcaggagacacatcaggtgctgcacggccagaaggttgcttacggcatattggtgcagctcgcgcttgagaatcggagacatgagattgaagagctgcttccgttttaccgccggctcggtttccccgtcagtctctgtgctctcggcatccttgacaaccatgaggaagcaaagcgccgcatcgcttctcacgcctgccgggcggaagaatcgttatgcttaatggggcaatattgcgggaaggacgtgtcagcggcgattgaatcgctcgaatcagcacaaaagacaggatagagcttgtaatctgtcttgtctttattttttgaatatttccgttataatgagtggggtatagaaagggaggggccaaaggacatgtatcaggcgaagaagatgttgttattaggatcaggcgagctggggaaagaagtcgtcattgaagcgcagcggctcggggttgtcactgtagccgttgacagctatgagcatgctcccgccatgcaggccgcacacaaaagctatgtgattgatatgcttgataaagcgcaggtcagagaagtcattgagaaagaaaaaccggacttaatcgtgccggaagtggaagccattgcgacggatgagctgctgaagctcgaggaagaagggtttcacgtcattccgaatgcgcgtgcggcaaagctgacgatggaccgtgaaggcatcagacggcttgcagcagagacgcttcatcttccgactgccggctatgaattcgcgaatacatacgaagaatttaaagaagcggcggaaacaatcggctttccgtgcgtggtaaagccgctgatgagctcttccggaaaagggcaaagcgtgtgccgctcggcttccgggctgaaaagctgctgggacatggcaatggaaggcggccgggtgaaaaacggccgggtcatcgttgaggaattcattccgtttgaatcagaaatcactcttctgacagtgcgcgcggcgaacggtacgtccttttgcgcgccgatcggacatgaacaaaaagacggtgactatattgaatcatggcagcctcatcatatgacggaacagcagattgaagaggcgaaacacattgcgaaaagcataacggatgagctcggcggatacggtttgttcggggtggagcttttccttactgaagataaagtatatttcagcgaggtgtctccccgtccgcatgatacggggctcgtaacgcttgtgacgcaaaatttgtcagagtttgcgctgcatgtccgcgcggtcttgggattcccgattccggaaatcattcagctgtcgccgggggcaagccgtccgctgaaggcgcccaaagagcttgctgattatgcggttgaaggtttggagaaagctttggcggtaaaaagcactcaggtccgcgtattcggtaaacccgtcacgaaagtcggacgccgtatggcggttgcgctttctgcagccgagaccgttgaagaggccagagaaagagcggccgaagcactcagtcatttatcaattacataaaatgatcttaaaaggcgtttttaccgtaatggtaaggcgccttttttgtttggacagactatatactggaaaacggggttgtgagataatgtatgaggccgttttgtgccggttttttaattcttgaaactttttatgtccgcaatcgttatatgtaatgttctcatttcacggagaaggaaataacaatacatcatacggcttttcattcatcaagaacggacaatccggatcgcagcatggaatatttaagcagggtaatccggaatagaggaaaccatgattgcttaccttaatatgaacggcgaaaaaacaaaaatcaccagattagattgttcaaataacaccaaatgctgtataataaaagaatttgaatgatagcattgaaaggatttcattttatgtttccgtaaaatggagtctttatgcatacgcagtccgatttgatatggttttaattggaggtttgtgtaaactgtgaattatatacctagtatgattacaattggaaattttatttgcgggctcttatcgattcattcccttttgtatcataatatacactctgcggtgatctttattttcaccgggatgtttcttgatttctttgacggtttggccgcccgtaagctgaacgcggtatcggagatgggaagggagcttgactcttttgctgatctcgtgacgttcggcgtagcgccgtccatgctcgcttacagtgtttcactatatacgcttccgttcatcggaattttaatcgcgctttcctacagcatctgcgggatgatccgtctttccagatttaatattgaacaaagcaagctgccgacgtttatcgggatgccgattccgtttgcgggtatgtgtcttgtcattttgagctttatcaataacgcttttcttctgggggcgggaacgatcgcgctcggttatttaatggtcagcaacattaaatttccgcactttaaaaaacaggcgcctgaaaacctggagagcagaagatggaattagttcagcaattaatatccgattacggatatatcgcgatttttcttatgctgacactcggtattatcggattgcctattccggatgaagtcatgatgacgcttgtgggctacttcgctcatttaaacgtgctgaattacgggctctccattctgatcagctttatcggagcgctccttgggatgattatcagctacttcatcggcagaaaagccggccggccgtttattaataagttcgggaaatgggtcggcctgaaggaaaagaggatggagaaagtagacaggtggatgaagaagtacgggccgtacaccattattttaggttatttcatccccggcatcagacacgtgacctgctacttttccggaatcggcagaatggaattcaaaacctacttatgcttcgccgccatcggagcgtttttatggtgttttatttttattactataggaaaattcataggagtaatcaatgtttaatactgccgctaaagttctttaccgttcattgattgaactgactaataatcgattgacgtcttatctcattaaaaacttctgtgaatcgaaactgagcaagccgatgattccgctgttttccaaacactatcgcattaactggaatgaaacggaacgcacggcttctgactttgattcactggcgtcatttttcattcgtgatattaatttgaatctccgccccgtggcaaaagagaagaacgccatcgtcagcccggtggacggcgtcgttcagacggtgggcatgattaatcccaatcaaactttcatggtaaaagggaaggattattcgttcgccgaactgacggggtttaaaagcgccgatcacaagtataacggcgggtgttttgccgtgctttacctgagcccgagacattaccaccgcttccattctcccgtcagctgcacgtataaaaagctggccgagctggggaaacgctcctatcccgttaatacgatggggttaaagtacgggaaagatgtgctctcaaaaaattaccgttatgtgtacgagctgacccgtgctgatcagcagatgctcatgattccggtaggtgcgatgaatattaactcgatcgttcagacaaacaccggaaaccggcttgagacgggggaagagcttggctatttttcatttggatcgaccgttattttagtattcgagaaagatatgtttaccccttcggataacctgactgaaggccgtgaattacaggtcggtcagatcatcggttatgcggagtcacaggaggaggcgtccgctttataaaagctgctcctcttttttatatggtgtaaggaagtgaactttatggaagaaaaggatttgggaaagctgatcgaacagtatcggcatacaggcgatcagcaaattcttgaagcggtgcgggatgcatgccggcctgtcgttgaggcgctcatctcagaactggctgaagacagcgcggatcttctgcgggcaaaaggccgtgaccgttttccgtttattatcggcaagtatcagaccgcggccggcctttcgcttgagacctttttgcgcaatacgtatcggttttattttcagcaggttttaaaaggcgaagcgtgactggaagaaagagtacggacggaaatgttcatctttcgcccgttttcctgtatgatatagtatagtgtgcgtgatcattaatataattgaacagggtgtataaatcatggaaaaacaatatagagttttactttattataaatatgtaaagattgatgagcctgaagagttcacggctcagcatttgaagttttgtaaggagctcggtctgttaggccgtattttgatttctgaggaaggcattaacggcacggtgtccggaacggttgaacagacggaacaatacatgaatgcgctgaaagctgatccgcgttttgccgacatgccgattaaaattgacgaggctgacggccatgcattccgcaaaatgtttgtgcgccataaaaaagagctggtgacgcttcgtctcgaagatgatgttgatccgaatgtcacgacgggcaagcatttgaaaccgaaagacttttatgagcaaatgcaggatcctgacacgatcgtgatcgacgccagaaacgactatgagtatgacctcggtcatttccgcggagcggtcagacctgatattgaggcgttccgtgagctgccggactggattgaagaacacaaagacatgcttgaaggcaaaaaaatcctcacgtactgcacaggcggcgtacgctgtgagaaattttccggctggctgctgaagcagggatttgaagacgtgtcccagcttgacggcggtatcgtcacttacggtaaagatcctgaagtgcaagggcagctgtgggacggacagtgctatgtgtttgacgaaagaatcagcgtaccggtcaaccgcgtagagcacgttatcatcggaaaagattatttcacgggcgagccgtgcgagcgttatgtgaactgcgcaaatccggcatgtaataaaaaaatgatctgcacacctgagaatgaatacaaatacatgcgcagctgcagtcacgaatgccgtacgaacgaacgaaacatgtatgtgaaagagcacgaaatgactcaggaagaaatcaatgaacgccttgctttgattgaaaaagaggatcatgcggcgattgattaatagaaaagaccaccaatgaggtggtcttttttgtgtttacatactttctgtccgggcggtctgatctgccgtgacgggtcctttatatgtgaaggctttttcccatttggatacgacgatgcaggcgaccgcatggccgggcacgttgacaccggttcgcgccatgtccatgacgcggtcgacaccggcaatgatggcgacgccttccgcggggagaccgacggcattcgctgtcgccagaagcacgacgagtgagcctgacgggacggcggcaatgcctttgcttgtcatgacgagcacaagcatcatcagaagctgctgagaaagcggcatctccacatgaaacgcctgcgccaggaaaatacaggacaccgataaatagaggcttgaaccgtcacagttaagcgataaacctgacggaaccacaaaggagacgacccgcttcggacagccgtatttctccatccgatccatcagctgaggcagaatggtttctgtgcttgtcgtggagaaagcgatcaaaaacagatcccaaatcattttcagcacttcaaagtacttgattttaaagataagccccacgatcggaaacagaacgaagaggatcaggaacagcccgagaaacacagtgccgatcagcttcagcatcgggagcagaagcgcgattccgaattgcccgacggaggcggccatcagggcgagaacgccgatcggagcggtgaccatcaccatctgcgtcagcttgaacataatatttgccgtggattcgaagaaactcatgacaggtgcggaggctttgccgatgccggctgcggcaacaccgaataaaatcgcgaaaaaaatgacggcgagaagatcatttttcgccataacgtcaatgatgttaacggggataatatcaagaagcatttgtttcagatcgactactttttccgtatagccggaaagctcgtgaatgtcttttttagcaagatgagagaggttaagtccgactcccggcttcagcacgttcgccaataacagaccgagcgccagaacgagcgtcgtaatcacttcaaaccaaataatcgttttgatgccgagactgcccatttttttcatactgccgctgccggcggctccgataacaatggtcgaaaacacgatcggcacgacaatcattttaatcaggcggataaatccgtctcctacaggccgcagcgccatcccgaaatccgggaagaaatggccgatcaatgctccgatggctaaagcgatcaaaatctggaatgcgataaattttttcaagcgaatcccccttttacttgcgcatttcttacgtaattcgtgaagcaggcggcaaccaccttcctgtccgccataaatttgtcacatgattgactgtgcgaaaggaaggattgctttacattatgtaagcgcaatcattgaatatgacagaaagtcctcattgaaaaaaatgaaggagcataagaataaagaaagatttccgctgaaaatattaaaaattttgataattatcctcttataagtggtatatttgatatgatatggtcaactgcattctcatatatctgtgcatacaagattcgggacagaaaaaacatgcagcccagaaaagactgaaaatttgaacaattagaagaaaggtgtgcttttgttgaatcaactgattgaaagacgtaaggtcacagctagaaaggaaaaaccggattccgcttcattgggatttggcaagtacttcacagattacatgtttgtcatggattacgaagaggggagagggtggcatgatccgagaatcacaccttatgaaccggtccatctggatccttccgcatcggttttccattacgggcaggccgtatttgaagggctgaaggcttacaggtcagaagacggacgggtgttgatgttccgtcctgaccaaaatataaaacggctgaataaatcgttacggcggatgagcatgccacctcttgacgagaagctggcgctggaagcattgatacaattggtggagctggagcaggaatggataccgatagaaaaaggaacctctttatatatccgtccgtttgtgattgcgactgagccttctttaggcgtccggccttcaaagcgttacaagttcatggttgttttgacgccggtcggttcgtattacggcgatcagctgaaaccgatccgtatttatgtggaggatgagtatgtgcgcgccgtcaccggcggagtgggcgacgtcaaaacgtccggaaattatgcggccagcttacaggctcagcggaaagccgaagaactggggtatgatcaggtgctttggctcgacggagtggaaaagaaatatgccgaagaggtaggcagtatgaatatctttttcatcataaacggagaggccgtaacgccggcgttaaacggaagcattctcgggggcatcacacgcgcatctgtgatagagctgttaaaaagctggggcatccgtgtcagggaagaacaggtcgccattgatgacatctatgaggctgcaatgagaggcgaggtgtcggaggtattcggtacgggaaccgcggccgtcatctcgccggtcggcgcgctgcacattcacggagaaacgattgagctgaataacggtttgatcggtgaagtgtcagaaaagctctatgaaacgattgccggcatccaagtcgggaaggtgcgggattcgttcagatgggtcgttgaagtataaatgaaaaaagaacccttgcgccgcagggttctttttttggttattgggattttacggcttgcacgcgggctctgcttttccggtttttcaagtaataagcggtgtagcaaacggccataaatacaattccgcaataaagggcgatggcctggttcggatcaaaagcgatgccgatacaggaggcgaggcataggagaaaggccgctatcggtacggccggatatcccggcgtcctgtatttcaagtctgaaagctggtgcccttctttaagaaatcgtcttctgaacaaaaattgtgatgcggcgatgctcatccacacagccactaccgcaaatcctgagacggagacgagaacaagatagactgtatccgctgcaaatacgcttgacaacaacgacagaatgccgccgatcatactgaagatcagagcgttaaaaggaatgcctttagaggtcagcctggcaaaggcgggatgaagctccccttctttagacagggaccacagcatacgtgatgacgcgtacagccctgaattggccgcggacagaagcgccgttaaaatgacgaaattcatcagatcggccgcataaggcacgccgactctgtcaaataccgtgacaaacgggctttcaatcacaccggcttccttgatggagatcatccctgacagcacaaaaatcgttccgataaagaaaagcgccagccgccagactgtggtcttaatggcgcgcggaacggttttttccggatcggcgctttccccggcggcgattccgatcaattccgtccctgaaaaagcgaagtttactgaaagcatcgtcatcagtatcgggaaaaagccatttggaaaaaggctgccgccatccgtaaagttcgacagcataggtgcggcctcaccgcttttcatcgggacgaggccgaacatcgccgctccgcccaataaaataaacagtaagatggctaagactttaatgcttgagaaccaaaactccgattcagcaaaaaatttcacggagaaggcgtttaataaaaagatgaaaagagcgaataccgcactccacatccaaactgaagtatgcgggaaccagcgctgcatgaagagcccggccgccgtgaattcagagcccagcgccaccgcccacgtcagccagtacagccatgcgaccgtaaagcccgtcgcgggcccgatataggtcttcgcataggtgtggaatgcgcccgtcaccggcatggccactgacagttcaccgaggcaaagcatgacaagatagacgatgcccgcgcccaaaaggtaagcgaaaatggtgcccgccggacccgcctgatgaatggtatacccagagcttaaaaacagccccgttccgatcacacctccgagtgatagcataaagaggtgtctgcttttcatacttctctgaaaattcgtctcgttcttgttgttcattgttttccaactttctgcgagggccgttctaataaaaaatctcatgccggcgaacggcacgagattccggcgaaccggctttttgaatagaatatacaaactattccgattagtcaagttgtttttaaggtcttggcccaatcggcaatggcttggatgtccgcgggtttcgtccggcagcagcctccgatcaggctcacgccgttttcgtaccagctttgcgcgctttttccgaaatggttttcgcacgctgcgcctttccaggtttttgtcaccgggtcatattgttcgccggagttcggataggcgataatcggtttggatgctgcccgtttgatttcttctatcagcggcggaatatattcgatcggtgtgcagttgatgccgatcgctgcgatttggctgcaggagtcaagcagggccgcgcattcggaaataggcgtgccttcgctgatatgccgcccgtctttggcgctgaagctgatccatgcataagtgccggggaattcctccagcagccttgtgatcgcttttgcttctgacagggacggaatggtctcacaggccaaaagatcggcgccggattctatgagggctttcatccgggggcggtgaaagctgatcagctcatcttccgtcagtccgtaatgcccgcgatattcagagccgtcagcgaggctcgcgccgtaaggtccgatagaagcggcgaccaaaggtttaggccggtgtaaacggttttcttcatgcgcccaaaattcatcgcgtgcttgtgcggcaagttcaacagatgtctgaatgagacgtatcgcatcggtttccgggatgccgcgcgctgcaaatccttcaattgtcgattgataactggcggtgatcgcgcaatcagcgccggcggcaaaatattctgcatgcacctgtttgatcagttcgggtctctccaaaagaattttggccgaccacagatcgtcatgtaaatcacagcccatccgctcaagctcggttgccatcgcgccgtctatgatcataaccgggtattcatttaatatttgtgtaatgggattcataggccttcctttctgactttactgaaaatatataaaaagggtaatggacgctattctctttgtcaatgaaccggcggaaaaaaggtgttcaggacgctgcctgaacaccttttgtttaggaaatatgtttgcctttcgcgcttttcgcgatatctgaatactcccagcattcgatcccgtcgtcatcagggagcacatctctgtaaaagacggggtcctttccggctttcttttgccgggcataatcgctcaaagcggcaaatgcttttttcgacagaaggaaaattgcgattaagttcacgaccaccattaagcccatgaacaagtcagccatatcccacacaagctggactttggaaatacagccgaacagtaccattccgagcacgcagatgcggtaaatgaacagccactttttgttctggcttaaaaatccgatattggtttctccgtaataatagttgcccatcagagcgctgaagccgaacaaaagcattaagacggcaaggaaacctgacgcccacgcgccgacatggtcgctcaaggcggcctgagaaagcgcgatgccgctcagtcccggctggtgataagcgtctgaaaataaaatgataagcgccgtgcttgtacaaatgacgagcgtatccgtcaggacgccgaatgcctgaatgagcccctgtttcaccgggtggctcgtcgtagctgtcgccgccgcgttcggagcgcttcccatacccgcttcatttgagaaaatcccgcgtcttacaccttgcatcaaggccgcacctaaagcgccgcccgctgcctgatcaatgccgaacgcattttttacgattagcgacagaacgccgggcaattgggtgatattcgtcagaatgacaaagaaagcgacaccgatatataaaacggccaagacgactacgatgtattccgccattttcgcaattcgtttgacgccgccgaagattacgccgccaaaaaccaagattaaaataatgcccaatgtaagccggctggtgccgaacgcgttttgaaaggcgacgctgatcgtattggattgaacggaattaaaaacaaccccgaatgacagtgtgattaatacggcgaacagcgcgcccatccagcgtttcttcaggcctttttccatgtaataggccgggccgccgcggaatccgttttgatcttttactttataaatttgggccagcgtgctttcaacaaagcttgaagccgaaccgatgactgcgataatccacatccagaaaatagcgcccggaccgccgagtgcgatcgcaatggcgattccggtaatattccctgttccgacacgcgccgccatactgatgcaaaatgcctgaaacggggaaatgctgttttttgtccgggcggccgcgccttccttcaaaacccggatcatttccttcagcatgcggacttgcagaccctttgatctgaacgtaaaaaacagtcccagagaaagaagcagtacgattaacagttttgaccataaaaaatcatttgccgagccgattacattttcaaggaattcctgcatccaatcacctcttggttcgtttgattaaaaaatactgagctcccactcctgtgcgatatgtttcagcagcatgccgccggtcaggctgttgccgtattcatcaatggccggaccgtaaatgccgatgccgcatccgttatgaaaaggctgctctcttctggcgcttgggggaaccaatgccatgatgccgccggataccccgcttttggccgggacgccgacgaaagccgcatatttgcctgacgcattgtacatcccgcacgtcagcatcagggctttggcgagtttcgcgacatctttcggaatgacctgttcccgtcggatcggatggtagccgtcatgggcaagtatcaatccgattaaagcgatgtcctcggttgtaccctccatggcgcactgctttaaatacacttcaagcgtttcttccacatccgcctcgagaaagttcgtttcttttaaatagtaggcgagcgctctgttccgatgcgcggtctgccattcagaacggaagacctcctcgtgaatgtgaggccgttttcctattaatttttcaaaaacggaaaagagatattctaatttattatgcgccgtttcacccggaagcagcgaggcgacggtaatggcgccggcattgatcatcggattgaagggcttcccgggtttatggatttcaagccggatgatagaattaaacgcatcacccgtcggctccacgtccacacgatcgagcacataaggaatgcctctggacatgcatgcggcaataaagctgatgacttttgagatgctctgcaatgtgaacggcacattccattcaccggcatgaatcattgagccatccggctctaatatgcaaatgcccagctgagagtcgttgatttctccgagggcgggtatataatttgcgctttttccattgacggaaaacggtcggtaatgctcgacccaatcttgtaaaagtgaagccagttcctctttttcaaggcgctctctgaccatatctttcataacattcctcctctattgcaagcctgtccgaagcggaaaccggtcttggaaaacgttttcaaaaatagcgtgttccatgttaatgtataatgacatctacagaatcatacaaaatacgacaaaatcattcttaaaataagccgatagatttataaatcagccggagtgtcccgccattcgggtctaaagaaatttgcggactgtatcggtcttgttcaaaatagacagaagaaggaagtgattatgatcaggctcgactatttactgaaaaaagacggctatcttttcgctcttatgctgatcaccgtgccgctggcgggggaactgaaattttaccccctgaatgaggtatatcggatcagcttcggcgccccggcttttttcttttttcttctgctgcttcggcatgtgccggcggtattgtcagggctgttgacaggtgcagccgttgtgggattccggatcggcctggcgtgctgggggggagagcatgccggatttacggcggcttttttcagccaatatcccagtttctttttttactttacatatgcctgtttgttttatgtgctgaaggtcaggcttttttgggatcggccgctcatgatcgggtttctcggttttctcattgaaatggcgtccgatgccgttgaaatgacggttcagttttccggcggcaagcagattatgatgccggacaagctggcggatattgcggttatcgctgtttctcacacatttattgtgctgagttttttcaacgtgatgaagctgcacgaatctcaggtcagggaaaaacaaacgagaaagcagcatgagcacatgctgatgattgtgtctaacttatatgaagaaacgattcatctgaaaaaaacgctgaaaacgacggagcatgtgacgaaagaatcctatcagctgtatcgggaaatgagcgggaacgaccgggagctcgggagccgaatgctgcgccttgcgggagaaattcatgaagtgaaaaaagacaatcagcgaatattcgccggcctgtcgaagctgatttcaaatgagagattccgggattacatgaatgccgccgatctggtcggcctcgttatccgcatcaatgaaaaatacgccgaatctttaggcaaagacattcaattcaaaaacgtgattgaaggagaacaccccgattatcacgtctttaccgtcctgtcgatcttaaataacctgaccgccaatgccgtcgaagccatgggtgacaggggtgagatccgcctcgcgctgcgcagggcggagggggggatggccgaatttgaggcggaagatgacggtcccggcattccggaaaaaatcggagaggtcgtttatgatcccggttttacgtccaaatacgatgaattcggcgcaccttcaacgggcatcgggctttcatacgtgaaggaaatcgtaaccgaacttgacggagacatttcctttcataacaagccaaaaggcgtcatatttacgattaagctgccggtgaagcatttgattgcagaaaggatgaactcataatatgcgtttttttatagctgatgatgaccgggcgatccgttccattttaaaacagatgatcgaggacgaggacttaggagaagtcgtcggtgaggcagaggacggaagccagattgaagggcattatctccatttcaaacaagtcgatattttattaattgatctgctgatgccgggccgggacgggattgagacgatacggcatcttcagggggcgtacaacggaaaagcagtgatgatatcgcaggtggaggcaaaggaaatggtgggagaagcttattctctcggcatcgaatactttatccataaaccgatcaacaaaatcgagatcgtcaccgttttgcgaaaagtaaaagagcggattgaactggaaacctcgatcggcgacatccaacactcgttaagccgtcttattcagcggaatgagccgaaaaaaagcgggccggggggatgcacgagaaatcaatcaaagaaacaggaaaatttcttttgtcggaattaggcatcgtgggagaaagcggggcgcatgacctcatggccgtccttcactatttatttgaggatgaacaggcggaaagaaacatcccgtctttaaagcagatgtttacaaacgccgccatccggaagctgggacctgcggcggcacaagccgaggttaacagagaaatcaaagcctcggaacagcggatcagaagggccgtcattcattcgttaaaccatttcgcttcattgggcacaactgatttttcaaaccccaaatttgaatattacgcctcgaaattctttgatttccccgctgtcagcaagagaatgaaagaaatgcaggccaaggaaaccgtgccgctttctccggttaaagtgaatatgaaaaaattcattcacgtcttttttttggaggcgaaagatttacgcgaaggatcaaaatttgtcagcggaggcagccggtaagctgataaatagggtttacgtatataaggtttttgtgtaaaataatgttaactaagaaggaacggagggatcctgatggctgatcaaattccggttttcgcactaatgaaatagtgtcaaagtctctgccttgagcgcggaggaaaccgggattgtctgcctgaataaggaacctgacagtaatagtgagggggcggcgattatgccgccctctttttggcgtcttcacacatctctttcttctccgcctaaaggcgaagctctgtgtcagtcaataagggaaatggggaaacaagatgacaaaaaaacaaagggaaatagaatccgttttgaacatcgcaaaggaaaatggcttacggttaaaatatgaaggggcggacataaatgaaacgggtatggacttccaagtcgtatttgctgaagatgacagcggcgtgacatgggtgctccgaaagccgcgccgtcccgatgttatcgaaagagcggctgcagaaagcgatgttctcgcgtttctccgcagccatgccgctgtatcagtccccgattggcggattcatacaccggaactgatcgcttatccgaaactggacggaataccggctgccgcaattgatctggataagaaacagtatgtctggaatatggaacacgagccgccttcagacggttttgtcggctcgcttgccgcagcattagccgggctgcacggggcagacacggatgcggcctccagatccggaattgaaatcataaaaccggatgacgtcaggcaaagggcggcggaatcaatggatcatataaaaaaagaaatcggggtttcagaacagctttggaaaagatggcaaacgtggataaatgacagctcgtactggcctgatttttctgcgctgatccatggcgacttgcatcctccgcatattttgatcggcgaaaatcagcgtgtgacgggtctcctcgattggacggaggcaaaggttgccgatccggccaaggattttgtcctttatcaagtgatattaggagaaaaagaaacaaaacggctgatgaagagctacgaagctgagggcgggcgcgtctggccgaaaatgcaggagcatgtgtcagaatggcaggccgcttaccctgtggaaacggcgaagttcgcgcttcagacggggcaagaggagcatatgcaaatggcgcgggacatgctcggactgtccgatccgaaaggttattgacttccgccggatgacagcgtatgatacattttaaaatcatagaacggatgaacaatgctgaggaagagtaagtacgcatcagcgcgcggggttcagagagtcggtggccgctgtgaaccgatccccgtccggtgccgaatgggcttctgaattgctgcgctgaaataacagtaggcggtgccgggattctttccccgttatcaagataggagtattgaaaccctgagtttctgtactttttgagagaatggctcttcagccgttaataaaggtggcaccgcgaaaacctcgtcctttgatggacggggtttttttgcgttgttaaggaggtgatggccatggaaagtgactggagacggacagacaatcaaaaaaggagggatattcatggtgatcgcaaccgacgatcttgagctcacatgtccgcattgtgaaggaaccggcgaggagaaagaagggacgccctgtccgaagtgcagcgcgaagggcgtcatattgaccgctcaaggaaacacgctgctgcattttatcagaaagcatatggatcagtgaaatcaaacgaatatgtaaagaaacagcacaaaacaaaaaagcttgtagaaaaaacatcgttttctctacaagctgctttttcattcttcaaaataaggattcacatggatgagcacttcttcaacatctgaaaagtgtcttttgatttcatttcggatttcccgggctatatcgtgtccctgcttaatcgtcaaatcatgatccaaagataaccggacatcaagcaatttatagtggccgtgttctcttgctcggattttatcgagccgtttgacttgagggcaatccaaaataaccgctttatattcctctatcagttcgggatcaacacttttttccatgagaacgtcaacagacggcctgattaattccattgaaatcttaaaaatgaggtacgccacgatgacactggcaattgcatcggcgtacaacagataggaccatccgcgtgtgttcccgataatcgccaataggacgccgataaaagcggcaagagaggcaacgatatcgcctttatgatcgtatgcaatcgctataatcgctttactgttccatttttccccttgtttgatcgaataacgatataagatctgcttagccacgtaggatatcagagccgcaaacaatgcgctgtattgcgggatgcttggaccttcaacaaaggacgaaatcgcttctatcagaatatacacggaaacgagcactaatatgattcctacaatcgcttcgctgatgatctcagctttgccatgcccgaaaggatggtcttgatcgggcggcttattagaaatgccgatgacggccaggacagcaattgaagccacgacatccgctgcagaatgtataccgtcggcaaaaactgcttcactatcgcctatcagtccaaaaaagatctttcctgccattaagatcagattggctatcaatgcaatcaaagcaacttttttgcttatttgttctctttcacttgtcattttttcctcctataaaactgcacaaaaaaataggagcgctcttgattcgctctccgtatcctttcttgtgtaatcactttgcttatcatatcaattcagtttcgagtgggtctatagcaaggttgtttcctgtttactaataaataaggtgacagaaaaaaagttggagcagggctaaatagtacataaacaaaattgcgctgaatttaaaaatgaactgttgacatttgagtatttatcttttattattatcctgaattcaagatattttaattcgagacaatttaattagagtgcaggataagaacctgccgatcgttttgttttttgatcatacattatttgattttttataccataatatctcgaattcgagataaaggggagtgcgagagaaatggctgaatttgtacagctggtgaatgaaagaagatctgcaagcaactttcttccagaacatccaatcacaagagatgagctcaacgaaatgtttgaattggttgcgttggctccatcagcttttaatttgcagcatacaaaatatgtgacggttcttgacccggaggtaaaagaaaagctgaagcaggccgcaaacggacaatataaagtgttcagctcatcagcggttcttttggttttaggggataagcaggcatatcagcaagcggctgacatctatgaaggattgaaggtgctgggggtattaaataaacaagagtatgatcacatggttcaaaacaccgtttcgttttatgaaaacaggggagaactgtttaagagagatgaggcgataagaaatgcttcactttctgcgatgatgtttatgctgagtgctaaggaaaaaggctgggacacctgtccgatgatagggtttgatcctgaagccgtgaaacagattttgaatatagatgatcaatttgaggtcgtcatgatgattacaatcgggaaagaaaaaatagaaagcagaaggccgcgcggctaccgaaagcctgtgaatgagtttgtggagtatatttaaatatttataaaggagcgcataaaaatggctaaaaaaacgatgggaatccatcatattacagcaattgtcggccaccctcaagagaatgctgatttctacgctggagtgctggggctgcgattggtcaagcaaacggtcaattttgatgatccgggtacgtatcacctttatttcggggatgaaggcgggaagccgggaacaatcatcacattctttccgtgggcggacgcccgtcaaggcatcattggagacggacaggttggcgtgacatcttacgtcgtgccgagaggtgctatggcgttttgggaaaagagacttgaaaagttcaacgtgccatacacaaaaatcgagcgttttggggaacaatatatagaatttgatgacccgcatggcctgcatttagaaatcgtggaaagagaagcaggggaggccaatacgtggactttcggagatgtaaccccggatgttgccattaaaggctttggcggtgcaaccctgttatcagcacagcctgaaaaaacaggtgaactgctggaaaacatcatggggcttgagcgagtcggcaaggaaggagacttcgttcgttatcgttctgccggtgatatcgggaatgtgattgatcttaaattaacgccgatcggccgcggacaaatgggtgtcggcacagtgcatcacatcgcttggcgggctcaggatgacgaagatcaattagattggcaaagattcattgctgcgcacggatatggtgtgactcctgttcaggatagaaactattttaatgcggtttacttcagagaacatggggaaatcttatttgagatcgcaactgatccgccgggctttgcccatgatgagtcacaagaaacaatgggcggaaaattgatgctccctgagcagtatgaaccgcaccgggcacaaattgaacaagggctgctgccgtttgaagtaagagaattagattgatttgacacataaaaaataaagaaacatatagtcaattgatgattgctggatggtaccgtccagcaaagaatcagatgaaatcaaagatgaggagagataaaaatggaagatgcaggactattacttattcgaatcatgattggtgtggtgtttctgttttatggatcacaaaaattattcggctggtttggcggatacgggattaaaggaaccggacaatggttcgagtcaattggagttaaaccaggcaatgccgcggccgctttatcaggtctcggggaactcgcaagcggaattttatttattttaggtgtattcctcccgcttggagctgctatcataacgatcattatgttaggtgccattgtaaaagttcatggagcgaaagggtttgcgaacggtgccggcggttttgaatataacgtggtgctgattgcagtctccatcggagttgcactcatcggttcaggagcttacgctttgcatttttaatataagtatctaagaacagttactgaaaagcggtaactgttcttttatttttcaagcacgacgttaaggtgctctgaatcgcaaaaaagcggatatgatcaatataaatgtgtatagtgaatgtacgagtattgatgagcttggtcatgaaagacgagccgatttgaaggagggttttgatgaaagagctgacagacttacattcattagattctatcgagaattttattaagcagcatcaattcagttttatctacatttcaagacctgcctgtacagtatgtcacgctgttctgccgcagctcagaaaagttttggatcagtttccgaatatcaaattggggcataccaacgctgacgaggtagaagaggttgccggcagattttcagtcttcactgtccccgtgcttcttttgttcattgatgggactgagtttctgagagaagcccgctttgttcattttgaacagctcgaaaaaaggctgaaaagggtttatcagttatatcaagatgtataaagcgttactttacaaataaaaagccccctttaaggggctcaggctgtctagaaaatctcgacagcctttatttttcccttaaaatatccattcccctgtcatataataaaagacccgcacaagagacgcttctcaaaatacagccgaattcgttctgtttgaccaactcgttgaagaggatcacctgcttcgaaaaattgatcagtacatagacttctcttttatcgttgaaaaggtcaaaccttactgcaacgaaaataaaggccgcccctcacttgatccgctgatcttattcaaaatgatgttgaaggttgccgcatacccagccaagcaaggctgggcatatgtaaagaaacagcaaaaaacaaaaaagcttgcagaaaaaacatcattttctctacaagctgaaggccgttatccggccttttttacattattcggaccggggttctaaaaaacgggaccctcccaagtcttttctcatcagatagatatggaaaaaatattctccgacggcgatgatgacggcggaaatgagagcggcaaacgccagtcttcctccggaaatgcccatggacagcggcattcccatcagccagacaacaagaaacgcgattccgaaatcagcggacgccgccgtgatattattccatctcggaagcacgtacaggtcgcccgtaaagtaggaaacggctcccagcacaatggtcatcagcagcacgtcaccgaatgtaaagcgaaaacctaagccgagtatcagatacagaataatgatggtcataatgcctttaatggcaagcgctttaatgtgttccattcgaattcctccttatggaaatcatgttagtatgtttcctcataacgtgaaatataaacccttttttcgtgaacatttgttttctggcttttggctgtcatcactgggccgctgctgaatatgatgaaaggagaaaatacgggaggtgtcatgatggcagtcgtaaaagcgtcgagcgccgatgtcgatctaatggcaaggctgctcagggcggaagcggaaggcgaagggaagcagggaatgcttttggtcggcaatgtgggaatcaatcgggtgcgggcgaattgttctgattttaaaggcctgcgcaccatcaggcagatggtgtttcagccgcacgcgtttgaagcggtgactcacggatacttttaccagagaccgcgtgaatccgagcggaggcttgcccgcaggaacattaacggagaacggttttggccggctaagttcagtctgtggtactttaagccgccgggcaactgcccgcagacttggtatggccagccgtttgtcgccagattcagatcccactgcttctatcagccgacaggtgagacgtgcgaaaacgtgtacaatacattttaatcccgggggcaccgttcttaaaatgaacggtgtttttttaatgttttgtgaagaaaaataggaaaaaagtgcgcttgacggatgacaagccaaaaagaaacagagggggttttcttccggcggggcaaggtttgtcgaaacaatgtgaaaaatgtctcccgccgttcatttttcagccttacaaacccttcacacttcttcatagcggtttaacatttcttttttataataagggcgatcaataagacgaaaggggaactgacatgacacatgacggccgtttagatgaatggatcaaggaattggagaacaaaagctttcagaacaatacgtttgaccgccgcgcatttatacagggcgccgggaaaatcgccggtctttccctcgggttagcgatcgcgcaatccatcggcgcgtttgaagtgaatgccgctccgaaattttcaaactatccgttcaccctcggcgtagcttccggcgacccgctgtctgacagcgtcattctctggacgcgtcttgcccctgacccgctgaatgggggcggcatgccgaagcaggccgtgccggtaaaatgggaaatcgccgcagatgaacatttccgtcacatcgtcaaacgcggaacggaaatggccaagccgaatctcggacactccgtccatgtcgaggcggacgggctcaagcccaataaagtgtactattaccggtttaaaagcgggcatgagctcagccccgtcggccggacgaaaacgctgcccgctcccggcgctgacgtatcggccatgacgtttgcatttgcctcatgccagcagtatgaacacggctattatacggcgtataaacatatggcgaaggaaaagcttgatctcgtattccatctcggagattacatttatgaatacggaccgaacgaatatgtgtcaaaaacgggaaatgtcaggacgcacagcagcgccgaagtgtacacactgtcagattaccgcaaccgtcacgcccaataccgctctgatgccaatctgaaagccgcccacgccgcatttccgtgggtcgtgacgtgggacgatcatgaggtggaaaacaattatgccaatgttatccctgaaaaaggccaatccgttgaagcgtttgtgctcaggagggccgcagcttatcaggcttattatgaacacatgccgctcaggcgcatgtcattgccgaacggtcctgatatgcggctgtacaggcaattttcttatggcaatttagcatcgttcaatgtgcttgatacaagacagtacagagatgatcaggccaacggcgacgggaataagccgccttctgatgagtggagagacccgaagcgcacattgatggggacagagcaggagcaatggctcttcggaaatttagccgcctcaaaagcgaagtggaatgtgctggcgcagcaaatctttttcgcgcaatggaatttcggaacaaccgccaatccgatatacagcatggattcatgggacggctacccggctcagcgggagcgggtcatcaattttataaaaagcaaaaacctgaacaatgtcatcgtgctgacgggtgatgttcatgcaagctgggcgtcaaacctgcataccgattttaatcaaacgaattcaaaaattttcggagccgaattcgtcgggacttccattacatctggaggaaacggggcggataaacgggccgatacggatcagatcttaaaacaaaacccgcatattaagtttttcaacgattaccgcggctatgtccgctgtacggtgactcctgcccaatggagagcggattacagagtggtgccgtacgtgacggagccgggggctgaggtatccacgcgggcttcattcatttatcagaaagaccagacggggattcggaaggtctctcaagcggcggttgcaggcggtttaaagcagtcaaacgaggtggaagaggatcgtttcttcgcccataacaatgcgcatgaaaagcaaatgagaaagaaacgggccaaaatctcacaataaggaggcacactcatgttttcaaatatcggcattcccgggttgatcctgattttcgtcatcgctctcatcattttcggaccttcaaaacttccggaaatcggccgtgccgccggccgcacgctgcttgaatttaaaagcgccgcaaaaacattggtctcaaatgaagagccggacaagcagacggctgagaaagacaaaacggcaggctgaatcctgacatgggggcagacgaatccgcttctgcctctttctctataaggaggatgtacgattggataaaaaagaaacccacttgatcgggcatttagaggaagtccggcagcgtctcattaaaatcgttatcgcctttctcgtgttttttatcggcgcctgctggtttgtgcaggatatttatgactggctgatcaaggatttgcatggcaggctggccgttttagggccgagcgagattttatgggtgtatatgatgattgcgggaatatgcgcccttacggcagcgattccggttgcggcctttcagctctggcgttttacggcgccggctttgaccccgttcgaacgccgcgccgctttgctttacattccggggctttcgcttttgtttattatcggaatttccttcgggtattttgtgctgtttccgattgtgctcggatttttaacacaattatccgccggccattttgacatggtatttacggcggacaagtattttacctttatgctgaatcttacattgccgttcggatttttgtttgaaatgcctctggccgtcatgtttctgacacggctcggaatcgtgaatccaacccggctggcaaaggcgcggaagctttcgtattttttgctgatcgtcgtctcggtgctgattacgcctccggattttatgtctgactttctcgtcatgattccgctgctcgtcctctatgaaatcagtgtgacgctgtcccgcatcgtttaccggaagaaatgggccgaggtgtctgccgcttagtgaagctcgcctccgccggtctcaatatcgtcctcatgcgccgcggcggtcaccgcggcgattttgagcgcttttgtcacgagatccaggctgaggctcggcgcagacttctgcaaggtttgctccggaatgtacgggatgtgtataaacccgccgcggatgtgcggatgatggcaggcgatttcatccatcagcccgtaaaagagatgattgcatacaaacgtccccgccgtgtaggatacagccgcgggaatgccttcctttttgatttcctcaacgatccgtttgatcggaaggccggtccaataggccgcgggaccgctttgagaaatgttttccccgacaggctggtttccttcgttatccggtatgcgcgcctcattcagattgatcgcgacccgttccggcgtgatctgcattctgccgcctgcctgtccgacacaaatgataatgtcaggctgatgctttttgaccgcttcgcgcagcacggcaagagacttataaaaaacggtcggcacttgttcggatacgatagaggcagggccttcatgggaaccgtccagccgtttgaccgcttcccatgaaggattgaccgtttccccgccgaaggggtcaaagcctgtcagtaatacttttttctccatataaaaccctccttttctttttaccatactctataatggacatatattcctgccgaagggggaaccatgtcttgaattcgcctctggtgcaataccgatctttatttccggtgctccgcacacatacgatgctcgccagctgctctcaaagcgctcttgccctgccggtttcaaaagcggtcaatgactatcaggaaagcctgtttcagcatggcggaaactgggaagaagccattggacgtacggagcaggcaaggtgtgaatttgcaaaattgatcggcgcccatcctgaagaaatcgccgttttaccttcagtaacggctgctgtctctgccgtcgtttctgctttaccggattgccgaaagaaacaggcggtgtatacggaattggattttccggcgatcgcccacattttgaaggcacagactgagatggagctttcagtcgtgccgtctgaagatggaatgatcccgttagagcggtatgagacgtacatatcggagcagacgcttttcacctgtgtgccccatgtgtcatatacgtcgggttttgtccaggatataaagcgcattgccgagatatccgcaaagaagggatcgcttctttttgtcgatgcttatcaatcggcggggcacatcccgattgatgtaaaagaatggggagttgatatgctggccgcgggtgcgagaaagtatatgctcggcataccgggaacggcgtttctttatgtcagaaaggaacttgccgaacggctgaagccgaaagtcaccggatggttcgggcagcagcgggcgtcgatgccggatttaacccgtttttcttatgcggacggagccaaacgctttgagaccggaaccccggcatttatcagcatatatgcggcacaggcggctttatctctattaaacgatgccggcacagaccgcattcaccaagaagtaaaaaaactcagcgcatttgcgtatgaatacgcttctgaaaaaggactgaatctcacagggccgccgtctgccgatgacagacccggcatgatttccatacgggatgaaaaagcggcggaaacggctgcgctgttgaggcggaaaaacatcgtatgcgcatccagcggacaaatcatccggctggcgcctcatttctataacacagctgacgatctgatctatgcgattgatgaactggctgaagcgcgcggtatataaaaaaacagcagactcacggggagtctgctgttttcttatgaatgattcactttgacccgtttcataaagaaagcgctgatcaagccgataacggcgacaatcatcgcaaagataaaggcgtgctggacgcccgcaatcagcgcgtgagagtatgcggaaggatcattcgggtttttcgcggtgctcatataattcttctggccggcagccatgatgctgaccgccaccgcagtgccgattgcgccggccatctgctggagcgtattcataatggctgttccgtccgggtaaaattccggcggcagctgatttaagccgttcgtttgcgccggcatcatgatcatggaaatgccgatcatcaggcatgtatgaagcgcgacaatcagaagcgccgtagaagcgccgttaatgtttgagaaaaacgaaagcacagttgccgtgatgacaaacccgggaatgacaagccacttcggcccgtatttatcaaacagacgccccgtcaccggagacataaagccgtttaaaataccgcccggcagcaggatgagcccggacgtaaacgccgtcagcatcagtccgctttgtaaatacataggcaataggagcattgtcgataagataaccatcatacagataaacacaatcacgacaccgagaacaaacatcggatagcggaaagcgcgcagattcatcatcggctgcttcattgtcagctgcctgatggaaaataagatgagcgcgatcgcgccgacagtgagcgaaccgataaccgtcgggcttgaccagccgtctgatccttcgcctgcattgctgaatccgaatacgatgccgccgaacccgatcgtagacagaataatggaaagcacgtcaattttcggttttgtaatgtcagacacgttctgcatgtaggcgatgccgaataaaagagccaacacaagaaacggcagggaaatccagaaaatccaatgccagttcaaatgctctagcacaagccctgaaaatgtcggaccgatcgcaggagcgaacataatgacaagcccgatcgtccccatcgccgctccgcgcttatgcggcgggaagatgacgaggattgtattaaacatcagcggcagcagcagcccggttcctaaagcctgcacgattcttgccgccaaaagaaacggaaagctcggcgcaagcgctgcaatcagcgtgccgataatggaaaaagcgagtgaaacgatgaacagctgtctcgtcgtaaaccattgcaaaagcagacccgataccggcacaagaataccgagaacgagcagatagcccgtcgtcagccactggacggtcgcaggagtgatatgtagctccttcatcagatcagtcaaggcgatattcagcgccgtttcactgaacatgccgataaaccctgccgtcagcaaagaaatcatgatcggcatgactttatattgtttggaaggctgagcgttttccaaaatcattctcctctctttctatacgtacatgtctctcgtattttatgtcttcagcaggttggggatttgtttagaaatatggaggatcggcattttgtcttttttggctaaggacacaatgatgccgccttctatcatggcatttaaaacagtgctgatttccgccgctttctcatcagaaaaaccggctgatcttaatttgcccgcgaacagattctcccattcctgataagcgttttgacaggcctgccggagcttttcgctctttaaagcagtctcggcagccagtaaaccgacaggaaacccttcaaaattctccggacatgtgaattggcttgataagtcctgtaaaaacgcttgaatgctttccgccggatcaagatgagcatcaaggctttcttttattttcatacggatataatggctcatttcattgacagcctcaatggcgagctgctctttgccgtccggaaaatgatagtaaagagaacctttcggcgccccgctttctttaataatctgattcagtcccgtgccgtaatacccctgaagctgaaacagcctggttgccgcggcgaggattttttcccgagaatctccatagctcataatgttcccaccttactgatttgtgacaaatttaaaatatagtgactggtctattatcttgatttcgcatgacggtgtcaaggttttttaacggttattttcttcggaagaatgcctgacaagcgcgttgaccggtgagaggaaaatcatcataaataaagaaaaggagagaaaagaatgaaaaaacaattcatgcccttcattacatttatcacggctctgctcttcatcgcggccggctgctcccaatctcctcaaacgaaagaaacaccgccccagatggcagccgcagcctctgcgaaaaaagacggacttccgaatattaaaattcttgccaccggcggcacaattgcaggcgctgctccttcaaagacgtccgctacggagtacagggcgggggcaatcggagttgatgccctgattcaggccgttccggagataaaagaggccgcgcatgtgagcggagaacaggttgtgaatatcggcagccagaatatgaataacgagacactgctgaaacttgcaaaacgggtaaacaagctgctcaagtctgatgatacagacggcattgtcattacacatggaacagacacacttgaggaaaccgcctactttctcaatctgacggtcaagagtgacaaacccgttgttgtcgccgggtcaatgcggccgtccacggcgatcggagcggacgggccgtccaacttatataacgcggtaaaaacagcggctgcgcctgaggcgaaaggcaaggggacgcttgtcgtattaaatgacagaatcgcttcggcgcgttatgtgacaaaaaccaatacaaccgcgaccgacactttcaaatcggaagaaatgggttatatcggaacaattgctgatgacgtctattttaataacatcatcacccgaaagcatacgaaggatacagatttcaagatagataaacttgataaactgccgcaggtcgatattatatacggctatcaaaatgacggaagctatctctttgaagccgccgtaaaatcaggggcgcaaggcattatttttgcaggcccgggaaacggctcaatgtctgatgcggcgctaaaaggcgctgtaaagtcggtcaaaagcgggctggcggtcgtccgctccacaaggacgggaaacggggcggtaacacctaatcgagagtatgaaaaagaccatttgacagcttcaaactctctcaaccctcaaaaagcgcggattcttctcatgctcgcgctgacaaaaacgcaagatcctaagcggattcaaacctatttcaatgagtactaggagtagagaaccgggtgttctctcctttgtcggtatgccgtattaaagcataagcgtgctttcgggaaaggggcgtctttctcatttttccgctcttttttaattgttgaaaacagtaaaaaatacactattttttccttttcttctctaatagaatgaaaactgcaaaaatattacatagcaggaggaaagttcatgaaacatataaaaagcaaaatcctagtcatccttacagtttgtatgctgtccgtcatttccgtatttgccttccagccgaccgtatcgaaagcctcctcagggcataaccctgtagtcatggttcacggaatcggcggggcgtcttttaactttgcgggaatcaaaacatacttggcatcccaaggctggtcaagaaaagagatgtacgctattgatttcttagacaaaaccggaaacaacagacacaatgcgccgagactgtccaattacgtgaaaaaagtgctcagcgaaacaggtgcgaaaaaagtcgatatcgtcgcgcacagcatgggcggcgccaacacgctctattacattaaaaatcttgacggcggagacaaaatcgccaacgtcgtcacactcggcggagcgaacggccttgtgaccaaccgggcgcttccggggactgatccgaaccaaaagattttatatacatcgatttacagctcagcggacttgatcgttctgaacccgctgtcacgactgatcggcgggaaaaacgtgcagattcacggtgtcggacacatcggacttttgatgaacagccaagtaaacgggctgattaaagaaggtctgaacggcggcggacaaaatacaaattaacagtttcaaagccccggagaatgagaatatcccggggcctttttttcttccatattcttttttcgccgtaaaccaagccctctgaagttatttttgttaaaataataaagttatatcagaattcggagggtttattgtgggaaaagtgaaaagaaatgccccttgcccatgcggcagcgggaagaaatataaaaaatgctgcggaagcaaagaagctgccattccggcagacatcgcggcaaaagaagcgaaacagattcaggaaagcttaatggagtacgcctttacagcacatagagacggcatatcatcatttattaaccagcatgagttcattacggagctggacagacagactaaagacatcggagtcttcaacctcggtatctggggaattttcttccgtccgctggcaggcggcaagacgatttttgaagaatatcttcagaaaaaagccggcggcatcaaccgtccgaaaacacgggaaatcgttgaatcatggaaaagcatgacaccagcggttatggtgcttgaagatgtgaaagaaggaatgattcactttgaagatgtgatgaccaagaaacaattcaaagtggaaatggacgtcagccagcaggatcttccgccggcgggaagcctgattctcggctatccgatccacgaagcggaaaaagcggagttctttatgcagtttacgatcttccctgtgaagcggaccgaagctctaatcagcaaagtgaaaaaggcggctgccccggcccttgcggaaggaaaatcgcctgagcgctttatgcaggaggacttcgacactgtgctggccgctcttttaggaacggcggaagagcctgagcaggctgctgaagaaaaacagacggagtgggcgaacgacatggagaaggaaacggcggacgccattgaaaaaggcctgagcggggatgaatacccggctgagctggttccggccgttattgacctgtggaaaacgttctgtgtcaaaaaaacaccgacgatcagaaagccggaagctttcgcggcggcggttgaatattacgtaaacagtatttctctgaacggcgcgtccgtttctcaagccaagctggcgaagaagtacggcgtcagcgcctcaacgatttccagccgctataaggaaatcgaaggtgctctcacagatgaagccgaacgcttcgccgcagctctgacatcttaatacacagccaaaaaaccttgaagggcacatgcttttcaaggttttttctgcagaaatgctctcggggcaggataattcttaccagttatctaatactaaacagagcgataaaaggaagggagcctgagccatggatgagacacgtacgctgggcaggacggatttacgggtaaagcgtatcggctttggcgctaatgcggtcggaggacataatctgtttccgaatcttaatgatgaaacgggaaaagaactcatccgcacagcgttggacggcggcgtcaattttattgatacggcgtttatatacggtttggggcgttccgaagagttaatcggtgaagttgtcgcagagcgcggcgtgcgggacagcctcgtgattgcgtcaaaaggcgcgcacaaagaggtcaacggacaaatcgagctggacaacagccgtgaatttctccgtagtgaggcggaaaacagcctgaagcggctgaaaacagacgtgattgatttgtattacgtccacttccctgacggcaaaacaccgctctccgaagtggcgggcacgctaaaagaactgaaggacgaagggaaaatcagagcaatcggcgcgtccaatctcagcttcgggcaattgcaggagtttaacgccgacggttatttagaggtttttcaatcagaatattcactgattcagcgtgaggcggagcatgatctgctgccttattgtgaaaagaacggtatttcttttattccttattttccgcttgcttccggcttgctgacgggaaagtttacaaaagacacagtctttgaggacagccgaaaaaacaggccgccgtttcagggagaagcttttcaccaaaacctggagcgagtggataagcttcgggccgttgcggaagaaaaaggggcgcagacagcgcatatcgcactcgcgtggcttctgtcgcagccggcggtggatgcgatcattcccggagccaaacgccccggccagctgaaacacaatctgggcgcgcttgatgtgcaattgaccgaggatgaggttcaatatatcagtgacatcttcaagtgaaaataaaaaaaggaaatagcctgcgctatttcctttcttgctgtcaggacgttttcaaaaacgcttctgtcaatccttccagatcggcgtctgtatccagataccactggccgcgggcgtttttcttcatctcgatttctcttgttacggaagaagaagccggtttcaggcgcataaactcttccggatagacagaaagcaggtggctgacaatttcgttttcatcagcatcggggtgctttccggcatagtcttgcacgcggtcttgcagctggcccgcgagcggagacatatcaagcggcgtcacttttgcttcaaggacggcttttttgcctgacatggatttggtatgcaccttgagctctgtgttatcccgaagcgctgatgacatggcgtcaataatagcggaaatggcttttgaatccgcctgttcttgtgaaatgcctgcagaagcgataaagctggctttcgccgattcctgatatgcggcggccgtcattttttcatttacaccggtcaggcgggtgaaatctttattgtgcttgccgtacagcatcacatcaatgtatgcggataatgcgtccgccgggtcaggttttgcgtttgaggctgtgcctttgactttcagtttataagataaaggcttcgcgtcttttgcctgcggctgatataccaattcatatgatttgccttcgtcagccgtgaagtacagattgcccgtcactgtcttgcccgcatgaagcgtgccgctctgcatctggtcatccttatcggccgccgctgttttcgcgtcatcctgataaagcgagaagtcgctgcttttgacggtaagcgggtctttgcccgtatttttgacggtgaccgttactttcagcgcggccggatgttcagtatcgtctgaagcggcccatgccgtctcttttattttcactttcgccgtgctgctttcctggccgccgctcgtttcgctgctgcatgcggcggtaaatgccgtgagaagcagtatgaaaaacacggcgctcatttttttgatggacatctggtttaccccctgttgttataatgattaattcaatagtcatgaagacagacaggttaattatactagttttgtataaaagagtcttggtaatcatcaatctttttggaagaaaaggaagtgttatgatgaaaaaagaagaattgaaacagctggctctccggatcggtaacgtacctgcccgctacgaaagtaatgtggaagaataccaagaagatgaggttttgttttggtgggaagataagaatgatccggaagccggcatcatggtcgaattggaccgggacggaaaactgaaatccttatcccgtccggctttccggactgatctgccggctctttcggaatcggacatagaagaacggatgcgggcgtttgtagaaacccatcgtccgggggcattggctgagttcgaattggaaaacagcggctccgcaaatgatggtgatgtgagatattcctatgttcagatggctgacggtctgccgcttccgctgaccgggttttacgccgacctgtctttgacaggggaagtaaccggcttttcttaccatgggaaggctgataatctcttaagacccggaacaattgcggacaagcgggaagcattggctcactttgtcaaacatattgaagcggagctgttgttcaccgtactgcatcagtccgtctatgtgcagggggatgacaagcctcatctcgtctatgaaatcgtgtctccgacgcggccgatatcggctgacctgaaggaagagaatgcagaaatagacgaatatgaagggctggaagacgacatgctgccgtatgtcccgatttcacgccctgcacctgaagcggaaaagatgagcatcaatgacatgatcgggctgcacgacggtttttataaagagagggaaactgatcttggagacggccgcatcggcattgcatggcgtcctgaaaaaacaaaatccgtccggaaagataaaagcttagaaagtctgtttaaagaacggaatgaacatgtattgaaaacaatgcatgataaagaatcgggccggctcgccggagtgatgtcatttatacatagtgaaggcgaaccggagttttccgaggaagaatgccatcacatggccatccgctttttattcgccatgtttccggaagcggatcagtatttccgggttcaatatgatgagccggatgatgaaggagaaaacgtgggacttacatataaggcttgttcgggcggcgttgatttgcgattcggagaggggagaatctgcgtcagcaaaaagacgggtcttgtcacgttttatatgccgccggaaattgatccgaaagagctggaggaaatcgatcccgttccttcattgacaatggaagaggcgaaggacgcgatccgccgggccatcaaagccgagctcgcttgggatcgttgttacgatgacggcagctgcggaaaagtgtacaggctcgtatacaagccggttttcccgcggtttattgaggcccatacgggagaagtgatcacgagtttaataggctgaaggtcatgggcgttcgtcccgggtcttttgcgggaattgtgactattgtatgaaaaacagccgctctgaatacggctcttttccctctttgctaaaaatagacacataaaaggcactttcttccctttaaaaggataaggacgtttttatataattaaaaacagttcttttttatacactcttctgaaaggatgaccccattgctgaaagaacatctgagaaaaaaagcgctggagatcgggaacataccgccgcactatgagcttgaaatagaagattatgatgaaaaacaaaaaacgagagcctattatatatggaaagatcgtaaccatccggataaaacggtaacgattgagctgggcgacgacggatctttgcttacctattcacgcaacgactgtccgggttcagacatgcagctgtcagacgccgaattaaagctgacggctcttcggtttgcggcgagacaccgcccgcttacttttatgaatttcatctttcaggcgagggaagaacgcaatgggtgcatccgatttatctatacaaaaaaagtgctcggccggccgcttcccgattcaggttttttcgttgatgtaaccaggagcggcttcgtcgtgcagtttatctattacggggataagggtgaagcgcccgtcccggaaacattcgtcgatcgggaaaaagtcgtctcgcattatatgagtgtgctgacattcagtctcgtctatgatgtggtcaattttgagaacataccgcgtctcgtctatgaaccgattctgccggcttacagctatccggccggtgaagatgatatcgtgccggatcagcagctttgcgaagacaggaatgagccggcaaaaccgcttcctgcgtttgaacataaacgggaaatcagcctggatgaattgatggggtttacctcggatatggttcagacgcgccggcgcgatctcggggatgagatcggaacgacatggcggaaagggtcggttccggaacggaaagatttgagtatcgaaagctattttgaaaccagcaacaaaaatacaatgaagatgaaaacggacaaaaagacagggaaaatgacagcctttaaatcttttattgagcatcagggcccggccttttattctgcggaagagtgtgaggccgtcgcgcttcaatttttatacaagctttatccgagagcggacgagttttttaaaatgaacccgctgaaaacggacggaaggggcaggttccgcttccatttttccgtatggcatcaggatattccgctgcggttcggcgctgcgagaatacttgtcagtcccgtaacggggcttgtggaagcttatatggcgcctgacattgacccggagcagctggagaagatcaatccggtgccggccgttactcccgaagaagcaaaggccgcttttttatccgatttccatctgcggctggagtggcagcgcgattttacgccgtccggcaatgaaggatataagcttgtgtacaggcctgtctatcctccgtacattgatgcgcagaagcgaaaaaagaaaaggttttattagccagggatcatttgtaaatgaggataatctttaaagcctctccaatcgcctccccaatcaaaaccgagcgttttggcaatcgatacgacctcaagccaatcgggcgtgccgtttcggtttccgtcgtacgtcatatcccaaatcaggcttccatcctttttttgcagggcgaagtcgatcgcaaggccgtaattgtggtaagattccccgccttttgcgtaggtgacgatatttcctttttttgaacgtccttgacggtacaattcgttttgttcctcaattgatctgaaaccctctgtgataacgacggtgatgccttttttcagagcggccgtccgcaatagctccgcattctgtttcacgagcggatgaagagcgcttggaatggctctatcttgtaatgccgtctgcggcctcaattctttctgcacataggaaaaacataggtctgcggaaaagaagaggatcagaagcagcgaaattctgactggtagtttcatggtgaattctctctttctttaattgattaaaatctttgtttgctcactgccataaatttgctatgataaaatataacataattagtagccggaggaaggaggcaaatctatgaaatccaagattccatctgaagaagtggccgtaaagatgaatgaatggtataagctgatccgcgcgtttgaagccgataaagctgaagcgctgaagcgggagattcaatatgaactcgaagatatggaagaaaatcaggatttattgttgtatttttcattgatggaatttaggcaccgcatcatgctggataaattaaaacccatgaaagacggcgactgccagcctccgttctctgaaatgctcactgagattgagatgaaccagcaaaagctgaccggcttactggaatattatttttactatttcagaggaatgtatgaatttaagcagaaaaacttcatctcagcgatttctcattataagcgggctgaggaaaagcttgaatatgtggaagatgacatagagaaagccgagtttctgtataaaatttctgaggtgtactatcatatcaagcagactttcttttcgatgaattacgcggggcaggcgcttgatatttacaagaaatatgaattatacggaatgagaagggtgcagtgcaaatttatcattgccggaaatctgatggacgcccagcagcataaaaaagcgctggaatacctcgaatgcgccttggagcacgcggagcggcttgatgatcaatatatgattgctgcggcctattataatatcgggcactgtatgtacagtctgggtgacttttgcaaggcggcggaggattttgaacgggcggctgccggatttgaagcacacagcttccggcaggtcatccaggctgttttttcactcacgcatatctactttaaaacggaaaaatacagtgaagccgccgccagctgcgcgcggggcatgagaagcgcggcggagtgggaagatgagatctatatgacgaaattccgtctgattaaagagctttatcagggggaaggcggacaggattcgctcaaagagtattttgacatcctggaatcaaaggagctgttggctgacacagaggaactgcttcaggacgcggctcatttctttcataaacgggagaactacaaagcggcatcttattttttcagcaggcttgtcggcgtgcaaaaaaggctgcaaatgaacaactacgcataataaaaaaaagaacgagggagcttcggtttcatcgttctttttatgattccttttgttttcagccgattaaaaccgggtacatgctctgtattaacatcagggaggaaatgagacaatgtatcaggatttacaggggaaaacagcgattgtaacaggttcttcgaaaggaatcggaaaagccattgccgaacgcttcggcaaggagcggatgaatgtggttgtgaactacctcggtgattccgccggagcggaagaagcggcggatatcattgagaaagcgggaggcagagccgtcaccgtaaaagccgatgtatcctcagaagaagggattcaggcgctgtttaatgccgcgcaggagcatttcgggggcgtggacgtgatggtcaacaattccggctttaacggagcggaagcgatgccccatgaaatgagcctggaggattggcaaagggtcatcgacgtcaacgtgaccggcacctttttgggggcgaaagcggcactgaaacatatgctcgagcacggcaaaaaaggaacggtcttaaacatatcgagcgttcatcagcaaataccgcgtcctgaaaacgtgcagtactcggcatccaaaggcgggatcaaaatgatgacggaaacgatggcgctcaattacgcagacaaaggcatccgggtgaatgccatcgctcccggcacgatcgccacggagtccaataaggatctggaagatgaaacacataaacaggcccagctgaaaaaaattccgatgaacgccttcggaaaaccggaagaagtcgccgcggccgccgcatggatggtgtcggaagaagcgagttacgtaaccggaacgacacttttcgtagacggaggcatgacgctttatccgtcccagctggaaagataaaagaggaggggaaaccttctcttttttgtttagagaaggggcatacaggaaatggttctctaaaaaacaggagggccgcaagatggcgaatgactggtggaaagacgccgttgtctatcaaatctatccgcgaagcttccaagatacgaacagcgacggcataggcgacctgcggggattatcgcgcgtctcgattatataaaagagcttggcgccgatgtgatatggatctgcccgatttacccgtcgccaaacgtcgataacggctacgatgtgacggatcatcaagcgattatggaatcatacggaacgatggaggactttcacgatctgcttacagaatgccgcagccgcggattaaagcttgtgatggacttcgttttaaatcatacctccacggagcatccttggttcaaagaggcggaaatgaatccggacagcaaataccgcgattattatatttggcggccgggcaccgcggagggcccgccgaccgattgggtgtcggattacggacaatccgtctggcagtacgaagaacatacgggcgaatattacctgcatatgaacgccgttaaacaagccgatctgaattgggaaaatcccgaggttcggcaatcagtatacgagatgatgagattttggctcgataaaggcgtggacggattgcgaatagaccagcttcatcttctgtcaaaaaaagaatacttgccgccatatgaagattacatcgcccgccgggcagatccgaagcctttccggccaaacggagcacggatacatgattacttaaaagaaatgacgaaagaggtattttccaaaatatgacgtgatgtcggtcggcgaggccggatcagtgacgcctgaggaggggctggtttacacgggaaccgatgagcatgaactgaatatgatttttcattttcagcatatggagcttgatcaaaagccgggccaagagcattgggatgtaaaaccgcttgagctgtccgatttgaagaaagtgctcacagactggcaggaaaaactggaacatcaaggctggaatacgctgtattggtgcaatcatgaccagccccggatcgtatcccgcttcggagacgaaggcaaataccgaaaggcatccgccaaaatgcttgccgccctgctttatttcatgaaaggcacgccgtacatttatcagggagaagaactcggcatgacaaacgccccgtttgacagaatagaggactatcaagatattcagaccgtcaatatgtatcacaaaagggtatttgaaatgggccgcaacagggaagaagtcatggcgtccattatggcgaaaagccgcgatcatgcccgtacaccgatgcagtgggacggcagcaagaatgccggatttacggagggcgaaccgtggctgaaggtcaatcccaattacaaaaccgtcaatgcggccgaggctcaggatgatcccaattctatattgaacttttacaaaaaactgatccgcctgcgaaaacagtatgctgatatcataaaaggcagctacacgctgctgtttcccgatgacccgcagctgtttgtgtatgaaagacaggcaaacggacaaaaaatcatatccatcagcaacgtatcgaaagaagaagccgccttttattggccggacggctccgaatctgaaagggccgagctgcttctcagcaactatgaaaataacggcggagcggaatcccgcatcacgttccgcccttacgaaacaagagtttatctgcatgcctgatatgtgatacgacgccccgtccatacatggcgggggctttttaggtaaatcggttatcaatttagaaaaaaattacttgcaaaacgtaattacttcgttttattatggtataggtaacaaatgaacgagaaagtacgctttggaaatcgtcatcattctgatttacagaacagggggaaacggcttgtttaaaaaatggagcggaatcattgtcattgcggcatgctttttaatcgcggcgggctgcggcaattcatcttcaaaaggttcgtcaggttcttcgaaaagcggcaaactgcacgtcgtgacgaccttttatcctatgtacgaattcacgaaacaaattgtcaaagacaaaggcgatgtagacattctcatcccgtcttcggtcgaaccccatgattgggagccgacgccgaaggatatcgccggcattcaaaacgccgatcttttcgtatacaacagcgaatatatggagacatgggttccttcagcggaaaaaagcatgagctctgatcatgcgaagtttgtaaaggcgtcgaaaggaattgacttgctcgaaggttcggatgaagaggaagaggaacatggacacggcggtcatgaccacagccacagcatggaccctcacgtgtggctcagcccggttcttgcgcaaaaagaggtcaaaaccattacggcgcagatcgtaaaacaggacccgaagaataaagcatactatgagaaaaatagtaaagaatatattgcaaaactgcaggatcttgataaactataccgtacaacattaaataaagcgtcgaaaaaagaattgatcacacagcacgcggcattcagctatctcgccaaagaatacggcttaaaacaagtcgcgattgcaggcctttctcctgaagaagagccgagtgcggccaaactggcggatctcaaaacgtttgccaaaaagcatgatgtgaagatcatctattttgaagaagttgcatcgcctaaagttgcagatacacttgccggtgaaatcggcgcgaaaacggaagtgctcaatacactggaaggtttaagccaaaaagaacgggataaaggcatcggttatatcgacattatggagaaaaaccttgatgcactgaaagattcgctattggttaaataacatagtgtgcgccgcggggtgcacactatttctatgcgggaaaggaaggtcagcatgaatctcgttacattacaggatatcgtttttggttattcgcatacacccgtgcttgacggtgtgtcgctggaaatcaaaagcggcgaattcgtcggcattacaggaccgaacggcgcgtcaaaatcgacgctgatgaaagtcatgctcggcatgctcagaccttgggaaggaacggccgagatcagtaaaaaaaacgctgccggaaaacgcctgacaatcggctatgttccgcagcagatttcttcatttaacgcaggattcccaagcacagttctggagcttgtgcaatcaggccgttatacgaaaggaaaatggtttaaacgattgaacgaaacggatcaccacgaggtggaaaacgcgctgaagatggtggaaatgtgggatttccgccaccggaaaatcggcgatttatccggcggacagaagcagaaaatctgcattgcgagaatgcttgcaagcaatccggatctgctgatgcttgatgaaccgacaaccgcggttgactatgaaagcagacagggtttctacgaatttatgcatcatcaggtgaaaaatcacaaccgcaccgtcgtcatggtgacacacgaacaaaatgaagtacagcagtatttggataaagtcatacggcttgagaggggggaaaaaggcggatggaaatgtttgacttggaattcatgcgacgagcttttctagcgggaagcatgatcggaattatggcgccgatattaggcgtatatctcgtgctgagaagacaggcgctgatggcggatacgctgtctcatatttcattgtcgggcgtggccatcggtttttttctcagtaccaatattacggcggcgagcatcgttgtcgtcacgatcggagcgatcggcatcgaatatatgcggcgggcataccgtacatattcagaggtatccatcgcaatcttaatggcggccgggctgtcgtttgcgatgtttctgatcagcctgtcaaaaggcggcgcgtcgatgagcatcgatcaatatttatttggatcgcttgtcacggtcagccagcagcaggtctatattatcggaggcattaccctgctgattctgctttatttcattatattaaacagaccgctctatctgcttacctttgacgaggcgacggcgaagacatcaggcattaacacaaatctcctgtcaatgtcattcagcatcgtgacggggctggcgatttcggtcattattccgattatcggcgtgctgcttgtttccgcgctcctcgtactgcccgcggcttttgcaatccgtatcgccaaagggtttaaatgggtgtttgcggcggccattattatttctcttttcagtgtgttcatggggctgacgtcttcgtaccagctcggaacgcctccggggccgtcaatcactttactgttaatcattctgcttctgctcggctttatgctgcaggggatttggaatgcgtttaaaaaaggaaaagaacgaaaaaaccgccgttaagcggtgcagcagtctcatctgctgcgccgtttgacggctttttttacagaaatatatcagcaagacgctcatatgactctttttttgcttcgaaatcaaagacgttgcacagcaccatcatctcttttgtctgataacgttcggaaagttcaagcagacggcgtttcactgcggcagcagagccgatcaccatccgcttcctattttctgcaatctgtttacggtcctccggcgaatacggataagccttcgcttcttccacactcggcacgcggctgtcggcgccttttccgacacgaagaagccataaatcctggcttaaggcgagttcttccgctttctcatccgtagctgcgcatatgacgaaaatggcacagagtgaggccggagcggaaaaatgggaggaggcccggaaatggtcccgatagatctgaaaggcttttaccccgcgttccggattaatgaaatggccgaagacatagcccgcaccttgaagagcggcgcgtctggcgctgttttccccgaggcccagcacccaaagctgcggggctgtttcaatcaaaggcgctgtttttattccggcataagcatggtccgagggaaccgaatctgtcagaaaggatgataaatcctgaagctgcctgttgaactcggtcatacttttctttaccccgtctgtgagggcgagccggattttcgtcgtgccgcccggtgagcgtccgaccccaaggtcaatccggttcggatgcagcgcctcaagctgacggaaagtttccgcgactttataggggctgtactgcggcagcagcacgccgcctgatccgacacggatggacgttgtggctgcggcggtatgagcgatcataatttccggcgaaacgcttgcgagccctcttgtgccgtgatgctcggcaaaccagtaccgcttatagccccatccttcgctgaggcgggcgagctccgctgaacggcggagcgtctcgtgcggcccgtttcctttggatacgggcgcctgatcaagtatgcttaaatcaatcactcgtctgcccctttcctgacatgtattgatacaaggataggaaaaatgttcagtccccgtcaatttctttgttttctctattctctccggaacgaaggagaatataggaagtaatttttcgccgtttttcgccaaaaattcttatgttttatgaaactttgatataataaaagacgtataacttaataaacaccgggattcttgtcccggaatttagtaaaaatgcgcacttgcggcgtgcttagcggcacccttacagaataggagtgaatcatatggcgatctctttacaaaaaggacagcggattgatttaacaaaaggaaaagccggcctgtcaaaactgctggtcggactcggctgggaccctgtatcatccggcggctttttcggaaagctgttcggcggaggcggtgccaatatcgactgtgacgcttccgtactgatgcttgaaaatgataaaatgacagacagcaaaaacgtcatctatttcggcaatctgaaaagccggtgcggcggtgtcgtacatacgggtgacaacctgacgggtgaaggcgacggtgatgatgaacaaattctcatcgatttgtcgaaagtgcccgctcagattaataaacttgtgtttgtcgtcaatatttacgactgcgtcagacgaaaacaggacttcggcatgattcaaaacgcgttcatccgcgtcgttgatcaggctaatcgcgaagaactggtgacttacaatttaagagataactattcaggcagaacgagcctgatcgcggctgaaatctaccgcgaggacggcgagtggaaattcgccgcagtaggagaaggcacaaacgatacaaaaatcggcgatatcgttaaccgatacgcctaaacgataaaaaggagagtgcacacatggcaatttcattggcaaaaggacaaaaagtagatttgactaaaacaaatccgggtctttctaaagtcgttgtcggccttggctgggatacaaacaaatacgatggcggacatgattttgatttagattccagcgtctttctattaaatgaagcaggaagatgcgcgtcgcccgatgattttattttctataatcagcttgaaggcggaaacggctctgtcgcacattcaggcgacaaccttacaggccagggcgagggcgatgacgaaagtgtaagggtcaacctgagcgcggtgcctgccgctattgacaaaatttcattcgtcatcacgattcatgaagcggaagcgcgcggccaaaacttcggacaagtttccaacgcgttcgttcgcattgtcaatgaagagacaaatgaagagctgatccgctacgatctggctgaagatttctcaattgaaacagccattatcgcaggggagctttacagacataacggcgaatggaaattttccgcgatcggctcaggctatcaaggcggactggcccgtattgcgacagattacggcctgcaaatcggctaaaaccatatcaagcacagaagggagagacggcacatggctattcaattggcgaaaggacagcgtgttgatctgacaaaaacgaaccccggtcttacaaaagcggtgatcggcttaggctgggatacgaacaagtactccggagggcatgactttgaccttgacgcgtcggcttttcttgtcgatgcccatgacaactgtgttaatgatcttgattttgttttctacaataacctggaacacccgagcggcggcgtcatccatacgggagacaaccggacgggcgagggagagggagacgatgaacaaattatcgtcgatttctcaaaaatacccgcaaatattgaaaagatcggcatcaccgtcacgattcatgatgcggaagcgcgcggccaaaatttcggacaagtttcgaacgcgttcgtgcgcgtcgtcgatgaaaacagccagaatgaactgcttcgtttcgatttaggggaagacttctcgattgaaacggcggttgtcgtttgtgagctttaccgccatggggctgaatggaagtttaacgccatcggcagcgggttttccggcggtctggcatcactttgccggaattacggcttgcaggtgtaagcaggaaattaccgttttactaaataggaggaaaaaacttggattttctacatcatattatgtcgacctacgcttccttttttgattggaaaatgtggggtgaggtgctgactgaccctgtatcatgggggctgatcggttccttggttctgctggaagggctgctgtcggccgacaatgcgttagtgcttgcggttatggtaaggcatctgcctgaaaaacagcggaagaaagcattaacatacggattgttcggggcatatattttccgctttatctttatcggaatcgggatgctgctcattaagttctggtggatcaaagtgcttggcgcgctgtacctggcttggctcgtcattaagcatttctggatcggagaaggtgatgacgatacggaaggcatgaagaaaaattcatggatggtccgtacgttcggaattttctgggccactgtcgtttcagttgagttaatggatctggccttctctgttgacagcattttagccgcgtttgcggtatcggaaaaagtgtgggtgctcttgatcggcggtatgctcggcattctcatgatgcgtacagtcgcaaaagtattccttgtgttaattgataaaatccctgagcttgaaaacacggctttcgtgctgatcgggattatcgccgtgaaaatggcggcgagcgcttttgattatgaaatgccgcacgtggtgttcttcggaatcatcatcgctgcatttgtggtcacgtttattatccactatttcaacaaacaaaagcaggttcaggagcagacggctgcatctaaagaagaataaaacaaaaaaggagggagagttcatttccttccttttttgtaccgattatcatgaagagaaaggaggaaaatgatgaagcaggaagaattggtgatccgaaaggccgagccggaaaacgatgactgggaaacgtttctgatgcggccgctgccggaacgtcccggttacgagcgggaaaacgggctggcgtttacccggcttgccggccggattttgggcactccttatgatgagacggagtattacagtaagcttttcgagctgtcttctcatgaaaacatccatgtgttgagcgagacgctggataagaccatcgcgccggaaacgtttcaggcgctgcagcacattcattcggtcaatcaaaaagagaaagggctttcggtttccaggtttgtcgcgtttctcgatgggggcaggctgcttgccaaacacgctgatccgcttatgcaccgccggctgaggaccgcgtttatgacgcttttggaaacctttgcggaccggcatgaaaacgggctgaatcatcccgatttccggcgtgtgctcttggatgtgtcaaagttttcgctgaaccacctgaatccatggctcgaacaagccgatatagagtgtgagatgccgaaggtggtgtggtatggagacgcgaccaaaagccagctctattttctctattatctcatgctgatcggctgtgatgtcctattgtttcatccggctgcggaagatccgttcagcttgattgatccggatgaggagctcagctttgtgataaagctccccgcaacaggcggtcttgagccttttccgaaagaaaagccggacagaacgtccacgacggcctaccggtcaacgaaagaaattgagcatgtgctgaaccatgaggaatccatgatgtataagccttggcagttcagggagcacaccccgcagtccgtgaccttaaaaacgacgtatgatgagttatttctcattgcgaaggagcgggcgtttatccggccgcaatttaaagcggacagggagcgggtggccgttccgaacctttttgcgaaagtgatgggggtttccaaagatacgaaagaatattggaacagactccataccgccgcggactatcaggagacacacatgatccgcagttttccgtttacggaagagctgaaagccaactaccagtatcactacagtcaggttttaaatgaaaaaggagagattgacgcggacaggctgaaaagaagcaacatctggcagtacaagcatctgccttcaggtgtgcagagcgccatcgccaatgtgatttctgacatgtgcagaaacccagggctgaaggctttgcccggggagcagtcaagggatgccgcaatctatttgttccgccaggcgacgaatctgcccgcttcgctgctgcaattgattcagacgtttgattacgcccaaaccgttccgaaactcgttttatatcatacggaacaaaatggcgaactcacacgttctgatgccgccgctcttttgtttttaaataaattcggcgtcgatatcatcttgtataatccgccgggccatcaggacattgagcattatattgaagaaagccaatttgatgtccattggctggaggacatggtgtttcggcaggaatataaggagccgtcactcgtaagaaagctgtttagaaccattacgcaaaagcagggagagtaaataaatatgacagaaaatcaaaatccgcttgttcttgataaaaatgaagagatttctgaacaaaaagcagatgacatcagggcgcagctgcgccaagaccctgaggtgcagcgcatttcgcagcagattgacgtgaaaaaccaaatggagctgcttgagtacggaaaagaaccggcagttgaaatctcgaagttctccgaccgcatcttaaatatgatgaaaacaacaagtgtcacggattcaggcacaatgctgacgcagctcggaaaaatcatggaccgtttcgacaaaaatgatttcgatgaaccaaaaggatttctcgctaaaatgttcaaacgcggcaacagcatgattgaaaagatttttcaaaagtaccgcaccctgggcggagaaattgaaaaaatccacgtcgaaatttcaaaatacaaagatgaaatggcaaagacgaaccatacgcttgaagagatgtatgaaaacaacattaactactacatggagcttgaaaaatatgttgtcgccgggcagatgaagcttgaggaaatgcaggcgctcattccttcttatgaagaaaaagcggccggcggaaaccagcttgcgcaaatgcagcttgatacgctgcgtgacgggcttcaggcgcttgaggaacgtgtctatgatttagatatggcgcggatggtggcgctgcagacagcgccgcagatccgcctccttcagcgcggaaatacgaagctcatcggaaaaatcaattccgctttcgtcattacgattccgattttcaaaaacggcatcattcaggctgtcacagtcaaacggcaaaagcttgtggctgattcaatgagcgagctggaccgccgcacgaatgaaatgctgaagcgcaacgctgaaaatatttcaaaccaaagcgtggagattgcccgtatggcaggccgtccgagcattgacattgagacgattgaaacgtcttggaatacgattgtcagcggtatgcaggaaacgaaacagatcgaggaagagaacagacgtatcagagaagacggagcgaaacggattcaacagcttcaggataatattaaaaacgcagtcttaaagaattaatctgcaccccgcttgcttacggcaagcgggtttttttgcgaaaaaagataatgacaatgtgtaaagacaggtgtaaacttatacggtaatcattttcgatttgaggtgctgcttatgaacaaacaacctgccgtcactccgcgaaaacttctggcgattgccggaatgggctggctgtttgatgcgatggatgtcggaattttatcgtttattatcgccgcgcttcacactgattggaatttaacacccgatcaaatgaaatggatcggaagcgtcaattccatcggtatggcagcgggcgcctttttattcggaatgctggccgacaggatcggccggaaaaaagtgtttatgatcacgctgttattcttttctgtcggaagcggcatatccgcttttgcaacgggattgacggtttttctcatattgcgttttctgatcggaatggggcttggcggggaactgcctgtcgcctcgacgctcgtgtcagaagcgtccgctcccgaaaagcggggacggatcatcgtgctgcttgagagcttttgggcagcgggctggcttcttgcggcggtgatttcctactttgtcataccgtcattcggctggcaggccgcactgctcttaacggcgctggccgcgttttatgcgctgtacttgcggaaaagccttccggaatcaccggcgcatcaggcattgacgcagaaaaaaagcatacgcgggcaggcgggaagtgtctggacgaaaccgtatatccggccgacggtgctgctgtctgtcgtttggttctgcgtcgtcttttcttattacggcatgtttttatggctgccgagcgtgatgctgatgaaaggctacagcatgattgagagcttcgaatacgtccttctgatgacgcttgcccagcttcccggatatttctcagcggcgtggctgatcgaaaaagcggggcggaagaccatcttagtcatctatttgctcggaacggcgggcagcgcttatttcttcggtgccgcggattcattggccatgctgctcacggccggcatgctgctgtcctttttcaatctcggcgcatggggcgtgctttacgcctatacaccggagcagtaccctgcggcgatccgcgcgaccggttccggaacaaccgcggccgtcggcagaatcggcggcattttcggtccgcttctcgtcggatcgcttgcagcacggaacgtttcgtttacagctattttcgctgtcttttgtgcggccatcctgattgccgtcatcaccattattattctcggaaaagaaacgaaacagacagagcttgcgcaatgagcacccttttggggtgctttttttagtgagctgtctgttggcagacctatatttttccttaaaatcccttattttcaggaggcgaaaacttctttttccgggacaatgtcgcaaaaaaattcttgtatttgtaaaaaaaggataggaaatcagtttgcagcacattcgatggaaacgttctcaagcctgataaaagcccgatttcctttataatttatcctcaataaggaggattagagagtatttagaagcataccagaggaaaataagacacagggatgtttttaaagtaatgatacaaaataaacgggattatgatgtttgtttgacttattacaaacgtgttacggtattaaagattgcttattatggagggaaaatatgaatttggatgagaaaccaattaagataaaagtcgaaaatgtatctaaggttttcggaaaacagacaaaaaaagccattcagatgctgtccagcggaaaaaacaaaaaagagatcctgaaagcgaccggatcaaccgttggtgtcaatcaagcaaactttgatgtatatgatggggagatatttgtcatcatgggtctatcggggagcggtaaatcaactttagttcggctgttaaaccggcttattgaaccgactgccgggaatatttatattgatggtgacatgataacaaatatgtcaaaagaccagctccgggaagtgcgccggaaaaaaatcagcatggtctttcaaaaatttgcgctgtttccgcacagaacgattcttgaaaatacggaatacgggttggaactccaaggcgtcgacaaaaaagagcgtgagcaaaaagcgcttgattcgcttaaacttgtcggtcttgaaggctttgaacaccaattcccagatcagctcagcggaggaatgcagcagcgtgtcggacttgcccgcgcattgacgaatgatcctgacattcttctgatggatgaagctttcagtgcgcttgatccgctgatccgcaaagacatgcaggatgagcttttagaccttcatgactctgtcggcaagacgatcatcttcatcacgcatgatcttgatgaagcattgcgcatcggcgacagaatcgtgctgatgaaagacggtaacatcgttcagatcgggacgcctgaagaaattctgatgagcccgtccaatgaatacgttgagaaattcgttgaggacgttgacttatccaaagttctgacagcgggccacatcatgaagcgcgctgaaaccgtgcggattgacaaagggcctcgtgtagcgctgcagctcatgaagaatctcggtatttcttctatttacgccgttgataaacagaaacagcttctcggcgtcattcacgcggcggatgcgaaaaaagcggtggaatccgacttatcgcttcaggatattttaaatactgaatttacgactgtgcatgaaagcacatacttgacggaaattttcgatgtcgtgtctgatgcgaatattccgatcgccgtcacggacgataaggaccgcatgaaaggcattgtcgtaaaaggcgcattaatcggcgcgctttcaggaaataacgattatataaatgttgaagattctgctgaacaagctcaggattcttctgttcagggggtgaagtaaatggacagattgcctagaattccgttagcagatatcgttgaccggtttgttgactggcttaccatgacgttcggaggtttctttgacggaatctcaaacggtttggccgctttcgtaaacgcgattgtgagcggtttgggtttcatcccgtctattttattgactgttatttttgcagctctcgcttggtggatcagtacgagaggaattgcactctttacgttaatcggattccttgttattgattatttgggttattggtcgccgatgctgcaaacgttggcgcttgtcgtcacatctgttttgatttccattattatcggggttccgatcggcatatgggcgtctcagaaagaaacagtccgccgcattgtcacaccgattctggatttaatgcagaccatgccggctttcgtatacctgctgcctgcaattttcttctttaatatcggggttgtgccaggcgttgtggcatctgttattttcgcgatgcctccgacgatccgcatgacagttctcggtattaaacaggttccggctgatctgattgaagcgacggaagcattcggttcaacgacgtctcagcgtctgttcaaggtgcagcttccgcttgccacaaaaacaattcttgccggtattaaccaaagcatcatgcttgctttgtcaatggtcgttatcgcggccatggtcggtgcgccgggcctcggttctgaagtatacagcgccgtgacacagttgaaaaccggtgtcggagtggaagcgggtatcgcgatcgttatcgtagcgattacactcgaccgtatcacgcaaaacattaaagtgaagaagaagagcagggggaatgcctgatgcttaagaaaatcatcggtgtcggcgttaccgctgcgctggctctttctttggctgcctgcggttcgcagactgatgataaggcaacggctgcggaccaggtgaacaaaaccattatcggtatcgatccgggatcggggatcatggccctgacggatgaggccgtgaaggattacggattgaaagactggaatgtcatcacggcgtcaagtgccgccatgacggcgacattgaagaaatcatatgaccggaaaaagccgatcatcgtaacgggctggacgccgcactggatgttctccagatacaagctgaagttccttgatgatccgaaaaaaacgtacggaactgccgagcagattcatacgattacaagaaccggcttcagtaaggaacagcctaacgcggccaaagttctcagccagttcaaatggacgcaggacgatatgggagaagtcatgattgccgttgaggaaggcgaaaagccggccaaagccgcagctgaatatgtgaaaaaacataaagaccaagtggctcaatggacaaaaggcgcccataaagtcaaaggggataaaatcaacctggcttatgtggcatgggacagtgaaatcgcaagtacgaatgtaatcggaaaagtatttcaagacctcggctatgacgtgaagctgacgcaagtggaggcaggaccgatgtggactgcgattgcgacaggcagcgcggatgcgtcattgtctgcttggcttccgaatacccataaggcatatgcgtctaaatataaaggcaaatatgaagatgtaggaacgagtctgacaggcgtcaagatgggtctggtcgttcctcagtacatgaaaaacgtcaattcaattgaagatctgaagaagtaatgaagaaaagcagccctgtaacgggctgcttttttttatgcttcaaacgatttgaggacggcggccgttaatatctcagcgccagtaaagatggcgcttcggtcaaatgtcatttggggatggtgaagtccaggctccagaccgcatcctaggccgagcatcgtcgttttcaagttcggcacctttaacccgtaaaagtgaaaatcctctcctccggttgtcacaagaggttcatccacatgttcttctccgagaatgctgctgatcgcagatgtcatgatggcttccgcctccttgtttcgctcggctgccgggaggctgtgttctttttgcagttcgatttttgcgccgaatgcggcagccgccgcctcacaggctctttcggtttcggcggttaatttctccatggcggcattggtttgtgcgcggagatcaaggctgaacgatgcttttcccggaatgatattggaactttctccgcctgcctgaagctttgtcatcttcacggaatgcgggatgccgggatcaagatgaatgaagctgagtttttggacgagaagagcggcgatttcgatactgttaagcccgagatgcggtctcgcgccgtgggcttcttctccgataatcaggccttctatatgccggcttgagccatgcagaatggacggtgcgcatcggccgtttgccgtttcctgtacggggcgcacgtgcacgccgtataagaagtcaacatcatccagtacgcctttttcaatcattttcagcgctccgccgcctttttcttcagccggctgaaaaataaagcggatggtgcccttcggaagcttcggctgactctttaaaagcatcatcgtgccgagcgccatcgtcatatgtgaatcatgtccgcatgaatggttcgcctgaaagacaccgtccacttcctgccacagcgcgtcaatatccgcccggacagccacaacgggcgagccttctccgatttcgccgacaacaccggtgcaatcatcaaacgtacggattcggcagccggcctctttcagtttttcagtcagatattcagttgtttgatattctttccagcttacttcgggattggcgtgcaggtggtcaaaaatgtccataatgacttgcttttcatgctctgtgagtctgttcatgccgtaagtcctccttcaaaagctgtctgttttttatttttgatattgaaaacaggcaatcggtctgtatataatatagcacatatctgtattttctgaatagtttataaattcaaagcgggatggtgatgttatggctgtgccgaaggccgaacctgtattgaaaaagaagaaattgtttgtgatgcctgatgcttatgtgctgctgttcattgtcgctttactatgcgcgatagcatcatacatcgttcctgcgggggaatttgacagggtgacaaagggcagtgtgacgtccgccgtcccgggaagttatcattctttagaccagtctcctgtcagcccgatcgctttttttaccgcgattcaggaagggatgacaagttccgcgccgattatttttttaatcctgtttacgggcggcaccattgcgattttggagaaaacgggcgccatcaatggattgatcagtaatgtcatcagtacgttccgcaccaaacagctgctgtttattgcaattgtcggatctctattttcgatcctcggcacaaccggcatcgtcgttaattccgtgatcggttttattccgatcggcctgatcgtcgcccgttcgctgaaatgggatgccgtggccggagcggccgtcatttatatcggctgttatgccgggtttaacgcgacgattttatcaccttcaccgctcgggttatcacaaagcatcgcggagctgccgctgttttccggcatcggcctgcggattgccgtctacatttgttttctgctatcatctattttatatatttatcggtatacgagaaggctcagaaaagcaaaggacgccagtctgctggggaacgattggtttccggcagcaggttcaatcccgcaggcttcagatccggaggacaagccagtcccgtttaccgtccgccataaattgattctggctgtcgcggctttgtcgcttgccggctttttatacggcgcgcttactcttgactggtctgattcagagatggccgccgtgttcatttttatctcaatcgtgtcaggcctgattgcgggaatggcggcaaatgatatcgcaaaaacgtttattacaggctgtcaggggctcgtttacggcgcgctgatcgtcggaatggcgagaagcatttccgttattctggaacacggaaagctgcttgatacggtagtcaatggacttgcgtcactgctgcacggtttcagcccgatggcaggcgcaatcggaatgtatatttccagcgccctgcttcattttctgatatcatcgggctcaggggaggcggtcgtatttattccgattttggcgccgcttgccgatctgatgggcatcacgagacaggtcgcggttgaagcggtcatgcttggggaaggcgtcgtaaactgtgtcaatccgacttccggcgttctgatggccgtactggctgccagcggcattccgtacgtaaagtggcttcgcttcatgattccgctggcgctgatttggtttgtcatcggccttgtgtttatctgcataggcgtcctgatcaattggggcccttattaacatttttgtcaatgatatttcggtttatcattatgaatcggcaagatataatgggagttgtaagccattcttaatagtacgggaggaagtcatgaatcagcgtcggaacagactttcaaacgtgaatggaaagagtgagagtgtgaaagagaaagaacgaatgatttggtcagaagtcggaatgcttgtgggcacactgtctttgcttgacatcatcgtacgcggacttgttctgaactgtccgtttagggaatgggccgggagcttggcggttttcttcattataattgtttattattgcatcagggcgggagcgtcgggaatgctcatgccgagaatagacaccaaagaagaactgaaaaagcgggtgaagcagcagcggatagattcaatagcagtcacttttgcggtggcggcgcttacgatgtacgacagggggtttccccatacattctttgcttggctgaaaatgatctttctttttatcgtctgcggaggcattctgtttctgcttcggtatgtcattgtgaagctgtcttacagaagagcgataaaagaaataaaaaagaaatcatcttgacaggtggtttctttttttgtttgaaagcgggaagtctttttaattgataggaatatagatttgaattcactctgccgcgttgctttgatagagagagtgtgataagttgaaatgtaagcgttaacagaattctccagtcttcacaacagttgaaaggagctgaagaaagagtaagaggaatttttgactccgcagtcagtcttcaaaaatgaaataaggagtgtcaaaaatgtttgaaaaacgattcaaaacctctttactgccgttattcgccggatttttattgctgtttcatttggttttgtcaggcccggcggctgcaaacgctgaaactgcaaacaaatcgaatgaggtggccgcgtcatcggtcaaaaacgggaccatccttcatgcctggaattggtcgttcaatacgttaacacaaaatatgaaagagattcgtgatgcgggctatgcagccattcagacgtctccgattaaccaagtaaaggaagggaaccaaggagataaaagcatgaggaactggtactggctgtatcagccgacatcgtaccaaatcggcaaccgttacttaggcactgaacaagaatttaaggacatgtgtgcagccgcggaaaaatatggcgtaaaagtcattgttgatgcggttatcaatcataccaccagcgattacgccgcgatttctgacgagattaagcgtattccaaactggacccatggaaacacacaaattaaaaattggtcggacaggtgggacgtcactcaaaattcattgcttgggctgtatgattggaatacacagaatactgaggtgcaaacctatctgaaacgtttcttggaaagagcattgaatgacggagcggacgggttccgctatgatgccgccaagcatatagagcttccggatgatgggaattacggcagccgattttggccgaatatcacaaatacatcggcggagttccaatacggagaaatcctgcaagacagcgcgtccagagatactgcttatgcgaattatatgaatgtgacggcttctaactatgggcattccatcagatccgctttaaagaaccgtaatctgagtgtgtcgaatatctcccattatgcatctgacgtgtctgcggacaagttggtcacatgggtggaatcacatgatacgtatgccaatgatgaggaagagtccacatggatgagtgatgacgatatccgtttaggctgggcagtgattggttcccgctcaggaagcacgcctcttttcttttccagacctgagggcggaggaaatggggtgcgatttcccggaaaaagtcaaataggagatcgcgggagcgccttatttaaagatcaggcgatcactgcggtcaatcaatttcacaatgtaatggccgggcagcctgaggaactctcgaatccgaatgggaacaatcaaatatttatgaatcagcgcggctcaaaaggcgttgtgctggctaatgcgggatcgtcttctgtcaccgtcaatacttcaacgaaattgcctgacggcaggtatgataatagggccggcgccggttcatttcaagtagcgaacggcaaactgacaggtacgatcaatgccagatccgcggctgttctttattctgatgatattggaaatgcgcctcatgtctttcttgagaattaccaaacgggggcagtccattctttcaatgatcagctgacggtcaccctgcgtgcaaatgcgaaaacagcaaaagccgtttaccaaatcaataatgggcagcagacagcatttaaggatggagaccgattaacgatcgggaaaggagatccaatcggcacgacatacaacatcaggttaaccggaacgaacggcgagggtgcagagagaactcaagaatacacgtttgtcaaaaaagaccaggcccaaaccaacatcattggctatcaaaatccggatcattggggccaggtaaatgcttatatttacaaacatgatggaggcagggccatagaattaaccggatcgtggccggggaaagcaatgactaagaatgcaaatggaatttacacgctgacgctgcctgcgaatgcggatacggccaatgccaaagtgatttttaacaatggcagcgcccaagtgcccgggcagaaccagcccggatttgattatgtgcagaatggtttgtataacaactccggtttaaacggttatcttccgcattaatggatagggctatcatcacatcagcgtgccggcaaaccctcgcttctgggaaaaggacagcacgtcttcaatcacgctgaaaagatacaacatcctaaaacggttccgttttaggatgttgtcaacaatctggaaaccatcatcgatattttttgtccaaaaatcaaacttttctcttgcaaaagtttgtgaagtgttgcacaatataaatgtgaaatacttcacaagttaaaaacagacaccacgaaacactggaggatgagcatacatgatgaacgaacgagtgaacaaagtagcattaatcggagcaggttttgttggaagcagttatgcatttgcgttaattaaccaagggatcacagatgagcttgtgatcattgatgtaaatagagaaaaagccatgggcgatgtcatggatttaaatcacggaaaggcatttgcacctcatccggtgaaaacgtcttacggaacatatgaagattgcaaggatgccgatatcgtatgcatctgtgccggagccaatcaaaaaccgggcgaaacgagacttgagctggtcgaaaaaaatctcgccatttttaaaagcattgtcggtgaagtaatggcaagcggatttgacggcatcttcctcgttgccacaaacccggtcgacattctcacttatgcgacatggacattcagcggtctgccgaaagaacgcgtcatcggcagcggcacgacactggattctgcgcgattccgttatatgctgagtgaatatttcggcgccgctccgcaaaacgtacacgcccacattatcggcgagcacggcgataccgagcttcctgtatggagtcacgccaatatcggcggagtgccggtgcagcaattgctggagaaaaatgcagcttacaaacaggacgagctggatcagatcgtggacgatgtgaaaaacgccgcctaccatattatcgagaaaaaaggcgcgacatattacggagtggcgatgagcctcgcccgcatcacaaaagcgattttgcgtaatgaaaacagtattttaaccgtcagcacatatctggacgggcaatacggtgtaaacgacgtctttatcggcattccggctgtcgtcaatcggaacggcatcgccggtgtgacggaacttgagctgaatgaaacagaacagcgtcaattcaaccatagcgcaaacgtgctgaaagacattctcgctccgcatttcgcggagtaaacaaaaaagcagtacatgacaaacgccatgtactgctttttttaattcgcttttttcgccatttcctgagaggtttttactctcgcttttcccataaacaaaatggtaacggccgcaatgacgatcggcgccagcgcaagcgtgaatacatatgtgatgctttgcgacatggcgtcaataatgcgatccagaatgtgcggcggaatatgggcgcgcgtgccggcctggaaaatctcctgcggatttccgatgttctgcatcgcgccgcccgctcctttcatgccgctgaatgaatctgtgagcttgttggtaaacacattcgtctggatggtcccgaaaatcgtcacaccgagcgtcataccgaatgatctcaaaaacgagtttgttgagttggcgcttccgcggtaacgcggctccagatcgttcatggacgcagccggcagcagtgagaagttgaagccgacgccgaatcctgagatcagcatgaataccgtcagcatcgtacgcgccgtatccggagtcatattggaaagcagcagcattccgataaagaaagcgaccacggaaatcagcatcaaattacggaaccgcactttcgtctggaaaattccgccgatcatacttccgataacagaaccgatcatcatcggtgtcaaaataaagcccgcgctcgtcgcggtgctgccgtacacagcctgaacgaaaatcgggataaataccgctaaaatcacaaatgtggctccgtaaaggaacgccagaatctgtgccgtggcaaataaacggtttttaaacatccaaaatgagataatcggttcttccgcttttctttccacgataaaaaaggcgataaagaacacggcgaacacagcgaacagaccgatgatctgaacggagttccaatcatacgtttttccgccgagctcaagagcgaacatcagaccgacaatggaaaccaccagcgtaatcgcgccggcccagtcgattttctgcttcttgtgttcaagggattctttataataacgaagaatgaaaaacaatgataaaataccgatcggcacgttgatataaaacacccagtgccagctgatggagtcggtaatgagcgcgcctaaaagcggcccgagaacgctggaaaggccgaaaacggcaccgaacatgcccgacatttttccgcgtttttccggcggaaataaatcaaaaatgatcgtgaaggcgatcggcatcagcgcacctccgccgattccctgaatgacgcggtaaataatgagctgatccattgtttgagcgattccgcataatgcagatccgattaagaaaagaataagaccgaataaaaagaaacgcttgcgtccgtacatatcggacagttttccgtaaatcggcataccggccataacggctaccatgtatgatgccgtcacccacgcgaacttatcgaaacttccgaggtccgccacgatatttcccatcgcagtggcaacgattgtattatccatagccgacattaaaatgcccagcaaaagaccgatgacgacaaacttcgtcgaggcgtccttcgcggctgtttgttccatgctttttcctcccatacttacttttgatcattaaatttgctatgatcatattagatttgccgaaaattatcttgatcgtcaagataaattgattttatagggaggcctgtcagttgtcaacaagaaataccagaagcgagacggaggaaaccgccatacagttattccggaagatggccacaaggacgatcctgtttcatcaggcggccgctcaatctctcggtctgtttccgaccgatttgaaatcagctgatatcttaaatgaagcaggcccgatgaccgcaggcgagctcgggaaaaaaaccggcctcagcacaggttcggtaacggcgctcattgaccggctcgaaaaagcgggatatgtcatgaggaaaaaagaccccgaagacaaacggcgggtgatcatcgtgccgctgacagccggaaaagcgaatgtgaagcaattattcagctccttatcccagtccacgatcagcctttgccggcaatataaagaagaagaactgcggctgatattcgattttttaggaaaagcgacggacatgatggaagacgagcttgagaaattaaaataatgtatcatagcacggcccattcatgaataacttgtacaagttgcatgaatgagggggaagccaatgaacatctttttaagctacatcgttctcgggctgtcattgtcagcacctgtcggcccggtcaatgcggcgcaaattgacaaaggcatcaaaaacggcttttggcatgcatggattttcggtctcggcgccatggccgcggacgggctgtatatgattttgatctatttcgggctgtctcaatttttgaccgctccttttgtaaaaacgtttttgtggctcttcggttttttcgtgctgacctacacgggagtcgaaacgttaaaaaatataagggaagccatgaatgtcagaagcggaaaaggaaaaccggctttttacaaaactttcggcgcggggttttttatttctctttccaatccgctgagcattttattctggctcggcatatacgggagcattctcgccaaaaccgctgaatccttcgatgcaaatcagcttttgatttacagctccggcattcttctcggcattttgatctgggatttctgcatggcggtcgctgcgagcactttcagaaatcttcttcatgaaacagcgcttcgctggctgacgggagcggcgggtgtgtctttgatcgttttcggattttatttcggctggcaggggattcaaatgctcatctcataaatagaaggactgtcacctatcgcctgtctccatcataacgtatcctgacgatactggaggtgggccgatggcaagcgggctgtacacaaaaagttgccttgaggaaaagttattggatctgccaaattggcagagaatcgcttttgagcttctatcagaaaaagtaggcgataaagcggatacgtttccgtgcattcccggacgtcagggatttttgacagatcagctccggatatcctttgcgggtgatccccgcgaagagggaaccccggaggaagtggggatgctgctgtccgagtacggaaagatctcaaggaataccggaaaatacgcgtcgctgcttgtgatttttgatacgcctgaggatttagctgagcattattccgttgaggcgtatgaagagctgttctggtcttttttaaaccggctgagcggctgcgacccgaaagactggccggaagacataccggaagaccctgaacattataaatgggagttctgctttgacggcgagccgtattttattctgtgcgcgacgcctgcgcatgaagcgagacaaagcagaagcttcccgttttttatgctggcgtttcagccgagatgggtttttgaaggattaaatgattcaaccgcgttcggacgaaacatgagccggctgatcagaaaacgcttagaggcgtatgatgaagcccctcttcatccccgattggggtggtacggaggaaaagacaatttagaatggaagcaatatttcctccgtgatgatgagacccaagtgtcaaagtgtcccttttcttatttgaagagactgtttaaaccgacgaaataagctatgatccggcagggctgtgtccctgctttttttgtacgatccatgtcacgatcgcaatgacggcgagaaaacaaaggctgaccagaaaaccgggccggctcgatttctcaaacagcgtcccggagacggccgcgacaatcagcacaagggcgataacaatctgtacggttcccatctttgtcgtttcaagcagtttcttgcccgagaacaaaatgaacagccacgtataaagaagcatgaggcccgccgcggttgtcatgtgttcatatatgtttttcggcagcaccaatgacaggatgatggagacgatgagtccggcaaacgtcaatccgagcgcgggccagcagatttttttgttttcctttaatctgaagcatttcggcgcatctccgtcatcagccattgtacaaagcaatgtcgtcaccgcaaacagcgaggcgacgagcgtggaaaatcccgcaataataaaaatcccgttaaaaatatcaagaatgatatctaaatgaaaacccttcagcgatgtaataaacgggctgtcctgttcggtgaatttgcccagcggcactaacagcagcgccaggccgagagaaatgacgtaaatcaccgcaagaacggcaagcatcagccggcctgattttgaggcttcctccggctttttcaaatgcacggtcatcagccccaagacttcaattcctccgaaggcgtaaaacgcataaatcaatcccgtccataaccccatcgctccgtgcgggaacaaatcctttgattcgttcggcacctgcacatccggtttatgagaaaatataccgcacagcgccaatatggcgatgacgataaacataacaatcgccgccgtcttgacaacagcgagcacattttccgttttttgaaaaacggacagccccgtaaatataatcaaaagaccgagcaccgcatagatggaggcgaaaatccacagcggcacattcggaaaccaatgcttcgtaaacagcgagatcgctgtcagctggcttcccgtgatcagcatctcggacgaccagtacacccatccgttgctgaaaccggcccaagtgccgaaagcctttctcgcataagcgcaaaaagaccccttttcgggctgtttggccgagagcttcgcgagctgctcaaagacaaaataggtgccaagcccggcaataagaaatgagatcagcgcggaatatccgcttttgacaatagcgatgctggacccgagaaaaaagcccgtcccgattgtgcagccgacaccgattaaggagagctgccaccaagcgagattccctttaggctggtcctgtgatttactcatgaagttcaacccctttatcaaagcttagattgcggccgtcagaaggggaatatacatccaataaattgctttacatgaaacaaacggccggggttcataatagaagaaaaaaaggagcagtctgatgacacagcaatttatcgtaccgccgaaaaaagggctcggcctgaaggttcacaaagggcagattataaaagtagtcgatgtggaagggcagcaggtggctgattttacggcgtatcatgccaaggacttttatgaacatcttgatcagggcgcgacgatcgatgccaaccagtccattcatgtaaaaacaggtgatcatatttattcaaatttatacaagccgatgctgacgctgattgaggatacagtcggcaagcacgacttgctgcttcccgcctgccgtccggatatgaacaggcttttatacggaaagcataaggacgagctccaggatacgtgctatgacaatatgagcggggcgcttgaaccgttcggggtgccgcggccgcatatgcattacccatttgccatctttatgaacacggtgctcgatgagaaggggaacttatcagtcgaaacccctctttctgacgcgggtgattatgtacggctccgtgcggaaatggatctcgtcgtcgcgttttcatcctgtccgatcgaaaaagggaaatgcaacggggacagcatcacggcgctgcgggtggaaatcagctgatcccggtgtatttggttcacttaaaaactgcacctgtgctatatttaacaaagagtcgtacatagtggcatgattcattttcagtatgaacgggaaatgaatcataaagaaacaatgcaggaggagtgattgggatgagcatccagaaacaaattatgaatgatcttcatgtaaaaccctcaattgatccgaaacaagaaattgaggacagagtgaactttctgaaacaatatttgaaaaaaacaggtgccaaaggctttgttctcggcatcagcggggggcaggattccacgcttgcgggacgcctcgcccaattggcggctgaaagcatcagagaagaaggcggaaacgctgaatttatcgccgtccgccttccgcacggcacacagcaagatgaggatgacgcccaattggcgctcaaattcattaaacctgataaatcatggacatttgatattaagtccgctgtcagcgcgttcgctgatcagtataaaaaagacacgggcgatcagctgtctgactttaacaaaggaaatgtaaaagccagaatgagaatgatcgctcaatatgccatcggcggacaagaggggctgcttgtcatcggaaccgaccatgcggccgaggcggtgaccggtttcttcacgaaatacggtgacggcggagctgatctgctgccgctgaccggattaacgaaacgccagggcagacgtttattagaagaactcggcgcgccggaacgcctgtatttgaaattaccgacggccgatctgctcgatgaaaaaccgcagcagacggatgagaccgagctcggcatcacatacaatgacattgatgattatttagaaggcaaggatgtttcttccgaagtgattgaagcgctggaaaaacgctacctcagtacggagcacaagcgccaggtgccggcatcgatgtttgatgattggtggaaatagaatgaaaaaaacctcccttttgaaagggaggttttttgtttatttcatttttatttatctacactttcataaatccctacccaataccctttgctgctgtcatagtatttgtatttaaaaatccatgttgtaccattcagttcgaaagaagcagcgaaaataccgttagggcttggaacgggcttgatggcattaatgccggcatctgctttcgttgagattgggctattttccacggatggggatgctgttggtgatgcggcaaaggcaggagcggcagacatcagtaaggcaagagacagcgcagaaccggttaacacttttttgaatttcatttcgaacactcccttttcaaatgaaatgtattacagtgttaataattagacgattatccatataattcctcctttatttctaaaatttttttcttaaattgaaaaaaacatcccttcggagggactttttatttattgatccatttgcatgggtcagggacatgttttcaaaacgcttttttatttgatacggatatgattcagcttcaccattaatttgtcggtaaatcttcgaaggctgcctctcgaatcaggctcaagaggcagatttgcttgggcagcgatcgtttctgcggcctgctgaatagacatttggtctgtatggagatgttctgcgaagaggctatcagacaggctgttgatacagcggtcgatttgttttgcggcccaggagttttttccttccgctctggtgcgcaggcgtttcagcaatgtttcctttgaagccagcagggtaaagtggtgaatggtccggccatcctgtctcagcctgctgataatgtcatggaagtattgatcgttcgtaatggtcatgggcacaatgatgatgccctgatatgtatctgacaaataggaaagcatgctgtaattgaattcccgccacagagggtagctttgaaagtcatcttcagcgatatccggcggtatcatcgaacgcatcgcaaaccccatcttttcaggatcatatacgtaagacggtttcagtcttctgtgcagttcaaacgctgtttgtgtttttccggaaccgaaagccccatttatccaaatgatcatcatgatatccccctttttctatatgatacaaaaaaaagacccttcgatcgaagagtcagcgggaaaaaacagacgtatattcccggagcgattcctttatatgcgtaaaggcatgttctccaaaatactcaagagaaacaaaaccgtcatattgtctgttcatcagctcttttaaaaatgctttttgatcgagatctccttggaaaatcggagttggcttgctgagataccagttgtcaaaattccagtgatagtttttcagatgaatatggctgacggtatgatacagcttttctaaagcggacatttggtcaacgtgattgacgtgtaggttggagccgtcaaaaatggtgcggacccgcggatgtccgacatcctccaaaaatgccagtgccgcctccggtgtatccgcgtacgtatcgtaatgaatctcaagcccgatatcgacttcatagtcatctgcgagccgtgccgcctgctgaaattgatcaaccgcacgttgccacttttccggtgacgtccgatgcgaaggaagattgccggcaaagactctgatcaaggggctgtgcagctgtcgtgccgcgcttaatgccccttgaacatcctttaacgcctgcctttcatcctgagcggcgaagtcagtgtacaaactgacggcaggcaccccgaggccttcctcctgaagctgctgatcaagcctgtcgagcgggccgatttcctctatatattgtttagcgtgtccgtaccacagttcgattccgtcaaaggagtgctccttcgcgaaagaaatgatgtcgaaaatatgcttttttttaaatcctgtcgtgcaaaaactcagtttcatcggtaatcctcccgtaactgtctatcatatgtgtacttttccccgggtgagatacggataaacaggtgaaaagggcagacacttttataagcggagtgtcagtgcggcgcacaaattgtttagcgcttttttgcgtcaaagtattaaataattgaccgaagtgttgtacaattaatttcattcgagtaaggggggagaagccattgaaaaatgaaacggagctgacggacttcagtcccgtccgcaataaaccgactcgcgctcgttatgtgatactgtttcttttgttttttatcactgcgattaattatatagaccgtgccagtgtatccatcgccgccccgtccattcagacatcgctgaacataagccccgcgcttttgggcgtcgtcttttccgcattcagctggacctatacgggtatgcagattcccggcgggctcattttggacaaattcgggtcaaaacggacgtacggcgtttctttaatgatctggtctgttttcaccggagtgcaggcttttgcagccagtttcggatttttattcggctgccgcctgattatcgggctggctgaatcgcctgcgtttccggcaaacaatcggattgtcacgacatggtttccaaggcgggaacgcgcctttgccacgggtgtttatacggcgggggaatatgtgggactggcgttcgccacaccggttttattctgggtgttaacggcatttgactggcgcgccgtctttatttcctcaggggtgctcgggcttgttttctccgttttctggttcaaaatgtatcacgagccgaatcggtaccggaaagtgaaccgggaagagcttgattatattagagaaggcggcggactgacagaggtgtctgaatcagccggcaggatcacgtggcgggatttcgtccagcttcttaaataccgcaagcttgtcggcttgtatatcggccaattcgccgtagcctccacgctgttcttctttttgacatggtttccgacttatctggcggaggcaaagcacatggcattcttaaaagtcggcttcgccgcatcaatcccgtatatcgccgcctttttcggcgtattgttcggcggatattggtctgacggaatgatgaaacggggcgtgtcggtgaacgttgcccggaaaacccccgtcatcctcggtcttctgctgacaggctccatcgtgctcgcgaatgttacggattctgctcctgcggttttgacgatcttatccattgcttcttttgcgcagggcatgtccaatatatcctggacgatgctgagtgaggtggcgccaagcgaaacaatcggattggcaggaggcgtgtttaactttttcgccaatatggccggcattatcaccccgcttatcatcgggtttatcgtttctgcgaccggttcatataacggagcgattctgtttgtcggcgctgtcgcatttatcggggcattttcttatattttcattgtcggaaaggtggaacgcattacgctccgatagaaagaaaaactcatctcttcttataaaggatgggttttcttttattgcattatctctatatttcaatattgggttatcatataataaacataactttttcatttcttaggaggatttcgccgaagatgaacgcaaaacgtgccattcccgtaagagaaagaaacatcgtactgatcggattcatgggtgtcggaaagacaacaatcggccagctggtcgctaagaaattatacagagacttcattgatattgatttgcagattgagaaagatttcaatatgtccatccctgaaatgtttgagaaaaaaggtgaagcctttttccgtcaaactgaaaaggactatatattagatatctgccgcaatacgaaattcaagatcgtgtcgcttgggggcggttcgtttaaacaagaggcaatcagacagtgctgcctcgaaaactgtctcgtgctccatcttgatttatcatgggagaattggaagcagcgggctgacctgctgattgaaagccgtcccgttctgcataaccgttccatggatgaaatgcagcagctctttaacgagcgccaaagcatctatgataaacataattcaaaagtggcgacggataatctggaaccagaagaaatcgccgattatatcgtagaaacgttaaaaatcggctgggatctgtatcagccgatgtaaaaagagccgtgacgctgtgagcgtacggcttttttgttttcttttaaacaaacgtttattaaaatgtttagaaaatgagtgtaaaatcgtgttaagatagagtcagaaaattaaatcttataaaacaaaggagaataatcggatatgcaattatacgacttgccgctcgaccaactgcaaacctataaaccaaataaaaccgctcctcatgacttttcggatttttgggcatcatcattacatgagcttgcaaaggaagaggcaaagcctgaattgacggctgaaagctacccggctgacggcgtgaaagtattccggctgacataccgaagcttcggcaaggcggaaattgagggatggtacgccgttcccgaccggcaaggaccgcatccggccatcgtgaaatatcacggctacaacgcgagttatgacggagatatacatgacatcgtaaattgggcgcttcacggatatgccgcgttcggcatgcttgtccgcggccagcacagcagcacagatacaagcgtctcaccgcacggacacgttcccggctggatgacgaaagggattttagataaagatacatattattaccgcggcgtgtacttagacgccgtccgggctttggaagtcatcagcggctttgatgaagtggatgagacgagaatcgccgtcatcggggggagccagggaggcggactttcaatcgccgcggcggcactatctgacattccgagagcggttgcggccgattatccttatttaagcaattttgagcgggccattgatgtcgctcttgatgagccgtatcttgagattaactcttttttcagaaagaacggcagccctgagacggagaaggccgcgatgaatacactggcctattttgatatcatgaatctggcggaccgcgtaaaagttccggtgctcatgtctatcgggctgattgaccgcgtgactccgccgtcgacggtgtttgccgcttacaatcatctggaaacggaaaaagaattgaaggtttaccggtatttcggacatgaatacataccttctttccataaggaaaagctggcctttctgaaagcgcatctgaaaggctgacgacagcgaaaagcccaagtacttgggcttttttcaggaatgatcacggaaaaggacggatacagatggaacaaaggatcatcgaagaattaaaacgaattgaagcacagcacggcgtcaaggtgctttacgccgtagaatcagggagccgcgcatggggatttccgtcaagcgacagcgactacgatgtgcggtttctctatgtgccgaaaaaagaatggtacttttcgatcgaaccgcatagggatgtcatagaagagccgattcatgacatgcttgacatcagcggctgggaactgagaaaagcgctgcggctttttaaaaaatcaaatccgcctcttttggaatggctctcttctgagatgatctattatgaagctttctcagcggctgaaaagcttcgaaaactgaaaatccgcgccttttcgcctgaagccggcatttatcattatctcaatatggcaaaacggaatgaaaaaacggaattgcagggcagtgaagtgaagattaaaaagtatttttatgttttgcgtcctctccttgcctgcagatggattgaaacgttcggctccgtaccgccgatgtcatttcccgtactggccgatgccttattgacggatgaagcgctcatttctgaaatcaatacactgcttacaaggaaaaaaagcggtcaggagctggctccggaaccgagaaatatgatcattcacgcgtttatagaagaagaaatagaacgcatcgggcactatgtcaaaacgatcaaaacaccgaaacctgacataacggaggaactgaatcagctattgattcagaccgtcgaagaggcgtggggggaaaaaggcggaaattgacgattgccgtcatttccgtccgccttttttcggcataatccgcctgctatctaagaagctgattgtggtaaaaccacaaaaatttatcagaatctttgtatttttagaatattgtgagaggatgttttgtccatttacaatagactcatacaaatacttcttagattgcggggtgttaaggttggaagtgattacaagagattttttcttatttttatccaagagcagctttctcaataagatggcgcgaagctggggaagccgtgtggcagccggcaaaatcatcggaggaatggatttccgcagttctatcccgacaatccgacatttgaacagccaggggctgtcagttactgtcgatcatttgggggaatttgtcaacaacggtgacgttgcgaaagaacgcaccgaggagtgcatgcagaccatcgccttaattgctgatgaacagctgaattcccaagtgtcattaaaaatgacgtctttaggtcttgatatagatcttgatctcgtctatgaaaatatgacgaaaatcctccagacggctgaaaaacataaagtcatggtgacgattgacatggaagatgaaacgagatgccagaaaacgctggatatctttaaagacttccggagccggtatgaatatgtaagcaccgtggtgcaggcttatctgtacagaacggagaaggatcttgatgacctcagcccgctgaatccgtttctgcggcttgtcaaaggggcctataaagaatcggaaaaggtggcctatcctgaaaaaagcgacgtcgatgaaaattataaaagactcatccgcaaacagcttttaaaaggacattatacggcagttgccacgcatgatgacaaaatgatcgagtttacaaaacagcttgccgaagagcacggcattccaaacgaccgttttgagtttcagatgctgtacggcatgcgctcgcaaacccagctcagcctggtggaagaaggataccgtatgagagtctacctgccttacggggatgactggtacggctatttcatgagacggctcgccgagcgcccctcaaacatcgcattcgcctttaaaggaatgactaagaagtaaaaaagggagagatgacaatgactacaccttataaacacgaaccattcacgaatttccaagatcaatcgaacgttgaagaatttaagaaagcgcttgcgacggtaaatgagtatctgggaaaagattatccgctcgtcatcaacggtgaaaaggtagagacggaagcgaaaatcgtatccattaaccctgcagacaaagaagaagtcgtcggaaaagtgtcaaaggcgtcccaggagcacgctgagcaggcgattgaagcggctgcgaaagcgttcgaagagtggagatacacatcccctgaagaaagagctgccgttttgttccgcgcggctgccaaagtccgccgcagaaagcacgaattctccgccctgctcgtcaaggaagccggaaagccttggaatgaagctgatgcggatacggcggaagccatcgactttatggaatactacgcgcgccagatggttgaattggcaaaaggcaagccggtcaacagccgcgaaggcgagaagaaccaatatgtctacacaccgaccggcgtaacggtcgtcattccgccatggaacttcctctttgcgattatggcgggaacgacggtggcaccgatcgtaacgggcaacacggtcgttcttaaaccggcaagcgcgacaccggtcatcgcggcgaagttcgtagaagtgcttgaggaatcaggtcttccgaagggcgttgtcaactttgtgccgggaagcggagcggaagtgggagactatctcgtcgatcacccgaaaacaagcatcattacgtttacgggatcacgtgaagtcggtacgagaattttcgaacgcgcggcgaaagtgcagccgggccagcagcacttaaagcgtgttatcgctgaaatgggcggtaaagatacggttgttgtcgatgaggacgcggacattgaattggcggctcaatccatctttacatcagcattcggcttcgctggacaaaaatgttctgcaggttcacgtgcagttgtccatgaaaaagtgtatgatcaagtattagagcgcgtcatcgaaatcactgaatcaaaagtgacggcaagccctgacagcgctgacgtgtatatgggacctgtcatcgaccaaggttcttacgacaagatcatgagctacattgaaatcggaaaagaagaaggccgtttagtaagcggcggcaccggagatgattcaaaaggctactttatcaagccgacgatcttcgctgaccttgatccgaaagccagactcatgcaggaagaaattttcgggccggtcgtggcgttttctaaagtatcaaactttgatgaagcactggaagtggccaacaatactgaatacggtttgacaggcgcggtcattacaaataaccgcaaacatattgaacgggcgaaacaggaattccatgtcggcaacctgtacttcaaccgcaattgtacgggagcgattgtcggctaccatccgttcggaggcttcaaaatgtccggcactgattcaaaagcgggcggcccggattatttggcccttcacatgcaggcgaaaacaatcagtgaaatgttttaagagggactgaatgggcatcctcctcgcggggggtgtccatttcaccataaacatataaagcggaggaggaaatgccatagcaaacattcagttgattatttccatttgtatttatatggcgggcatgctgtttatcggttattttgcctacagacggacgtcaaatctgacggattacatgctcggggggcgttctttaggccctgccgtcacagcgctcagcgcgggggcggcggatatgagcggatggctcttgatggggcttccgggcgccatgttctcaacgggattaagcggcgcttggattgtgatcggacttgtgctcggggcgtgggcgaactggcttttcgtcgcgccgagactgagaacgtataccgaaaaagcggggaattccatcaccattccgggtttccttgaaaaccgtttcggtgatcatacgaagcttctcagactgttttcgggtctcgtcattctcgtctttttcactttttacgtatcatccggcatggtgtccggaggtgtcttattcaacagcattttagggttgaattaccacacgggactgtgggtcgtgacaggcgtcgttgtcgcctacaccttgttcgggggctttttggcggtaagctggacggactttgttcaagggatcattatgtttgcggcgcttattcttgtgccgattgtgacgattttccatacgggcggcccgggggaaaccgttgccgatatccgttccgtcaacccggaactgtttaatatgttcaaagggacgaccgtcctcggcattatttctttatttgcgtgggggctcggctatttcgggcagccgcatattattgtgcgttttatggcgatcacatctgtgaaagagatcaaacgcgccagacggatcggaatgggatggatgattttgtctgcactcggcgcgctgtttacgggtcttgcgggaatcgcgtattaccaccagcgcgggttgaagctggctgatccggaaaccatttttattcagctcggcaacattctgttccacccgattattacgggatttctcatttctgcgattttagcggccattatgagtacgatttcgtctcagctgctcgttacgtccagttctttagtagaggatttgtataagtccatgttcaggcgttcagcttctgataaggaactcgtatttctggggagaatggcagtgcttgcggtgtcaatcatcgctttggtgctcgcctgggagaaaaacaacacgatacttggtcttgtcagctatgcatgggcgggattcggcgcttcattcgggccggtcgtactgctcagtttattttggaaacggatgacgaaatggggggcactcgccggcatgattgcgggagcgattaccgtaatcatttgggcgaatgccagtctttcagactttttgtacgaaatcattccgggctttgctgtaagccttgccgctgtatttgttgtcagcttattgacacaggctccgtcaaaagatgtcacagatcagtttcatgactaccgtgatacactttctcaataaaagcaaggaacgagaggaagaagggaccgccctttttcctcttttcacgatacaggctttcggatcattccgttttgggagtatatgaatttttttctatacaaaaagtcacccctcagagtatgataaagataaaaagagcataggagaaataggtatggaagagcttttagagagagttttttcatttacggacattgataaattaattgatttcatcagttatgaattgcagaagcccgttattctggaaagcgcggatttctttttgcttgcctataattcttattacattaatcacttcgactccgccaaccagcagacgatattctcaaaaaaatgccccgtgcagatttttgaaaggtttctgaaggacggggtgatcgaaaagctgaaaaccgttcctgaaccgttccgtgtcgaaaaaatagacagtatcggattgaatcagagagtggttgtaagcgcaaaacataaaggggaagtgatgggctacatctggattcaggagctcgaccgaaacttgacggacgaggagctcgattttttatatgaaacttcattccatgtcggaaaaatcatctacaaaacgaaccggctgaaacaggaaaaagaagagagagcggaagacctggtgaaacgggcgatctttcagcaattctcctctgaaaaggagttcaggcgggaagcggaaaagatgaacgccgtgctgccgtcggttttttcggtagtcgtcctgcacgccgcaaatggggatggggaggcagtcgaagatgtaaaggaaaatatcaaatcgtacttgaatttgcgggataaagtcagccacgtcttaaccattgattccaatattgtcatcgtcgtcgcaagcttctcgcaaaaaagctccggcacttcggcagcatctgaattcatccacaaactgctgactcattttcactttcagaagatccccactcccatctatatcggaatcggcaatgaatacagcagcatcctgaagctcggcaaaagttatatagaagcccttgaagttataaaggccgccgaaattaccggaaaccaggaaaatatcccgtacgaatacagtaagctcgggatttaccgctatcttgaaagcatcgaagaaaaaaacgcctcactggaatatgtaaacgatgatttagcgttattaaaagccaaagacagagaaagcagcaccgaactgctgaaaacgttagaaatctatctcctcaataactgcaaaacaaaaccagccgcagaacagctttttattcatcaaaacacattgaactaccgcatcaaacagattcttgacatgacatcaattaatttaaacgacttcaggacaaggtgccagctgtatctcgatatcatgctgatgaaaaagagataaaaaagaaaccagtcgccgtactggtttcagttttaataccttcccgcttatcaatctcagaacctcacttctgaatcactcctttcccgcaagatgagaaatgaataaacactgctcctcaatatatgttatactttcattgatattgattctcaattaaaaaagtatgaagtatagatataaacgggaggcagaacgatggcggaaaatcatgaggtgtacgacgtcacgattataggcggaggcccgatcggcctgtttgcggctttttattgcgggatgcgggagctgaaaacgaaagtgatcgagtttttgccgcggctcgggggaaaggtgtctatgttttttcctgaaaaaatcatccgtgatatcggcggaatacccgggattgccggggaacagctgattaagcagctgaaggagcaggcggcgacatttgagccggatatcgtgttgaatcagcgggtggccggatttgaacggctggaagacggaaccattgtgctcgaaagttccgaaggggaaaagcactatacgcgcacggtgattttggccgtcggcatggggacgcttgaggtcaatgaacttgacagcgcggatgcgagccgttattcaggaaagaaccttcattataaggtggagaagcttgatgcgtttcgagataagcatgtcgtgatttccggagggggagataccgcggttgactgggcgaatgagctggaaccgattgcggcgtctgttaccgtcttgcaccgccgtgaggagtttggcggtttggaaagcagcgtggcgaaaatgaagcggtcttccgtgcgggtgcttgcgccgtatcgtctgaagcatctcaacggcaccggggaacggatcgagagcgtcaccgtttgccaaactgagtccggactttctgaagtcatcaagcttgatgagctcattatcaaccacgggtttaaaattgatctcggtccgatgaaggactgggggcttgagatagaagaaggcaggattaaagctgacaggcatatgcgcacgaatcttccgggcgtgtttgtcgccggtgacgccgcccattatgaaagcaagctcagactgattgccggcggtttcacggaggggccgaccgcagtgaacagcgccaaagcctatttggacccgcatgcggatcagatggcgatgtattcgactcatcataaaaaattggtgacacaataaaaaagggctgccccccgatgctgggtccgggggtcagaaaagcattccggcgtatcagctgtgaacgagcatgtctttcatttcatttcgtataaacgcaaataactgttcctgatttttcacggcggtaaacccgcagccggcggggaggtcttcgcccatgcagatgacgggagggcggtttcctctcgggttcggtgatatgccgatttgttttccggcgctgatcaaatgctgagcggattctttgcccgtacagataatcatttgcagaggtgactcactgatcgtgcgttcgatcatggaagtgaatcgctcatccgcgatatgttcatgggtgatataaaacaggcatgattttgagtctggcaagttttctgctgcttgacggctccctacaatgagagaatgcggagaatcattttgccattcggataggagaaagccccgttttgtcagttccgtctttgcggcttcagtcgctgcattcaggcttgcggtcacccggcggatgtcgatctgcttgaaagccagtgtgtcaaagaattcgcataccgcaaggcgtgatgtgaaaaatagttgttcaaaggtgctgatctgtttcaggatgttttcgtttgcgggcatttttttaacgatccgcttcggccattcaataacatcggcgccatactcgcgcagcttgtctgtcaatgtatgttcatcatccccatgagtgaccaccatgatatgccgtccgatgaacggtttgctttcaaaccagctgtgtgtttgaaaattgacaatatcaccgatgacgataatggcagggttggtgatgttttggctttgaactttttcatggatatcctgaagcgttcctttaacgctccgctgccgtccccacgtcccccattgaatgacgagtacgggaacggaaggggattttccgtactccataagcttcctgcatataaatgacagatttttaacgcccatgtaaaacacaagcgtttgaacgcttcgggcaagcccttcccagtcgagattcggcctgccgtgcaatgatgtatcatgagcggtgatcatcgcgaaggacgaagcgaaatcacgatgggtgacggggactcccgcatacagcggcgctgcaattcccgaggtgatgccgggcaccatttcgtagcggatgccgtgctgatgaagcgcctctgcctcttcgccgaccctgccgaacacacttgggtctccgcctttcaagcggacgacggtgtagccctccgccgctttttctatcagcagggcatttatctcagactgtttcataaaatggcggtcgggcagctttccgcaataaatgaaccggcagtccggtgaggcgtattctagaaactttgggtttgcgagccggtcatacaaaatgatatccgctttctccagagcctgttttccttttacggtgatcagccccgggtctcctggtccggcaccgacaaagtatacgattccgtttttcatgatggcgtcatcccttcagcaatttaaaaaatgaaggaccacttggaaaagtgatccggtctttgatcaatacaggaggtatacattctctccttcgatcagtgtttcgtatgttttgacacagccatgatccggctcttggacttttccgtcttctaaggaaattttccagtcatgcatcgggcagaagacgtattctccgctgacgatgccttcagccaggacgccctctttatggggacagcggttttcgacggcgcggacgctcccgtcagaaagcttaaatacggcaagctctttatcttctatatatacggtttttcctaactcctcgggtaattcgtttacattgcctatgcaaacctttgtcatatctttattaaccatgtccgttcccccttactgttttatgaagtcgtgacgacattttcgaatagatctttagaagcttttttatctttaaggaagtattgccacggatctttgtggacagagagtgtctcattcattctgtcgttgagctcctgccgtttttccggatcgtttaatacggattggacatgagataaaccgacgcgctcaagccatgcggatgtccgctccagatagtttgccgtttctctgtagtactgaaggtaagcacccgcgtattctaagacttcttcattcgtttttactttcatcagcaaatcaccggcgcgcaaatgggttccgccgtttccgccgacataaagctcccagcctccgtcgatgccgacaacgccaaggtccttaatgcctgattccgcacagttccgcgggcaggcggacacggccattttaaccttatgaggcgtattgagcccttcgaattttttctcaagcgcaatacccagtgccatggagtcttgtgtgccgaagcggcagaattgttcgcctacgcacgtttttaccgtgcggagtgtttttccgtacgcgtagcctgacggcatatcaagctcggcccatactttcggcagatcttcttttttaacgccgatgagatcaattcgctggccgccggtcattttaacgagcgggatctcatatttgtcgacgacatcggcgatcttgcggagatcttgagagttggttacgcccccgtacatccggggaacgactgagtatgttccgtctttttgaatattggcgtgcatccgttcgttcacaaaacgggatgttctgtcatcctcgtatgtagccggattaatcatgcctaagtagtagttgagggcaggccggcatttggagcagccttccggcgttttccagccgagcacgttcatgatttctctcgtatgtgagagccctttggctttgatttcttctacgacttcatctctcgacagtgaggtgcagccgcaaatcgcttctttttgcgcggatgagtcaaattctgagcccagtgtatattgaagaatgtcttctacgagcggtttacagcctccgcaggaacgggatgccccggtgcatgctttgatttcgtccgttgatgtgcagcctttttcctgaatggcttgaataatggcaccttttgaaacgccgttgcagccgcagatgatttcatcgtcgctcatcgccgcggtcatgcttacgcctgcttcctgatcaagaggctgtaagattgatattttggaggtttcagagatatctgcttctttttgaatcatagaaaacaggcggttgccttcgctgctgtctccgaacaaaacagcgccgacaatttgattgcccctcaggacgatttttttataaatgccgtcctgttcatcgaacacttttattgcctttttgtcctctgattcatcaaagtcgccggcagagaagacctcgacgcctgatacctttaattgagtggagagaacggagccttcgtacggttttgtttcaatgccgcaaatatgtttggccagcacttttgcctgttcatagagcggcgccacaagaccgtacgcgattccgcggtgctcggcacattcaccgaccgcgtaaatgtgcggaatttcagtctgcatataatcgttgacaatgattccgcggtttaccgggatgccgctttctgtgccaagctgtgtattcgggcggatgccgaccgccatgacgaccagatcagcttcgatgcttgtgccgtctttaaagcgtacgccttcgacacggtcagtaccgagaatttcttcggtttgtttttcaaggaaaaatgtcatgccttgtttttctaactcgttttgcagcaggcgtcccgccgctgcgtcaagctggcgctccatcaggaatggggcgaggtggatgacagacacgtccatgccgagattcagcagtccgcgcgcggcttccaaacccagcagtcctccgccgatgacggctgcttttttatattgttttgacgcggcgagcatcgtgtcggtatcttttatgtctcggaatgccgtgacgccttgtttgtctgcgcccggaatcggaaggataaaagggacagagcctgtcgccaggatgagttcatcgtaaggctggattctgtctgcatcggtgatgacggtttggttttccgtgtcgactttgatgactgtttcaccggtatacagctgaatgttgttttctttgtaccagttccaatcgtttaacgtaatgtcttgaatgtcggtatcgccttgcagcacttttgacagaaggattcggttatagttgggatgaggttcggccccgaatattgtaatctcaaattcgtcttttgaaacacgcagtatttcttcaatcgctcttaccccggccattccatttccaacaaggactagctgtttttttcccatcagatgatccgctccttatctttgtttttttcagcgtagcacagcaaaaacaaatatttaagatgcatgttatgaaatgtaacaaaaaatacgaaaaaatctaaaaattttatgaaaattagatagggatgattcgtaccgcacacatcttaaaaccgggcattttacagtccggatccaaggcttcaccaattaaatcgttgacgttttgcgtgtcagaccaatggatggggacaaacaacgtgtgatgtgtctgacttttacttgattttaaacggagaatacatcaaaataaatagtaacgattgcgatttaaaactatgtacatcatgatgaaaataaggcagttgcgagatataaatcgtaatcattctattttatcaggggctattgatatgaaaaaaattccggttacagtattgagcggctatcttggtgccggaaagacgaccgttttgaatcatattttacaaaaccgcaacggtttaaaaattgccgtcatcgtcaatgacatgagcgaagtaaatatagacgcgggcttggtgaagcagggaggcggtttgtcaaggacggatgagaaacttgtagaattatccaacggctgtatctgctgcacgctgcgtgaagatttattagtcgaagttgagaaactcgcgaaagacggcaggtttgattatattgtcattgaatcaacagggatcagcgaaccgattccagttgcccagacattttcttatatagatgaagaaatgggcattgatctgacaacattctgcaggctggacacaatggtgaccgtggtggatgcaaaccgcttctggcatgatttccagtccggtgacagccttcttgaccggaaggaagcggcgggagaagaggatgaacgggagattgccgatttattaattgaccaaattgagttttgtgatgtgctcattttaaataaatgcgacatggtgggcgaaaaagagcttgaacagctggaaacggttcttcgcgcattacagccccgtgccagactgatccggtccgttcgcggagaagtgcccgccgaatgcatattgaataccggtttatttgagtttgaggaagcgagttcatcagcaggatggataaaggaactgacggcaggtcatgaagcgcacactccggaaacggaagagtacggcatcacttcgtttgtgtactcgcggcgtctgccgtttcataccgttcgttttgacagctggctgcatcaatcaatgcctgacaacattgtgcgcgcaaaaggaattgtttggtgcgcaacccgcaacagccttgcgctgctgatgtctcaggcgggtccggcggtttcgattgagcctgtttcttattgggtggcggcaatgccgaaacttgagcaggagcagatcaaaaagcaggaaccggagattctggaagattgggacgaccaattcggagatcgtcatacgaacttggtgtttatcggaacagatttagatgaagccgccattacaaaggaattggatcagtgcctgctcacgcagtctgagttcgattctgattggtcgcagcttgaagatccttttcaatgggatattcagcgggccgaataacataccggccaagtttagaagcaggtgaaaagggaaggagtgatgaaaaaggagctgaccaagtgtgaaagcattgacataccaaggaaaagaacatatggaagtgaaagaagtcccggcacccgccattcaagatgagagagatgtcatcgttcgaatcaccgcaaccgggatatgcggttcagaccttcatttatataaaaacggaatacccgccgatccgggttatattgtcgggcatgagccgatgggaatcgttgaagaaacgggcagtcaagtcaaaaagctgaaaaaaggcgaccgtgtcgtgattccttttaacatcggctgcggagaatgtcattactgcaagcaccagatggaaagccagtgtgatgaatcaaatccaaatcctcatacagatgccggcggtttattcggtttttcggagtttaacggtaattatcccggcgggcaggctgaatatttacgtgttccttttgctgatttctcttcttttctggttccggcagacagtgagcttgaagatgagcaggtgctgcttctgtcagatgtcatgccgaccgccttttggagcgttcagcacagcggagtgaaaaaaggagatacagtcgttattttgggatcaggtccgatcggcttaatggcgcaaaaattcgcgtggaaaaaaggagctaaacgggttatcgcagttgatcaagtcccgcatcgccttgaacatgcgagacgcataaacggagcagagaccttcaatttttcagaacatgatgagatcgggaaactgctgcatgaacaaacgtcagggggcgcggatgtagtgattgattgtgtcggaatggacggcacgccgctttcaaaagaaaaagcagagcaaaaaccgaatcagttcggaacgatcagcccgattcttatagcatcagaagccgttaagaagtttggaaccgtgcagctcacgggcgcatacatttctgaagcggacggctttccgctcggtgatttttttacacgcaacgtttctttaaaaatgggccaggcacccgttattcatctgatgccgatgctgtatcaaatgattgaacaaaatgaaattgatccgacggatatcattacacacaaaatgagtcttgcggaagctcctgctgcatatgatatatttgacaaaaaagaagatggcgacattaaagtgattttgaagccatagcgaggggaaacatgatgaatatttacagaccggcgggattttggatcagattgggagccgttgtactcgactatttaattacttcagtgcctttggcgattatttttatgctggcaacaggaaaagacccgaatgagagcgcaatgatcagcatcattttgactctttatggtattttgctccctgtatactggaacggttatgttatcggcaaaaagatctgcggtatccgcatcgtcaaaaaagacggaaaccaggcaggctttcttactatgattttgagagtgcttgtgggcggcctgatatatggcgtgacgtttggaatcggtgtgatcgtgagcgcattcatggtcggaatgagagaagacaaacggtcaatccacgattttgtagcgggaacgtatgtcacatacgcactgccggacgaatcgattgaaaagagcgaataatttcgctctttttttgcataaaaaatggatgagggagcaacatataacaaacgttaaaggaggaaagagtcatgaaaaaagctgcattgtctttagctgcgtttttcattacagcaatggttttcacaatgccggcacacgccgaaacaaaaatgccttcaacaatgtcactcacggaacagcagaaaaaagaaattgaatcacttgaaaaagaagtgctcgaaaaacgcaaacatgtcatatccaaatatgttgagtacggggtcctgccgaaagaaaaagcagaacatattaaacagcatatggacaggcgctttaatatgatgaaacaaaatggctttgtcccgaagcctccgcctcataaattggaaaagcggcatcatcattcttaagcatccggcaagccggatgcttttttgtttttatcgggattgctctgaaatgcgtttcaaaacgtatgatatcaatatcatacgcatcaggaggatgaaacacatgatacataaaaaacagggtctgttccctgatacatttctatgggggtcagcttcggctgcctatcaggttgaaggagcttggaataagacggtaaaggaccttcagtatgggtgaactgtgcagagaggctattagtgacggagttcatctcatcggctgctgcagctggtcattcacggatctgtttaagctggctgaacggctatcaaaaacgctacggttttgtgtatatcaatcgagatgaagaagatgaaaaagacttgaaacggatcaggaaaacagtttttattggtaccagaatgtaattgaaacaaacggtaaaagtttataaaagttccctgagagaaatatgattctctcaggggtttcttttacattgcgtctgcatcaataatatacgtatccgcatgaagatcggatatttcggcaggcactgaataacaggtaaggctgtatcggcctttcggaatattaaagaaaagccgctttgacatcacgctttcaatctcaattccatcttttacagcctcaaagggaacagtcgcttttttctcataggatagtaccggttcacttgtgttaagcctgaagacgataaatgccctcgtatttctccttgcttcgaatgaaacagctccgtcagcttccgcatatcctttttcaatggcttcatcggtccaatcgataacaggcggttctgaatctttttggaagattgtaaattgatgatacgaaatggccagttcttgcggtttccatgatttattcaatgcgctgttcctcctgtttttttacttgattttaaataatactctcgttccgtcgggatcattggtaagctggtgtccgacccaagagccggctccgcggttgtctgccggagaaatatattctacggaggcattgtttccgccctgtttacaaaccgccatcggccattcatccctatcgtatcccgttttgacaggcacatgtttaagagattgctcacgccgcttatgtactccgtctctgtcaatggtgcatatgctggaatgcccttcttttatcgcgtccttaatatgctttgctgtttccggatatcgatcggacggaaataggattactttgtcgtaatcactcttctgaacggtctgctcgttatctgagaaaagatcacccttgatcagggccgcgactgctccggcaatgatgataagaacaagcagcagtgcttttaatgttttcaagagtatcaatcacctccagttttaaattgctgtaaagctggtccaagaataaagcagaatcggccggctgtaaagctgttaaaatatatttctcagccgcaattcagctgaatatctgtaaaaccatccgcacaaatcaattttattcattaaatatccgatcagaaagtgttttttgccgtttccctattcagaaatgaacggttgcggccgtatcgtcaattgacttattatagcgataagctcaccggcaggatatcttcgtctgcgagtgtccgacccgaaaaccttggcctgcatgaccgtgcgcaacaagacgataaaaagacggccatctgataagaaggccgtcagtaaatcattccagattcgcatgctttgtaaacatgtctgctgaattcagttcttttttctccatgatttttagaataaccgcatcgtaaaacagcagaagagtttgttcgaataaagaacccatcggctgaatcgtctttctgtctccgccggtctcttccttaggagagccgggaatcgttatcgtaagatccgcaagtttgccgagacttgaatcggggttaatcgttaatgcagtgatgatgccgttaaggcttttggctttttcagctgtatgaagcagactttttgtttcgcctgagcctgagccgatgatgacgagaccgccttcttggaggggaggggtaagcgtctcaccgacgatgtaagcgttcaggccgatgtgcatcatcctcatggcgaacgctttagccataaagccggaacgccccgctccggacgtgaagatttgatctgccgataaaatctcatctgcaagcttgtcagcttcactgtcggctattaatgctgcggtgcgggatatttcattgagtatttcatgtaagtattcagtcgttttcatgatccttgtgaaatcagctgtttcattttagcagcagcatccgctttattgtcagctcccgtaatgcctccgccgacaatgattaaatctgggttttgtttgatggcttcaggaagcgtatcaagtttaatgcctccggcaattgcggttttagcgctcttgaccgcttttttaatcgccgtcagttcctcgaatgaattctttccttctgcttgaagatcataacctgtgtgaacacaaatataatcaacaccgagttggtcaatttcttttgcccgtgtttcaaggttttttacgttaatcatgtcgacgagaattttttctgctgtttttttgcttcggcaaccgcccctttgatcgttgagtcgtctgtcgctcctaaaacggtgatgatgtcggcgcccgcttctgccgctttcatgatctcgtagccgcctgcatccatgattttaagatcggcaagcactttcaggtgaggaaaggctgatttcatttcctgtacggctttcaggccttcattaatgacaacgggagtgccgatttctacaacatctatatattgttcgacctctttcacaagttcaattgcttccgggatattcactaagtctaatgccagctgtaattccactttatatccactcctctttttcatgtatttacattctatagagtgccccgcatgttgagaagtacgcactttgaagtctaatagttactttgaggatactgtccccgcaggcaatgcgctttgtttcagcaaaactgcgtggtagtataaactgatgaaagttgtgtaaaaaagtaagcgtgtatgaatagatgatgaacgtacaaaaagtaagaggaaggagaatggcccgtgagccgaatggatgagaaaacgtttaattgcgaaaaggaattgacgcttgccgtgataggcgggaagtggaaaatgctgattatgtggcacctgggaaaagaaggaacaaagcggtttaatgagctgaaagctttaattccggatattacgcacaaaattcttgtgaatcagctcagggagctggagcaggatctgatcgttcacagggaggtttaccctgtcgtccctccgaaagtggagtactcattaacggagcaaggagagacccttatgccgattttggacgccatgtataagtggggaaaagaatatatggaattaatcaacattgataaaactgcaataaaggaatctttttgaagcgctctatgtaaaatagagtgctttttttgcggtttaatgaaatcatattgcgaacgattaaatctcctgtttcggttcttgcgctgttttttccccatcagctcatatatgaaaactattttcattctgccataactggatattcgagagatttatactatagtttaaagatttttaattttacataaataatatttttaaaaataaattgcgggatgccgcaaaataccctctggaattgtcggaatttttttcggtgtgccgaatgaaacttttcacccatttttcggtgataaaaacaataatttcatataaagtgaacgtaagtagatatatagtaattcatgaagaaataggtaaaccctgttgcttacaaacattggattcttgtcttgatttctcataaatttgagccgcatttcggactgtgcgggtgagtggattgcggatttcggcggtgattgaatcgggatcgttttggaggtaagtggttcttttggcttgataatgagttagggacattgagggaggctgtttctaagggagaattgacaattttatcttaaaaaggggaggcgcacacatatggaaataactttttatcctttaacaaatgctcaaaaacgtatctggtatacagaaaaattctatccgaacacaagtatttcaaatcttgccgggttcgggaaactcatttctgacgacggcgtacaggctcattacgttgagaaagcgatacaggaattcgtccggcggtatgagtcgatgagaatccgtctgcggcttgatgatgagggggagcccgttcaatatgtgagcgattaccgtccgctgactatcgaacatacagacatcaggcaagccggctgctctgcggaagagctgtcaaaatggggacgtgacgaggcaagcaagcctctggcattatatgatcaggatttattccgtttttccgtgtataccatcagcgaaaatgaggtctggttttacgttaatgtgcatcacattatttcagacgggatttccatgacgattctgggcaatgcgattactgatatttatttggagctttcgggcggagcaagtatggaacagacggagattccttcctttatcgagcatgtgctgactgagcaggaatatgtgcagtcgaagcggtttaaaaaggatcgggatttttggaacgggcagttcgagaccgtgccggagcttgtgtccctgaaacggagccaggcagatgcgggtcttgatgcgaaacggttttctcaagaaattcctcacgacttatacggccgcattcattcattctgcgaggagcataaagtcagcgtactatctctgttccaatcagctttgatcacttatctctacaaagtgaccggccgggatgacgttgtcacgggtacgtttatgggaaaccggacgaatgcgaaagaaaagcagatgctcgggatgttcgtatctacggttcctgtgcggacaagcgttgacggaggacagtcgttcttggaattcgttaaaggccggatgaaggatctgatgaaaattctccgccaccaaaagtatccgtataacctgcttgtcaatgatttgcgcgcttcgaaaagttcgctgagcagattgtttacggtggctctggagtaccaggtgatgcagtggcagaaaaaagagaatctgtccttcctgacagaccctattttcagcggaagcggtacaaatgatatttcgattcatgtgaaggaacgatgggacactgggaaattgacgattgattttgactatcgcagcgacatattcaagggagaggagattgtatctgtttctgaacgtttgatcacgctgattgaagatgcgatttcatctcctgatcgcataattgatgagcttactcttctttctgaatccgagaaagagcggctgctgacacgggcctccggtaatccggtgaattaccgcggggagatgacgataccggggctgtttgaagagaaagtgaagtcactgtctgacaaaccggcggtggtgtatgaaggccgaacattgtcctatcgcacattgcatgaacagtcaggccgaattgccggacgccttcttaaagccgggatatcagccgattctcctgtcgcggtgctgcttggccgttctgagcgtgttattgcggcaatattgggaattttgaaagcgggcggcgcctatgtgccgatagatcctgactttccggcggatcggattcagtacattttggaggacagcggagcgaaggctgttctgacagaggccggaatacaggcgcctgcagcggatgccgaacggattgattttgacgaggctgttcagtttgaaacggctgcggacggtgtcagtacacaatcagaccggctggcttacatcatctacacgtcaggtacaacggggcggccgaaaggcgtgatgattgagcaccggcaagttcatcatctggtgcaatcactgcagcaggagatttatcaatgcggtgagcagacattaagaatggcgcttttggctccgtttcattttgatgcgtccgtcaaacagatttttgcctcgcttcttttgggacagacgctttatatcgtgccgaaaacgactgtaacgaatggctcggcactgctggactattatcgtcaaaaccgaattgaagccactgacggaacccctgcgcatctgcagatgatggttgcggcgggagatgtcagcggaattgaattgcgccacatgctcattgggggagagggcctgtccgccgctgttgctgaacagctgatgaacctctttcatcaatcgggcagggcgccgcgtctgacgaatgtctacgggccgacagaaacgtgcgtagatgcgtccgtgcatcaggtgtccgccgataacggaatgaatcaacaggcggcgtacgttccgatcggaaaaccgctcggcaacgcccgtctgtatatattggataagcaccagcggcttcagcccgacggcacggccggtgagctgtatatcgcgggtgacggtgtaggccgcggctatttaaatcttccggatttgaccgcagagaagtttttgcaagatccgtttaacggaagcggccgcatgtaccgcacgggtgatatggcgcgctggctgccggacgggacgatcgaatatatcggacgtgaagatgatcaggtgaaagtccgcggctaccgtattgagctgggagaaattgaaacggtgctcagaaaagctccgggggcggcgcaggccgtcgtgctggcacggccggatcagcagggcagcttagatgtttgcgcatatatcgttcaggaaaaaggaaccgagtttcaccctgccgagtacagggagtatgtgtccaagcaccttcctgattacatggtgcccgcttactttacaaaaacggacgaaattccgctcacgccgagcgggaaggcggaccgcaaaaagctgtttgcgcttgatgtgcaggctgtcagctcatccgaatatgccgcgccgagaaacgaaacggaggaaacgctcaccgtcatctggcaggaagtcctcggaatggacaaggcgggcatttatgatcatttcttcgagtcaggcggtcattcattaaaggcaatgacgcttctgacgaaaattcataagcaaatgggcgttgaaattccgctgcaatacttgtttgagcatccgacgattgcggcgcttgccgattatgcggaaaaccgaaacgaaggaccggcattcagggcgattgagccggctgagaagcaggcgagctatccgctttcgctcgctcagcagcggacttatatcgcgagccaatttgaagatgcgggagtcggatataacatgccggctgcggccgtgattgagggcgctttagaccttgaaaagctcgagcgtgcattttctgccttaatcagcaggcatgaagcgctcagaacatcgtttcaatcggaggacggcacgccgagacaggtggttcacgaacatgttccgtttcatattgaaatgctcgaagcgcgcggaagaacgaatgaacaggtcatgaaggactttgtgcgccgttttgatttatctgaggcgccgctgttcagaatcggcctgcaaacgctcggtcacaatcgccatatgctgctgtttgatatgcatcacctgatttctgacggggtgtctatttccatcatgctgaaggaactggctgacatctacggcggaaatcagctgcctgaattgcgcattcaatataaagattatgccgtatggcaggcggaacgggcgaaagaaggctacaagaaggagcgggcgtactggaaagaagtcttcagcggcgaactgccggtgcttcagctgctccctgattatccgcggccgcaggtgcaaagctttgaaggtgaccgcgtgtccgccaagctgccgaaaatgctgcgggaacggctgcagaagcttgccgagaaaaacggagccaccctttacatggtgctgttatcggcatactatacgctgctttctaagtattcgggacaggaagacatcatcgtgggaacaccgtcagcgggaagaaatcactctgataccgaggggcttatcgggatgtttgtcaacacgcttgcgctgcgaagctccgtgaagcaggatcagacatttgccggcttgttaggtcatgtgcgcaaacaggtgctggacgcgttttcccatcaggattatccgtttgagtggctgaccgaggagctgaacgtgccccgggacatgagcaggcatccgatatttgacacgatgttcagtctgcaaaatgcttcggacggaattccggagatcggcaacctgacgctgtctcttcatgaaaccaacttcaatatcgctaaattcgatctgacaatgcaggcccgggaaacagcggaaggcattgcgctcgatttggattattgcacgaagctgtttaagcgctcaactgcggatcgcatgcttgcgcactatgtccgtctgctggagagtgcggcagctcagccggatgcgaaaatcagcgaatatgatctgctttctgaacgggaggctttgaaccaattacagcggttcaatccggagcgcacggcatacccgaaagagcaaacgatcgtgcagatctttgaagaacaggcccgaaagaaccctgaccggacggctcttcagttcgaaggggaaactctgtcgtatcagcagctgaatgaacgcgccaacaggcttacgcggcatattctttcggtcggaggcggcgggaaaaccgcggctgttttatgtgaacggtcaatggacatgattgtttccattatggctgtgttaaaagcggggtccgcctatgtgccgattgatcctgagcatccggttcagcggattcagcatttcttccgcgacagcggggcgaatgtgctcctgactcagcaaagcctcaagccgcttgcggaaaaggccggttttcaaggcgtcattgtgcttgctgatgatgaggcgagctatgaaaaggactctcgcaatccagcattgccgtttgattccaaaacgattgccaatctcacgtatacatcaggcacgacgggaacgccgaaaggaaacatcgtcacacatgccaacattttgcggacggtaaaaaacacgaactatttgaccgtttctgaagaggacacagtgctcggtctgtcaaactacgtctttgacgcttttatgtttgatatgttcggttcgctgttaaacggtgcaaagcttgtgatcgtcccgaaagatacggtgctggacatgtcgcgcctgtcccgtgtgatcaaacgggagaacgtcagcattctgatgattacgacggccctgttccacctgcttgttgatatggagccgtcctgtctgacgacgcttcggaaaatcatgttcggggcgaaagagcgtctgtagaacatgtcaaaaaggcgctggcggcagtcgggaaaggaaaactgcttcatatgtacggtccgtcggaaagcacggtgtttgcgacataccatccggtggatgtcattgaagaggatacgctctccgttccgatcggtaaaccggtcagcaatacggaagtctttattatgaactcagccggacgcattcagccggcgggtatcgcgggagagctgtgcgtcagcggggaaggtctcgtagaaggctactacaaccgtcctgaactgacggaagaaaaatttgtaaagcatccgtttaaggaaggtgaacggatgtataaaacgggcgacttggccagatggcttccgaatggcgatatcgagtttatcggacgcatcgaccatcaggtgaaaatccgcggtcagcggattgagcttggcgaaattgagcatcagcttcaaagccatgatcagattcaggaatgcattgtgctcgctgtggatcagggcgcgggtgacaaacttctttgcgcgtattttgtcggcctcagggaaatatcttcccgggagctgagggagcatacggcgaaggatcttccggcttatatgattccgtccgtctttattcaattggatgaactgcctcttacagggaacggaaaaatcgacaggcgggcgctgccgatgccggatgtgaccgcagcgaatgccgtgtcatatacggcgccgcgcaatgaaacagaacaaaaactggcggatatttgggctgaggtgctgcaaatggaacgggtcggcgtccatgatcagttctttgagatcgggggccactcgttagcggggatgaaactgctggcccttatccagaagacattcggcgtgcagcttaccttaaaggatctgttcacttctccgacggctgctgggctggcgcagctgattgaaggggctgagcggaaggcggctgagagcatcgcaccggctgcggagcgggaaacgtatccggtttcttcaccgcagaagcggatgttcgtgcttcagcagctggaaggcgctgaaacaagctataacatgccgtctgtgctccgtttaaaaggaaagcttgatgcagaaaagctgaaatccgtcatgaaacagctgacagaacgccatgaagccttcagaacgacatttgacataaaggatggagaaacggttcagcgtatatgggcggaagcttatatcgacatggaatattatgaagcctctgaagaagatgctgaacggattattcagagctttatccggccgttccgtctggatcagcttcctctcgtcagaacggggctggtcaagctggctgaacatgaccacctgctgctgtttgatatgcaccatatcatttcggacggcgcttcagtcggcgtgctgatagatgaactgtcccgcttgtatggcggcgaaacgcttgagccgctgcggattcattataaagactatgcggtatggcagcagaaatttattcaatcagagcagtaccgcaagcaggaggagcattggcttcgggagcttgacggcgagcttccggtattgacgctgccggctgattacagccgtccggccgtgcaaacctttgaaggagacaagctggtcttttctctgactgaggaacagacgtcggctcttcgcagtcttgcgaaacaaacggattctaccatgtacatggtgctgctggcgtcgtacagcgcctttctctcaaaactgagcggacagcatgacatcattgtcggctcgccggttgcgggacggtcacatgcggatctcgcaaacgtcatcggtgtttttgtgaatacactcgcgctgcgtacgtatccggaagcggacaaaacgttcacggactatcttaaagaagtgaaacaaaccgctttacatgcatttgacgcgcaggattatccgcttgaagaccttctgcaaaaggttgaggtgcagcgtgatacgagccgaaatccgctgtttgatgcggtattctcaatgcaaaatgcaaatgctgaagatctggtcatggaaggaattgagctgaagcaccacccgtttgacagaaaaacagccaagtttgacctgacgatgacggctgaggacacagacgaaggcttaacgtttgtgcttgaatataacaccgcgctgtttaaaccggaaacggcagagacgtggaagcattattggcttcaactgttaaaagccgcaacggaaaatccggctgcgaagctttctgagctttccttggtgaatgaaacagaaaaacaagccctcctcaatgcatggaaaggaaaaacaatttctgtgccgcaggacaaaacggttcaccgtctctttgaagaaacggccgcccgatacgcgaaccggccggccgcggcatataacggcgcgaaatggacgtacggcgagctgaacgcaagggcgaaccggatcgcgcgcattctcatagactgcggcgtcacggctgacgaacgtgtcggcattttgacgaaaccgtccttggaaatggccgcgggcgtactcggcgtcctgaaagcgggcgcggcatttgtgccgattgaccccgactacccacaagagcggatcagctacattctgcaggacagcggcgccaagcttcttctcacacaggaagcgctggacgtaccggatggctacacaggagatacgattctgcttgacggcggacgctccattctgagcctgccgcttgatgaaaacgatgaagcgaacccgcagactgaaacaacggcggatcagctcgcttatatgatttacacgtcaggaacgaccggacagccgaagggtgtcatggtcgaacaccatgcgctggtgaacctgtgcttctggcatcacgacgcattcgccatgacggcggatgataaaagcgccaaatacgcgggctttggttttgacgcctccatctgggagatgttcccgacatggaccatcggcgcggaacttcacgtcattgacgaagcgatccggctggatatcacccgcttaaatcactatttcgaggagcacggcgtgaccatcaccttcctgccgacgcagctggccgaacaatttatggagctggaaaatacctctctccgcatgcttctcgtcggcggcgacaagctgaagcgggcggtgaaacagccgtacacgatcgtcaacaactacggcccgacggaaaacaccgtcgtcgcgacaagcggcgtcatcaatcctgaggaaggatcgctttcgatcggacgggcgattgccaatacgagagcttatattctcggcgacggcgatcaggtgcagccggaaggcattgccggtgaattgtgcgtggccggccgcggtctggcacgcggatacctgaaccgtgaggaagaaacggcgaagcggtttaccgcagatccgttcgtgcccggcgagcgcatgtaccggaccggcgacctcgtcaaatggaacgcgcagagcggcatcgaatacatcggccgtatcgaccagcaggtcaaagtgcggggctaccggatcgagctttcagaaatcgaagtccgcctcgcccagcttgcggacgttcatgacgcagcggtgacggcggtggaagacaaagcgggcaataccgcgctttgcgcctatgtcgcgcctcggcaggacgatattgaagcgctcaaagccgcgctgaaagacacgcttccggactacatggtgccggcgttctgggtggagatggacgagcttccggtcaccgcaaacggaaagattgacaaaaaagccctgccggaaccggacattgaagcgggaagcgccgcttataaagcgccggaaacggagatggagacgctgctttccgacatttgggaggaagtgctcggtcttgatcagatcggcgtaagcgataatttcttcaccctcggcggcgactcgatcaaaggcatccaaatggcgagccgcctgaaccagcacggctacaagctggaaatgaaagatctcttccagcacccgaccatcgaagagctcgtctcttatgtggagcggacggaaggcaagcaggccgatcagggacctgtcgaaggcgaagcggagttaacgccgatccagcgctggttctttgagaaaaacttcacggacaaacaccactggaatcaatccgtcatgcttcatgcgaaagacggctttgatccggagataacagaaaaaacattacatgtcctgacggtgcaccatgatgcgctccggatgatttatcgtgaacaaaaaccgtattacagagggcttgaggatgcgtctgttgaactgaacgtctttgagctgaacggacctgctgaagatcatgaggaccgtatcgaacgggaagcagaccgtcttcaaagcagtatttcactggaaacaggacatctgctgaaggccgggctcttccgggctgaagatggagaccaccttcttctcgcaatccatcacttagtcgtggatggtgtatcttggcggattttactggaggacttcacgtccgtttatacgcagctgaaacaaggcaatgaaccggcgctgcctccgaaaacacattcattcgccgaatttgctgagagaatcaaagaatacgcaaatacgaaggcgtttctgaaagaagcggattactggagggggcttgaggagaaagaggtatgcactcagcttccgaaagacaggcagtctggcgatcagcgcatgagacatacgagaacggtcagtttctctctgacgcctgaacaaactgaacagctgacgacaaacgtacatgaagcctaccatacggaaatgaacgacatcctgctcacggcgctcggactggcgctgaaagagtggacgggtgaagacacgatcggcgttcatttggaaggccacgggcgcgaagacattcttgacggcctgaatatcacccggacggtcggatggtttacgagcatgtatccgatgatccttgagatgaagcacgccgacgatctttcatatcagctgaaacaaatgaaagaagacatcagacacatcccgaacaaaggagtcggctacggcattctgcgttatgtaacggcgcctgagcataaagagggtctttcatttgagattgatccggatatcagctttaactacttaggccagtttaatgagatgtcggattccggcttatttacaagatccgggatgccgtcaggacaatcgctgagccctgacacagagaagccgaatgcgcttgatattgtcggatttatagaaaatgggcagatgacgatgacgtttgcctatcattctctcgaatttcatgaaaaaaccattcaatcgttcagtgacagctttaaagggcacctcttgaaaatcatagatcactgcctggcccaagacggacctgagcttacgcctagcgatcttggcgatgatgatctgacgcttgatgaacttgataaattaatggaaattctctaacagaaaagacagaggtgacatatgagcaaaaaatcgattcaaaaggtgtatgcactcacaccgatgcaggagggaatgctgtatcatgcgctgcttgatccgcattcttcctcctacttcacacaattagagcttaggattcacggaagctttcagcttgagctttttgaaaaaagtgtcaatgagctgattcggacatatgacatcctgcgtacggtattcgtgcaccagcagcttcaaaaaccgcgccaagtcgtattagcagagcggaagacgaaggtgcactatgaagatatcagtcaattagatgaagcgcgccaaaccgaatatattgaacgctataaacgcgatgtgcagcagcagggctttcatctggcgaaggatattctctttaaagcggcggtgttcaggctcagtgagaaggaactgtatctcgtctggagcaatcatcatatcgtcatggacggctggagtatgggcgttttgatgaaaagcctgtttcaaaactatgaagcgcttcgtgccggccggcccgccgggggaagccagggcaaaccttactctgactatatcaaatggctcggaggcagggattatgaggaggcggaacaatattggagcagccgcctggcggatttcgaacagccgagcctgctcccgggccgtctggcatcagaaaagaaagactaccaaaatgaagaatattcttttgtctgggatgaagagctggtcgcgcagattcagcagaccgccaaccggcatcaagtcacggggcctaacctgtttcaggccgtttggggtgcggtgctcagcaaatacaactatacagacgatgtggtgttcggcaccgtcgtatcaggccgtccttcagaaatcaacggcattgaaacgatggcggggctgttcatcaatacgattcctgtcagaatcaagattgacaaagatgcagccttttctgacgtgatggcggcagttcagaaaaacgccgtggaagccgagcgctatgattatgtgccgctctatgacattcaaaagcgctccgctctggacggcagcctcttgaatcatttggtcgcgtttgaaaactatccgctggacaaagagctggaaaacgggggcatggaggaaagactcggcttttccattaaagttgaacatgcttttgagcagacgagctttgatttcaatctcatcgtgtatccgggaaaaacgtggaccgtcaaaatcaaatacaacggagcggctttcgcacatgatgccatcgaacgaacggcgcaccatctgacctgcatgatgaaagcggcggtcggaacgcctgacgcgcccgtgcgggaactcggccttgtttcaggcgaagaagagcggcagattgttgagatattcaatgatacgaaaacggcgcttccggaagaggaggccgttcaccgtttgtttgaagcacaggcaaaccggacgcctgcaagcatcgcgataaaagaagagggacgcgaatggacctaccgtgaagtgaacgaagcggccaaccgcctggcgagacaccttgtgaagagcgggctggaaaaaggccggaccgccgctattatgaacgaccggtctgcggaaaccgttatcggaatgcttgccgtcctaaaagcaggcggcgcctatgtgccgattgatccggcttttccggaggaccgtctccgctttatggcggcagacagctcgattcggctcgtgctgacagttcaggactatcaagaacaagcgggcacattgcaagtcccgattgtcatgctgaatgaaagcgcggatgaaacggtaagcggaacagacttgaatctcccggccggcggcaacgacttggcgtatatcatgtatacatccggatcgaccggcaaaccgaaaggcgtcatgattgaacacagaaatatcatcaggctcgtcaaaccttcgaattacgtgccggttcatgaagaagaccggatggcgcaaacgggagccgtcagctttgatgccggaacctttgaagtcttcggcgcattgctgaacggagcggcattgcacccggtgaaaaaagagacgctgcttgacgccggacgattcgcccaatttctgaaagagcagcggatcacgaccatgtggctgacgtctccgctgtttaatcagcttgcccaaaaggatgccggcatgtttaacacgctccggcacctcatcatcggcggtgatgcgcttgtgccgcatatcgtcagcaaagtgaggaaggcatcaccggagctgtcgctttggaacggctacgggccgacggagaatacgacgttttcgacgagttttctcattgatcaggactacgacggttcgatcccgatcgggaagccgatcggaaattccactgcgtacattatggacgaaaaccgcaacctccagccgatcggcgcgcccggggagctgtgtgtcggcggaagcggagtggcaagaggctatgtgaatctgcctgaattaacggagaagcagtttgtccgcgatccgttcagaccggatgaaacgatataccggacgggggacttggcgaagtggcttccggacggcacgatcgagtttctcggcagaattgacaaccaagtaaaggtccgcggtttcagaatcgagctcggcgaaattgaggcgaaaatcagccaggcggagaatgtgacggaatctgcggctgtgatccggaaaaataaagcggatgaaaatgaaatctgcgcttactttaccgcagaccaagccctttcgccggaagacctgcgcaaaacgctttcggaatcacttccggaatacatgattcccgcgcacttcatccagatgaatcagtttccgctgacggcgaacggaaagattgataaaaaagcgctgcctgagcctcaggctgaagccgttcaaaaagaatacgaagcgccgaaaacggaagcggagcagaaactcgcggacatttgggaaggcattctcggtgtaaaagcgggtgtgactgacaatttcttcacgattggcggacattctttaaaagccatgatgatgaccgctaaaatccaggagcactttcaaaaagaagtgccgattaaagtgttatttgaaaagccgaccattcaggagcttgcgcattatttggagcatgagaccgaggaggaacagcagtttgaaccgatccgacaagcgccttatcagaagcattatcctgtttcctcagcacagcgcaggatgtatatccttaatcagctcggacaggccagcacgagctacaacgtccctgctgtacttctgctggaaggatcagtagacaaaaaccgtcttgaagaggccatgcaggcattaatcaaccgtcatgagacactgcgtacgtcgtttgacatggcagatggagaagtcgtgcagaccattcataaaaatgtgtcgtttgagcttgaaaccgccgagggccgggaagaagatgcagaagagctgacaaaagcctttatcaggccgtttgcgctcaatcgtgcgccgctggtccgttcgaagctgatccggcttaaagaagaccggcatcttctgctgattgacatgcaccacattattacggacggaagctcaatgggcattttcatcggtgatcttgcgaagctttatcaaggcacggagcttgagctgccaaagattcattataaggatttttcagtctggcagcgtgaaaaagcaaatcttgatcagcacgaagcttactggcttgatacgttcaaaggcgatctgccggtgctggatctgccgcttgatttcccgcgtcctgccgagcgcagttttgaaggggaacgcgtcatcttcgggcttgataaacaggtgacggcgcagattaagaagctgctggctgatacggatacgacgatgtacatgttcttgttagccgcttttcaagtgctgctgtccaaatattcggggcaggaagacatcatagtcgggtctccggcggccggaagacagcatcctgatctccaagacgtgccgggcatgtttgtcaacacagttgcgcttcggtcgcatcctgccggcaaaaaaacgttcaagcaatttctggatgaagtgaaaacggcgagccttcaagcttttgagcatcaaagctatccgcttgaagaattaattgaaaaactgccgttaacgagggacacaagccggagtccgctgttcagcgtgttatttaatatgcagaacatggagatcccggccctgcggctcggagatttggagatttcttcttactccatgcatcatcatgtcgctaaatttgatctttccttagaagcggctgagcgcggagaagaggtcggattgagctttgattacgcgaaagccttatttgcggacgaaaccatccgccgctggagcgctcattttgtcaatctgattaaagcctgcgccgaaaatccggatattcagctggccgacgcaagcctgctgtccgctcctgagcgggaagcgctcctttctgatgaaaaacggacggaagcggatctgcctgagggcacttttgtttcgctgtttgaacggcaagcgcagaaaacgcctgatctcacggcggttgcgggcggaacaagtctgacatatcgtgagcttgatgaacgctcgaaccggtttgcccgacaccttcaggcttgcggaacgggcagtgaggacatcgtggccattatgatggatcgttcggccgacttgattaccgcgattctcggcgtcatgaaagccggagcggcatttctcccgattgatccggagactcctgaagagagaatccgctactctctcgaagacagcggaacgaagcttctggtcgtcaatgagagaaacatgaccgcggccgccgtttataaaggaaaaacggtcgtaatggaagacggagaatggcagaacgaaagcgccgaccggcttgaaacggagtccggcgccgaccggcttgcctatatcatttatacctcgggaacaacgggcaaaccgaaaggcgtccagctggaacaccgcaatctaatcaattatgtcacatggttcagccgtgaagccggtttgaccgaagctgacaaatccgtgctgctgtcttcttacgcatttgatctcggctatacggccatattcccgattcttcaggcgggcggcgagctgcacattgtgccgaaagagacgtacaccgcgcctgatcagcttggtgagtatatacagaaaaacggcattacgtatatgaaactgacgccgtcattgttccatatgatcgtcaatacagcccgttttacgtcagaacgccgtttcagctcgcttcgtttagtggtgctcggcggagaaaagatcatcacgtccgatgtccgcaagtttcatgacgtatacgcccataccgacttcatcaatcactacgggccgacggaaacgacgatcggcgccattgcggaacggatcaatatggagcgtcttgatcaatatgagcagcgtcccgtcatcggccgcccgatcgcaaataccggcgcgcttgtattggacggagcaatgcagctcgttcctccgggcgcaagcggcgagctttatattaccgggaaggggcttgccagaggatatcttcaccgtccgcagctgacggcggagaaatttctctcaaaacctttttcaccggacagcctgatgtacaaaacgggagatatcgtccgcaggcttcctgacgggacgattgaatttatcggccgtgcggatgatcaggtgaaaatccggggctaccgcattgaattaaaagaggttgaaaccgtgctgttaagcgtaaacggcattcaggaggcggtcgttctcgcagtcagcgaaggcgggctgccggaactgtgcgcgtactataaagccgacagcgggctgaaaggctctgagcttcgcaaacggctttccgaaacactgccgtctcatatgcttccggcctatttcgtgcaagtagaccgcattccgctcacagccaacggaaaaaccgataaaaacgccctcccgaaaccgggcgtcagccaaacggcgcaaattgcttcagccttgccggaaacggaattggaggaaaagctgtgccgcatttggaaacagacactcggtacggatacgctcggcatcgacgataatttcttcgattacggcgggcactctttaaaaggaatgatgctcctcgccaatattcaggctgaactggacaaaacggttccgttaaaagcgctgttcgaacagccgactgtccgcctgcttgccgcatatatcgaaaaatcggcggtatctgagggatatcggatgatcacaccggcagacagtgcagacgcgtacccgttatcatccgcccaaaaacggatgtacgttctgaaccagcttgaccgggagacaatcagctataatatgccgtccgttcttctgatggaaggagaagtcaatatttcaaggcttcagaaagcgctcaatcagatgatcaaccgccacgaatctttgcggacgtcctttatcgatcaaaaaggccagccgatgcagcagatcgcagaacaggctgacattgacctgcacatttttgaagcagcggacgaggagaaggcggatcttatcattcaggcattcattaagccgtttgatctgagcgcggctccgctcattcgggccgctcttgtcagactgaatgaaaagaaacacctgctgctgctggatatgcatcatatcattgccgacggcgtgtccagaagcatgctggtcaaagagctcgctcacctttacaaaggcggaagtctgccgtcgccgaacctgcactataaagacttcgccgtctggcagaatgaacccgggcaggccgaacggatgaaagaccatgagcgttattggctctcggcattttccggcgagcttcctgaattgaatctgccgaccgattttccgcgtccgccggttcaaagttttaaaggacaatccgtccgtttcagagcggggcgtgagacggaaaaagcggtgcgtgaattaatggaatcatcgggagcgactcttcatatggtgcttcacgccgcgttccatgtctttttgagcaaaatcacgggacagcgcgatatcattatcggttcggtgaccgcgggaagaacgagcgccgaagttcaggaaatgccggggatgtttgtcaatacgcttgcgcttcgcaatgaaacgcaaaaagagcagaccttcgccgggctgctcgaacgggtgaaacaaaccaatctcgacgcgctggcgcatcaggattatccgtttgaggatctgatcggaaagcttgacctgccgagagatatgagccgcaacccgctgttccaggtgatggtgacgacagaagatccggataaagaaacactggaactggagaacctgcgcatcactccgtatgagtcaaaccaaggcacggcgaaattcgatctgacactcggcggctttacggatcaagaaggtctcggccttcagtttgaatatgcgactgatctgtttaaaaaagaaaccattgaaaagtggagcgccgggttcctgcggattctgaagcaagcggcggaaagcccggacagaaagctgcctgagatttcactgatcagcgatgctgaaaaacaagccctccttgacgcatggaaaggaaaaacactctctgtgccgcaggacaaaacggttcaccgtctctttgaagaaacggccgcccgatacgcgaaccggccggccgcggcatataacggcgcgaaatggacgtacggcgagctgaacgcaagggcgaaccggatcgcgcgcattctcatagactgcggcgtcacggctgacgaacgtgtcggcattttgacgaaaccgtccttggaaatggccgcgggcgtactcggcgtcctgaaagcgggcgcggcatttgtgccgattgaccccgactacccacaagagcggatcagctacattctgcaggacagcggcgccaagcttcttctcacacaggaagcgctggacgtgccggatggctacacaggagaaacgatcctgcttgacggcggacgctccattctgagcctgccgcttgatgaaaacgatgaagcgaacccgcagactgaaacaacggcggatcatctcgcttatatgatttacacgtcaggaacgaccggacagccgaagggtgtcatggtcgaacaccatgcgctggtgaacctgtgcttctggcatcacgacgcattcgccatgacggcggatgataaaagcgccaaatacgcgggcttcggttttgacgcctccatctgggagatgttcccgacatggaccatcggcgcggagcttcacgtcattgacgaagcgatccggctggatatcacccgcttaaatcactatttcgaggagcacggcgtgaccatcaccttcctgccgacgcagctggccgaacaatttatggagctggaaaatacctctctccgcatgcttctcgtcggcggcgacaagctgaagcgggcggtgaaacagccgtacacgatcgtcaacaactacggcccgacggaaaacaccgtcgtcgcgacaagcggcgtcatcaatcctgaggaaggatcgctttcgatcggacgggcgattgccaatacgagagcttatattctcggcgacggcgatcaggtgcagccggaaggcattgccggtgaattgtgcgtggccggccgcggtctggcacgcggatacctgaaccgtgaggaagaaacggcgaagcggtttaccgcagatccgttcgtgcccggcgagcgcatgtaccggaccggcgacctcgtcaaatggaacgcgcagagcggcatcgaatacatcggccgtatcgaccagcaggtcaaagtgcggggctaccggatcgagctttcagaaatcgaagtccgcctcgcccagcttgcggacgttcatgacgcagcggtgacggcggtggaagacaaagcgggcaataccgcgctttgcgcctatgtcgcgcctcggcaggacgatattgaagcgctcaaagccgcgctgaaagacacgctgcctgactacatggtgccggcgttctgggtggagatggacgagcttccggtcaccgcaaacggaaagattgacaaaaaagccctgccggaaccggacattgaagcgggaagcgccgcttacaaagcgccggaaacggagatggagacgctgctttccgacatttggcaggaagtgctcggtcttgatcagatcggcgtaagcgataatttcttcaccctcggcggcgactcgatcaaaggcatccaaatggcgagccgcctgaaccagcacggctacaagctggagatgaaagatctcttccagcacccgaccatcgaagagctcgtctcttatgtggagcggacggaaggcaagcaggccgaccagggacctgtcgaaggcgaagcggagttaacgccgatccagcgctggttctttgagaaaaacttcacggacaaacaccactggaaccaatccgtcatgcttcacgcgaaagacggctttgatccggacctggtggaaaaaaccctgcaagcattgattgaacaccatgatgcgctccgcatggtttaccgtgaagaaagggaaggcatcattcagacatacctccctgtcacagaatgcaaggcaagctttgaaatcgttgatctgtacggaacggacgaggatatgctgaaaagccagattcagcggcttgccgatcatcttcagggcagtcttgatctggagaacggcccgctgttaaaagcggagcaataccggacagaacaaggcgatcatctgttaatcgcggttcaccatctcgtcgtggacggggtttcatggagaattctgctggaggatttcgcttcaggttataaacaggcgcagcagcaaaacagcatcgtcctcccgcaaaaaacccactcctttaaagattgggcggaggcgctgaacacgtttgcgcaatcagaagagctgaaaaagcaggcggattattgggcgcaggcagatgcggaagagctccggccgctgccgaaagaccatgatccggacaaacggctcgtcaaacatacggcggccgtgaaatgtgaattgactgaggaagaaacggcacagctgctgacagatgttcatcatccgtacggaacggaaatcaacgacattctgctcagcgcactcggcttaacgatcggtgaatggacggaaaacggcaaagtcggcatcaacttagaaggacacggccgggaagaaatcataccgaacgtcaatatttcacggacggtcggctggtttacggcccaatatccgttgattctgcagatcagcaaggaagacggcgtctcttccgtcattaaaacggtaaaagagacagtgcggcgcgttccagataaaggtgtaggatacggaattctccggtatctgtcatccgatgaaacagaaaaaggcgccgcgcctgaaatcagttttaactacttggggcagtttgacaatgaagtgaaaacggaatggtttgagccgtctccatatgatatgggacgtcaagtcagcgaagagtcagaggcgttatacgcactgagcttcagcgggatggttacaggcggccgcttcgtcatttcctgctcatacaatcaggaagaatatgaaagaagcaccgtcgaaacacagatgcagcggtttaaagacaatcttttaatgatcatccgccattgcacggccaaagaggagaaagaatttacgccgagcgatttcagcgcgcaggatcttgagatggatgaaatgggagacatctttgacatgcttgaggagaatttaacgtgacaaaaacagttaacagaaggggggagcggagcagatgagccagttcaaaaaagatcaagttcaggacatgtattatttgtcgccgatgcaggagggaatgctgtttcatactctcctgaatcccggccaaagcttttacatcgaacaaatgacaatgaaagtaaaaggcagcttgaatatcaaatgccttgaagaaagcatgaatgtgatcatggaccggtacgatgtatttcgtaccgtgttcattcacgaaaaagtaaaaaggccggtccaagtcgtattgaaaaaacggcagtttcagatagaagaaatcgatctgacacacttaacgggcagcgagcaagcatccaaaattaatgaatacaaagaacaggataagatcaagggctttgatttgacgcgggatattccgatgcgggcagccatctttaaaaaatcggaagaaagctttgaatgggtgtggagctaccaccacatcattttggacggctggtgcttcggcatcgtcgtgcaggatctgtttaaggtatacaatgccctgcgagaacaaaagccgtacagcctgccgccggtcaaaccgtataaagactatatcaagtggcttgaaaagcaggataaacatgcatcactgcattactggcgcgggtacttagaagattttgaaggacaaacgacatttgcggagcaaagaaagaaacaagagaacggctatgagccgaaagagctgctcttctcactgccggaggcggaaacaaaagcatttaccgagcttgcaaaatcgcagcataccactttgagtacggcgctgcaggcggtttggagtgtattaatcagccgctaccagcagtccggcgatttgatcttcggcacagtcgtttccgggcgtcccgcagaaatcaaaggcgttgaacatatggtcgggctgtttatcaatgctgttccgaggcgggtgaagctgtctgaggataccacatttaacggcttgctcaagcagctgcaggagcaatcgctgcagtctgagcctcatcaatatgtgccgctctatgacatccaaagccaggccgatcagccaaagctgattgatcatattattgtgtttgaaaattatccgcttcaggatgcaaaaaatgaagagaacagtgaaaacggctttgatatggaggacgtccatgtttttgagaaatcgaattatgatctcaacctgatggcttctccaggtgatgagatgctgattaagcttgcctataacgggaatgtgtttgatgaggcgtttatcctgcgcttaaaatctcagcttctcacagcgattcagcagctcatccagaagccggatcaccctgtcaatacgatcagacttgttgatgaaaaggaaagagagcttctgcttaccggcttaaacccgccggctgagactcatcaggcgaagcctctgacggattggttcaaggaagcggtgaatgtaaatcctgatgcaccggcgcttacgtattccggccagactctttcctatcgcgaattagatgaggaagcgaaccgtcttgcgcgccgtttgcaaaagcaaggtgcgggtaaagacaccgttgtcgcgttgtacacgaagcgctcgcttgaactggtgatcggcattctcggcgtattaaaagcgggagcggcttatctgccggttgatccgaagctgccggaggaccgaatctcgtatatgctgactgacagtgcggctgcctgtctgctgacacatcaggagatgaaagaaaaagcggctcagctgccgtatacaggaacaacactcatcatcgatgatcaagcacggtttgaggaacaggcaagcgatcctgcagccgcaattgatcccgatgatccggcgtatattatgtatacgtccggcacaaccggaaagccgaagggcaatatcaccactcatgccaatatacaaggattggtcaagcatgtagactatatggcattttctgaacaagatacgttcttatctgtttcgaattacgcctttgacgcatttacttttgatttctacgcatcaatcctgaatgcggcacggctcattatcgcagatgaacatacactgcttgatacagaacggctcactgatctgatccggcaggagaatgtcaatgtcatgtttgcgacaaccgcactttttaatcttctcaccgatgcgggagaggagtggctgaaggggctccgctgtgtgttattcgggggtgagcgcgcgtctgtgcctcacgtcagaaaggcgcttgagatcatggggcctggcaagctgattaattgttacgggccgactgagggaacggtgtttgcgacagctcacgtcgtgcatgatataccggattccatttcctcattgccgatcggaaagccgatcagcaatgcaagtatttatattcttaacgggcaaaaccagcttcagccgttcggagctgtcggtgaactgtgcatcagcggaatgggtgtatcaaaagggtatctgaaccgtcacgacctgacgaagcaaacgtttatcccaaatccgttcaagccgggagaaacgctttaccgcacaggggatttagcacgctggctgccggatggaacgattgaatacgccgggcgtattgacgaccaggtcaaaatacgcggtcaccggattgaacttgaagaaatcgaaaagcagctgcaggaatacccgggtgtgaaagatgcggtcgttgttgcagaccgccatgagtccggagatgcatcaatcaacgcctatctcgtgaaccggacgccgctttcagctgaagacgtaaagaggcacttgaaaaaacagcttcctgcttacatggtgccgcaaacctttactttcttagaagagcttcctttaacgacaaacgggaaggtcaataaacggcagctgccgaaaccggatcaggctcaggcggcgaaagaatggatcgggcctcgaaacgcgacggaagaaacgattgcacacatctggtccgagattctcggcagacagcagatcgggattcatgatgatttcttcgcgctcggaggccattccttaaaagcgatgacggcagcgtcgcgcattaaaaaagagctcggtacggacatcccggtgcagctgttattcgaagcgacgacaatcgcagacattgccggttatctgcttcacggtgaagaaaaaggaatgaaagatctcaccatcatgaataaaaatcagtctgacacactgtttgcgttcccgccggttctcggttacgggctgatgtaccagccgctggcaaaacagctgtccggctatagaatctgtgcgtttgattttatcgaggaagacaaccgcatcgaacgctacacagagctgatcaatcagctccagccggaaggaccggtcaagctgttcggatactcggcaggctgcacgctcgcctttgaaacggccaaacggcttgaagccgaaggacgtaaagtggagcggctgatcatggttgattcctataaaaaacaaggcgtcagcgacttggaaggccgcaccgtagaaagcgatgtccaggcgctgatgaaggtaaaccgggataacgaagcgctgaatgacgaagccgtcaaagaaggtctcgccaaaaaaacaaacgcgttttattcttatttcgtgcataccgtcagcaccggcacggtcaatgcggatatagatctattaacgtcagaaccggactttgcgatgccgccgtggctcgcttcgtgggaggaagccacgacaggtgaataccgtgtgaaaaaaggctgcggcagtcacgcagaaatgcttcagggagaatgtctcgaaaggaatgcggcatatttgctcgaattcctaaggaaggaacatccgaagctgacagcttcacgatagaaaaggaggaagcccgccaatggtccagctctttaaatcgttcgataccacggaaaaaacgcagcttatctgttttccgttcgcaggaggctattccgcatcattccgcccgctccacacctatcttcaaggtgagtgtgagatgcttgccgcggaaccgccgggacacggaacaaatcaaatgtccgccgttgaggattttgaacagcttgtcagtttatacaagcaggagttgaatctccatcctgaccgcccgtttgtcctgttcggccacagtatgggaggcatggtcgctttcaggctggcgcaaaagcttgagcgggaggggatttacccgcaggccgtgatcatctcagccattcagccgccgcatgttgaaaggaaaaaagtgtctcatcttgatgatgaaaaatttctcgcccatattatcgagctgggcggaatgccgcaggagttagtggagaataaggaggtcatgtcatttttcctgccttctttcaggtccgactaccgcgcgcttgaaagcttccgtccgtctgattctcacatgattcaatcacccgtccatatttttaacgggcggaaagataaaaaatgtatcaaagatgcggacggatggaaaaaatgggccgacaatcccgtatttcatgagttttcggacggccacatgttcatattaagtgaaactgaaaaagtggcggaacgaatatatgagattattaacaggagcactgcaggccaattgttataggatatgacagacagcattcgctgtctgttttttgtaacaaaatctgcccgtgagttttctcatttatcaaaaattttatgttatgatttgatggaatataattttgaagggattgtcgtacatgaatgatgcagcaaaagagctgaacagaacattatctgaagaaaacccgcacgtgcttcatatgctttctgatttgggcagagagttgttttatccgaaaggggtgctgacacaatcggcggaagcgaaagccaaggccggaaagtataatgccacgatcgggattgccacctcacaaggcgagtccatgcacttttcccatattcaagagacactgtccgcctataaccccgatgatatctacgattatgctccgccgcagggaaaagagccgctcagacaggaatggctgaaaaaaatgcgtctcgaaaatccttcattagccggcaaagacatcagcacgccgatcgtgacaaacgctttaacacacgggctgagcattgccgccgacttgttcgtcaatgaaggggatgcgctgcttctgccggataaatattggggaaattacaatttcattttcggtgtccggcgcaaggcatccattgagacgtacccgctttttcagcaggatgggcgttttaatgcggcggggctgtccgagctgctgaaaaagcaggaagaaaaggcgattgtcgtgctgaatttcccgaataatccgacaggctatacgccgggggaagaggaagcgtcagaaatcgtcagtgtgatcctggaggcagcggaggccggcaaagagattgtcgtgctcgtagacgatgcgtattacaatctgttttacgatgaaacggccattcaggaatccatcttcagcaaactcgcccaagtgcacgaccgggtgctttgcgtaaaaatagacggcgcgacgaaggaaaattacgcgtggggcttccgcgtcggttttattacgtacagcacaaaaagcgaaaaagcgctgcgcgtgctcgaggaaaaaacaaaagggattatcaggggaacgatttcaagcgccccgcatccgtcccaaacgtttatgctgcgggcgatgcagtcaccggaatacgagaaagaaaaatcgctgaaatataatatcatgaaaaaacgggctgacaaagtgaaagccgttcttgcagaaaacaagcactatgaagacgtatggacgccttatccgtttaactcgggttatttcatgtgtgtccggctgaaagacataaacgccggcgaattaagagtgtcgttgcttgaaaagagaggaatcgggacgatatccattaatgaaaccgatttgcgaatcgcattttcatgtgttgaagaagaatacatcgcggatctgttcgaagaaatttatcaagaagcaaagcagctgcagaaacaggcggaaatatcaggctgacaaaaaaaggagggggataccctcctttttctatgcttacatcagctcttcatacgttttcatctcaatcccgtcacaaaaatcgggatgcgccgcacaaacggccagcttatattcctcgtccgcatcatatgtgcggatgaaacaaggttcatgtccgtccgggagctcaatggacacatggccgtcgtctttgaggcggacgctgaatgaatcaagcggaagggaaagcccttttccggcctgcttgataaagctttctttcatcgaccacaggaggtaaaaataatcggtctgctgatcggggtgtttcgcttgcagatcactgtattccgtcggcgaaaaaaaacgtttggcgatatcaatcgtgccgggcttcattttttcaatatcaatgccgatcggttttgaatcaacggcacacacgatccagcgcccggagtgggaaatgttaaagtgcatgtccggaagcgcggggatgtacggctttccgtattcctggacgctgaatgaaatcgcggccggatcaagtccgtaagccttcgccgcagcggtgcggatcagcatgtcgccgatcaaggtgcggtgagcatcctccttatggtaaaagcgccggcatttttcccgcttttcggcggacacggccgccatcatccgatcctcttcccctgcagaaagcgggcggtccatatatactccgtaaatcttcatgtccagatcctccgtctgaaaatattgtcaaaaccatcctaccatatcagacgaaagctgtccgaaaataaaaaaacaaaaccgtttcggctttgtttttaatgaacggacgttgcccgcccggagatcgcgtatgttaacagtttagaggactgcggcaaagaaaaacgcagaatcagccccgtcaaaacagccgtaataatggttccggcgccgatcggtccgcccatcacccaggctgcggcaagaatcgtcagctcaatgccgttccgcacccattgcacgttccagcccgttttttcagatatcagcatcatcagagagtcccgggggcccgcgccgagccctgctgatacgtaaataccgacgccgcagccgatcagcagcaatccgatagaaaaaaacacggccgctaaggaaaaagcgtgcgcctcaggaagcagaaacgagaagaaatcaataaacattcccatcagcaccatgtttaagatagcgccgattttcgggagcgtcctcgtgaacaggcaggttaaagccacgatgaccgcgccgaccaagatggaccattggccgacagatagcccgaaatgctgaaaaagcccataatgaaaggcatcccaagggctgatgccgagagcttttcctttaatggttaacgataccccgaaagacaaaatcaacagaccggcaaaataaaacgtccagcgcatcaagaattcccgcttcaaagaggtcccttctttcataacattcattaattgtcattgtagcataaccgcccaaaaaaagaagaagcgaaatcagtgtttcgcttcttctccggctcctacaaaggattcagtatacgatttaaaaaccgctgcgtgcgttcttctttcggcgcggaaaaaatctgggccggcggtccttgttccacaatgacgccgccgtcaatgaagatgacttcatcggccacttcctgcgcgaatttgatttcatgggtgacgacgaccatcgtccagccttcgttcgccagatccttaatcactttgagcacctcgccgaccagctccggatcaagtgctgacgtcggttcgtcaaacagcatcagctcgggctgaatcgcaagcgcgcgggcgatgccgacccgctgctgctgaccgccggaaagctggaacggatataaatccattttgtctttcagtccgactttttccagaagctctatcgcttcttttctgacttgctccttgtcgcgcttttgcacttgaacgggtccttccatgacgttttcaagcgccgtgcggtgaggaaacagatgatacgcctgaaagaccatgcctgatttgcggcggaggcggagaatatcagcctgcttcacttttttggagaaatctattgaaaaatcggagaatgccagctcgccgcgattggggatctcaagcgcgttcagacagcgcagaagcgtcgtttttcctgaaccggacggtcccagaatggcgatgactttccctttttctatctccatatctatcttttttaaaatttcattctgtccgaatgatttatttaatcctttgacggaaagcatatcgaaacctccttatttggccacataacggtcgagacgccgttcgatcacatgctgtacgattgacagcaagaagcagatgatccaataaataaaggcggcttcaatatagatgaccaagatttgatcaaggttttgcgcgccgatttcctgcgcttttctgaacagctccgcgacgagaatctgtgacgcgagagatgtatccttgatcaggctgataaatgtatttgataatggcggaatggacacgcgaaacgcctgcggcaggatcacgcggaacaatgtcttgcgataggtcatgccgatcgtataaccggcttcccattgccctttcggcacggatgaaatagatgcccggatgatttcagaagcataggcgcccacgtttaatgaaaacgcgatgactgcgcttgggaaagggtccagcgtaatattaaatgtcgggaacagataaaaaatgatgaacaattgaacgagaagaggagtgccgcgcaccgctgatacgtatacgctgaacacccatctcaatggtttcatatttgacattctggcgagcgccgtaatcagcgcgatgatcattccgaaaataaaggaaagaatggtaaggggaatcgagtaatagattcccccggaaagaatcggccagaatgactgctgcaccaaatcccacggaatggctgttgcaatcacgggttccggcatgttacttagaaacatcttcgccgaaccattttttcgctattttagaaagagtcccgtcctctttcatttcttttaacgctttgttgacgtgagtcacaagttcgccgcttccttttcggaatgcgaaatatgtctgctgcggctggcctgcttcaaacgcgattttcacgtttttattgccggacgtttttaagtagttcagtacggcaagcttatcgttgtaagtcagatcagcgcggccctgctgaatgagctgaagggattgcgccatgccttcaacgccttcaattttcgcgccggcttctttcgctaatttattgtaattgcttgttaatgactgagccgctgtttttcctttgacatcagcctctttcgcaatcgtgctgtcttttttcgtcacgacgactgcatttgacgttgtgtatttatcagaaaaatcatattggttctcacggcctgttttgccgacttggttggcgacgacgtcaaaccgtttcgcgtttaaaccggcaaacatgctgtcccattgtgtttctttaaagtcagctttcagaccgaggcgtttcgcgacttcttgaatcacttcaacatcatatccggtcagtttgtcagtctttttatcatggaaggtaaacggttcgtacgttccttctgtaccgacggtcagtacgccttttttcttgacagaagcccaaagatcgccgtcttttgacttagatccgctgtcctgtgagtttccgcaggctgcaagcattgcgatgctgaccatcatgaacaaagcgaataatgcttttttcatcttctttattccccacttttctgagtagttttattgagaaaaaatagctcccaattgtaaaggataacttttttttagtatgagtcaagtaattggttttcataagcgggaattcatcgtgttccggatcaaaataattccaaaaactgtctgacaggcttcggcaggtagctgtcttttctccagatgacggccggtgtcatgacaaacgggttgtcttcgatgataaccgttttgacatgcgagcgcatatggacgggaatcatcgtcaaaggcagaattgtggcgccgaatcctgatgatacaaggctcaagagcgtcgcggagtcatggcattcacaaacaacctggaggtcgagaccgtactgttcacaaacttggaggacttggtcatacacacctcttccattgacggtgcgcaaaaggatcagaggcaaagaggcgatgtcattcagtttaatcgtttctccgcacagtcgttttgaatgctcggacagcaccaatacacacggaatgtcttcaagctccttcgattcaatgccgtcgtttttaatcaaggtggtggtgacggcggcgtcaatctgccgggtttccagaagctccagcagtgagacgggttcatcttcccaaatgttaaaggtgagatgcggaaaccgctctttcatctgtgacactttctcaagcatgagcgctgcgcagtaaatggttgacccgacggcaagtgtcccggccacctcctccttcagctcttgtacctcgattatagcgtcctcaaacttatgaagaatctctttcgctcttttcaaaaagacgtttccttcatatgtgagggtcatttgtttctttttattgcggtcaaacagaatgacgcccaattcttcttcgagctgtttcaactgtcggctcaaaggcggctgtgccatatggagctttttggcggccgtcgtgattttctgctcttgggcaatggtgatgaaataacgcaattgccgaatatccatgagaacgctcgctcctttcttttatacctttaaggtatgatacatagatttaacgaatatttttcatatggatatatcaggagtatgatggatttgacaccacatttcaagcgtaaaggagggtcaatatgaagctcgtcatcggaatgaccggggcaacgggagccatattcgggatcaggcttttagaatatttaaaagccgcggagatcgaaacccatcttgtcgtgtctccttgggcaaatgtcaccattacacatgaaaccgattatacgttaaaagatgtcgagaaactcgcatcctatacgtattctcacaaagaccaggcagcggcgatttcaagcggttcgtttgaaacggacgggatgatcatcgctccgtgcagcatgaaatcactggcaagcatccgcaccggaatggctgacaatctgctgacaagggcggctgacgtcatcctgaaggagcggaaaaaacttgtgctgctgacaagagaaacgccgctcagccaaatccatttagaaaatatgctagcgcttacaaaaatgggttccgtcattcttccgccgatgccggcattctataacaagccggctgacatggatgaattgatagaccatattgtgttccggacgctcgatcagttcggcatccgtctgccggaagcgaaacggtggtacggaattgaaaaacaaaaaggaggaatctgataatggcctatcaggattttagggaatttctcgccgctcttgaaaaagaagggcagctcttaaccgtcaacgaagaggtaaaaccggagccggacctgggcgccgccgcgcgtgcagccagcaatctcggggataaaacccctgcgcttttgtttaacaatatttacggacatcacgatgcgcaggtggctctgaatgtcatcggctcgtggccgaatcacgcgatgatgctcggcatgccgaaagatacgcctgttaaagaacaattctttgagtttgccaaacggtacgatgcatttccggtgccggtcaaacgggaagaaaccgcgccgtttcatgaaaatgaaataacggaagatatcaatctatttgacatccttccgctattcagaatcaaccagggggacggcggctactatttggataaagcgtgcgtcatttcccgcgatcttgaagatccggacaatttcggcaagcagaatgtcggcatttacagaatgcaggtaaaggggaaagaccgcctcggcattcagcccgtgcctcagcatgatattgcgattcatcttcgccaagctgaagaacgcggcgtgaatcttcccgttacgatcgcgctcggctgtgagccggtgattacgacggctgcatcaactccgctgttatacgatcaatccgagtatgaaatggccggcgcgattcaaggggagccctacagaatcgttaaatctaaattgtctgatttagacatcccttggggtgctgaagtcgttctggaaggagagatccttgcgggagaacgggaatacgaaggacctttcggtgagttcacgggccattattcaggcggccgcagcatgccggtgatcaaaatcaaacgggtatatcatagaaacaatccgatttttgaacatttatacttaggcatgccgtggacggagtgcgattatatgatcggcattaatacgtgcgtgccgctttaccagcagctgaaggaagcctatccgaacgaaatcgtcgccgtgaatgcgatgtatacgcacgggctgatcgccattatctccacgaaaacgcgctacggcggatttgccaaggccgtcggcatgcgcgccctgacgacgccgcacggactcggctactgcaaaatggtcattgtcgtggatgaggatgtcgatccgtttaacctgccgcaagtcatgtgggcgctctcaacgaaaatgcatccgaaacacgatgcagtcatcattcctgatctgtccgtccttccgcttgacccggggtctgatccggcagggatgacacacaaaatgattcttgacgccacgacgcctgtcgcgccggaaacaagaggccattattcgcagccgcttgattccccgctgacaacgaaagagtgggaacaaaaactgatggacttaatgaatcaataagaaaggatgagtttactatgaaaacatgcccgcgatgtgaatcgcaaaaaggagaaaccgtcagccaatcgccggtcaaaggcgcttgggaaatataccaatgccaaacctgctttttcacatggagatcctgtgaaccggaaagtatcacgaatccggcggcattcaacccggcatttaaaatcgatccgaaagaaacagagacggccacacatgttcccgctgtcccggaaagaaaagcgtaatgctgacggagcacttgccggaggcgctttacgcgcttttagacggaacggaacttgaaaaaaagcagcacgacgcatttgtgctccaatccgtgacaaaagaaggccgtccgcacgcggccatgatcagcgccggtgaaatcgcggccgtgagcagaacaaatctccggctcgccttatggaaaaacacgacgaccgtaaaaagcctgctgcattcgggacaagctcttttcatcgcctggcacggaggagccgcatattacgtcacattggaatgtaaggcgcttccgccgttgaaagaggcgaaacacgagcgggaacggttcagctgccgcgtgatcaccgtcaaggaagatcgggcgaaatacgcggatctgacatcaggaccggccatccagctccacgaaccggaagatgtcctgaagagatggagagaaacacttgaggagttaaaacgatagacgcacaaaaaaagcctgcggacgattccgcaggcttctcttttattgtacgcctttcatcgcccgtttaatgacgggagacagaagaattaaaataataccgagaatgatcgaaacaagaccgattgagccgaagtaggccgcttcagaaatcttatcaaacaaaccgactacttttgcgttcagggcttgaccgcaggcgtttgttaaaaaccacatactcatcgtctgcgctgagaaagctgcaggcgcaagtttcgttgtgacggataaaccgaccggtgaaaggcaaagctcaccaagcacaaccaaaaggaagctgagcacaagccaaagcgggctcacaagctcgccgcttccgcccataaccggaagcaccatgactaaaaatgataatccggcaaggataatgccgatcgcgaatttaatcggtgttgaaggctggcgtttgccgagcttcatccagatccacgcgaacaccggcgcgaaaataacgatgaataatgggttcagagactggaaccatgaagactcaagatgcatgcccgcaaaggaaagtctcgtgcgctgatccgcatataaagctagaatcgtcgcgccctgctcctgaatcgcccagaacattgccgctgcaataaacagcggaacataagccgcaagccgtgatttttccgttttcgtcgcttttttgcttgtgaacatcacgataaagtaaataaccggaatgacaatgccgaggatactgacggtgtcaatcacacgctggatcgtcagccagccggtttgaatcagaacaataataacggctgctgcgatgaccactccgattcccgtgccgatcactgatgatttagaaatcggattcggtacattggagcctgctttgccgaggtatttctttctcgttagagcgaaaacaatcagtccgaggaacataccggccgcggcgcatccgaagcctaagtggtagttgtacttctgtccgagtgttccgacaattagcggcgcaagcaatccgccgaggttgatccccatgtaaaagatgctgaaacctgagtcgcggcgctcgtcttccttcgtatataaatctccgacaacgctggatacgtttggtttaagcaggccggttccgataatgatcagagccatgctggtaaaaaacgccgccgtgctgccggggaaggcaagagcgatgtgcccgaacataattaaaattccgccgtaaaatacggtgtttgccgtgccgaatacccggtcggccagccatccgccgatgacgctcgacatatatacgagagatccgtatatggacatgatggcaactgcggtcgttttatcaaagccgagaccgccatgagcgacttccgtgtataaatagtaaagcaatatggctctcataccatagtaggagaaacgctcccaaaattcggtaaaaaacagtgtgaacaagccgcggggatgaccgaaaaagcctcgttgcggcacagtttctgttatagattccttatcaatagatgccacctgagccaaccctttcttaaaaaagtgtattacaaaaatcatattcttatataatacttgtgtcaatataatttatactgaattcaaaaaattccagaatgaaaagatattaaaacggtgaatatagacgaattttcctgattccaatgacttattttgttatattatctgactaaactatctttataaacttttttaataaaatttaaagtatgtacaggcggagcgggatatggcggaataagatgacaataagagaggaaggaggagattatcacttgccgaatcgtatattggatattacggattgcggtgtggcggcagacggaaaaaccgatgtgacgggcgccatcaaccaatgcttggccagagccgtcagcgaaggctgtcatacggtgttttttccgcccggaacgtataaaatcaacggcacgcttggcggggacaaaagccagccgtttcggaacgccgggattaacgtgccgagccatctcaccatcgttttagatccggaatgcacgattaaagtggcgccgaacagctcctggggctactcggctttctatataggcaggcgtgaaaatgtcaccatcaccggcggccggatcatcggggaacgggatgaacacacgtataccaatgtccctttgcggtcgacccatgaatgggggtttggaatctgtattgaaggcagcagcaatgtgctgatcgaaaatgtgaagatttcagattttacgggagacggtataattgtcagcccgctcgggttaaaaacaaacagtgattacgaaacttcagaacaggtgaccatccgccgctgtgagatcaggcagtcaaggcggaacaacatttcaatcaccggctgcaataccgttacggtggaagaatgcgtgattgaagacgccgggcaagggaacggaacggctccgaaattcggaatcgatattgaatcgtacggagaaggcgatattgattatgaagaagctcttcatattacggtccgcaacaacttcttttccggaaacgccgcaagctcagtcaccaattttaacggatataatgtgttaattgaaggaaatcattccgataacacaatcagctacgggtatggggcgcataccgtcattacggggaatgtcttctttcggtcagacggcggctcaaggaccgcagtcgccggacaaggtgtgtcacaaggacaggacagcagcagtgccgtcatttccaacaatctgattaccgggttttccaccggaatagatgtaaggggaaaaagcgtcctcgtcacccacaacaaaattaatcaatttgaaaatacgggcatttccgtctatcaggcagaagatgtgaccgttgacggcaatgtcattgaaaacggacgttccgaaacgagacgaagcacggggatgcgggcgacgctttcggagaacgccgtctttacgaataacactctgaatcaggtgacagacggaatcagcatgtcggccggcagtatcattgtaaaacaaaatgtgctgaaatcgttcagccggggcatatgggtcacaggcggaaatgccgttattgaaggaaatacgctccttccgaatgcgtatcagggcgccgcggagtcctatgccgtatctgtgacaaatgacgccggggctgtcatcaaaggcaatctctttaagaactataaaaactatcccgtattcagttcaacatcctcgggaacctctgtcatcagcaaccgctttgaatcatcaccgcttatcgttaccgtgtatctgaactcaggcacgcatgaagtcatagacaatacgctcacgatcaaccgaacagcgggcagcccgatcggcatctatctgaacggagcctccaattccctcgtttcgggcaataccatcaacaacctatccgccgcttctgcttccgccatccaaaccagctcctccgcaagtactaaaatcatcggcaaccgcattatcaaaggcgtcattgtgaagcacgcgacagatacggaaagcggaaatatcgtcatctgagaacaatctgcgccggaaaaataaaaagaacacatgaactccgagagaaggaggaatgtgttcttttttgacacaatacagccttgcgcctgtcaggcatcttttttacctgatttatataaagcgatcatttctctgattaaaaagagggcgaataaaaacagcatcagccattctgagaaggtggtcaatttaaaagcggacaggttgttttgaaccgctccatagaaactgaaaccttgcagcatatccaccgttactgaaatgatcagacaggcagtcagcaaaaagaatgaaacccctaatattttcatgcgcatcactctccctttttatccttttcgattacgcagaacttatacagactttccgccgtgcataatcttttgccgtacaggaagaatatgaaaaaaacgaggaaaggttttttgcgatatgccgccattttttaagcagaggaaacaaaaaaaagccgatcaaaacgaccgtgacaatgaaggcagaaaagaagcggacagccagccggacaaagagcgggatgagccgatctccctcagcttaaagcaaaatatgaagaagctgtctgagaggttcggcaacagtgccgatgtcgtcatccgccggctgaaaatcggaaaagaagagcttccggccgcaatcgtgtatatcgccggtttggtagacgaacagcttgtcagccaatcccttctggaggatttaatcgatatcccgtccgttcagccggaacaagcggtctgcctgatatacgataaaacgcttgcgatcggcggggtgaaagaggaagaaaaatggaaaagcctttatgccgggctggtggcgggcagcacgctcatttttgtcgacggggctgacaaggcgctgatcgccagcacggaagggggagagcaccggtccattcaagagccgagcactcaggtctctttccgcggcccgcgccagggattcactgaatctctgcaaaccaatatttccatgatccgcaggtatgtaaaaacgcctgatgtatgggttgaaaaaatggagatcggacacgaaacgaatacggatgtcgcgctgatgtatattaacggaatttgcgataaaaagctgattaaggaagtccgcaagcggctgaagcacattgacatcgacagcatcctggaatccggctacattgaacagctcattgaagacgcgccgttttctgtgttccccaccgtatatcatacggagcggccggacgtcgtggcggggaatctgctggaaggacgatttgcgattatcgtggacggaacgccgttcgttctcatcgcgccggccttatttattcaattttttcaatccgttgaggattattattcacgatttgatatcgccacaagcatcagggtgctgcgggttttgattttcttcatttcactggtggcgccggggatttatgtggcggcgacgacctttcaccaggaaatgattccgacgcagctgctgattgtcatcgcggctcagcgggagacggtgccgttcccggccgtgattgaagcgctgacgatggaagtggcttttgagattctcagggaggcgggtgtccggcttccgagagttgtcggctccgccgtttccatagtcggagcgcttgtcatcggccaggccgccgtacaggccggcatcgtctccccggccatggttatcgtcgtcgcgctgacggcgattgccagctttgcgaccccggcttttgacatggcgatatccgcgcggctgatccggtttctctttattctgtcagcggcggtcatgggattttacgggctgattctgggcattatcatgatgttcgtccatctgtgcggcctgcgttcattcggttttccgtatatgtccccgctcgctcctttgaccccgggcgggctgaaggattccatcctccgcgctccgttatgggcagatgaaaaaaggccggaactgctcgtgcaggaaaacaacaggcgccaaggggaacatcaaagaccgaaaccggagacatccagagggatggttaataaagatgtagaagagggcgacggtaatgaaaagacgtaaatggatacttatcctttgtacgatggtttcccttatgtttgtatccggatgctgggataaaagggagctgactgatttggctgtgatctccgccatcggtattgaccggaccgaaacgggaaaatacgtccttcacttgcaaattatcaatccgggaaacgtggccggcggtctgcagggcggcggagcgggagaccggcctccggtttccgtctattcggtgtccggagacaatatgacggaagctttgagaaaaggctcgatgaaagtgtccagaaggctctattttgcgcatacgaatctcgtggtgttcagtgaaaagctggcgaaagaggaagggctcagttttattctggacaatcttgaccgcgacaccgaattcaggacgaccgcaaccgcggtgatcgcgcataattgcaaggctgaagacattattaaagtgctgacgccgattgataaaatcccttccaataaagtgaacaagacgctcagcttcacgcaggaacaatacggcagagtcattaaaaccagccttcaggacgttctgattgatctcgcttctccggccgggtcgccgtttattccgggttatgaaatgcacggagacgataaagccggtcctacgatggaaaatacgcagacgactgaaccgaaagcagtgctgtcagcggacggactggcggtgttcaaaaaggatgggaggctggattactggattgaggatgacgacagtgtgggggctgtatggctgctcaataggatcaagcatacgttcatcaatgcggattggaagaatgtgaagcacgcaatcagtctgcaggtcacccgccagaatacaaaggtgacggccacttttccgaacggaaaaccgcatattcacgtgcatgctcaggtcgaggggctggtggacgctgtcagataccctttccatctgtctgatccgcaagtgctgatgacgatgcaaaaggcgctcagcgtgcagcttgacaaagatatcaccaaatcaattgaagatataaaagcccgtaagaatgacttcgtcggcttcggagacctgatctatcggaagcatccggacaaatggaaaaagttcaaagggaagtgggatgaagaatatttccccaatctccccgtagatgtcaaaacggaagtcattatcagaagaacgggcttgcggaataatcctctctcagacaagcttgagcatgattgatttgaggagaaaggagcgaagcgtatggaaaatgcgaaaatcggcacgcgtcagctgtttattatgatcattttgtttgaattgggcagttcgttattgatcccgccaggcacgatggccgggcgggatgcatggctgtccgtgcttctcgggtgcgttatcggtctcggacttttctacgtttatcaggcgctgtatcaattttttcctgagtcttctccgagagattacatgaacgaactgatcggcagacatctgagctgggcggtctcgcttctttatattctctatttttcttatatcgcggcccgcgtattgcgggattttggcgaaatgcttgtcaccttcgcctaccaggacacgccgcttttaattgtgaatgccatgctgatgatcgccgcgatatttgcggtcagaaagggtattgaagtgatagcgagagccggcgagctgctgtttggcattatgtattttctgacagccgtcgggctgatcctcattatcagctcaggcacgataaacctcagatttctccagcccgttttagcggagggtgcaggaacggtcatttattccgtgtttaaacagacgatgttcatcccgttcggtgaattaatcgtgtttgtcatgattttcccttatttaaaagatcggaaaaaggtgaagaaaaccggatttctggcgattatcatcagcgggctgtttttggcgatgtcagtggcgattaatatttgtgtgctggacgtcaacttaatgctccgctctcaatttccgctgctgagcaccatacagacgattaaagtagaagagtttttagaccggctggatgtctttttcatgctcgtgctcgtcatcggcggttttttcaaagtcagcctttttacatatgcggttgtcgtgggtgtgtccacgctgtttaaagaaaaaaatccgtctcagctggcctttccggtcggattgggggtgctgattctctccatcagcatcgcaagcaatttttcggaacacatgaatgaaggcttaaacattgtgccgatctatattcatcttccgtttcaagtgctgtttcccgttttgctgcttatcattgccgttattaagaaaaaggtcaaagggaccgtctatacagtttcgaagaaataacccggacggtgcgccgggttatttttaaaatcatgatttttgtcttaatgcattgacaaacttgcgtgacaattgtacattttgatttattcttataaaattactaggaaatataggtttagtggtgttaatattttccgaaccgtatttcagaatagaaggagatccatcatgacaaagaaaaaagaaatcaaactcggtgtgtttctcgcgggcaccggccatcatgtcgcttcttggagacatcctcaggcaccggcggacgcgagcatgaatttggattatttcaaagaactggcgaaaacggctgagcgggggaaattggacatgctgtttttggcggacagtttatcaatagacggcaaatcacatccgaatgtgctgacgcgctttgagccgtttacgctgctgtcggcgctcgctcaggtcacatcccgcatcggtctgacggcgaccgcgtctaccacatacagcgaaccgttccatatcgcgagacaatttgcatcgcttgatcatctttccaacggccgagcgggctggaatgtcgtcacatcttcgattgaatcgaccgcgcttaatttcagcggcgaaaagcatcttgagcaccatctcagatatcagcgcgcggaagaattcgttgaagtcgtcaaaggattatgggattcgtgggaggaagacgcctttatccgtgacaaagagtcaggagcatttttcgataaagaaaaaatgcatgaattgaaccataaaggaacatatttctccgtgagagggccgttaaatgtcgcccgcacacctcaagggcgcccggtcattattcaggccggatcatcaggagacggaaaagcgctggccgccaaaacggcggaggtcattttcaccgcgcaaaatcatttggagtccgcgcaggaattctatcaatctattaaagaacaagcggcttctttcggccgtgatcctgaaaaaatcgcgatcatgccggggatatttcccgttatcgccgataccgaggaagaagcgcaggcaaaatatgaagagctccaagatctcatcattccgtctgtcggcctgaacattctgcaaaactatctgggcggcgtcgacctttccgcctgcccgcttgacggcccgctgcctgaattggatgcggatgcgtcgaatgccgttaaaagccggttcaagctcgttcaggagatggccaaacgcgataacatgaccatccgcgagctgtacaaatatgtggcgggttcaagaggccatcatatctttgtcggaacgcctgaacagcttgccgataagatggaagaatgggtcggaaaacaagcttgtgacggcttcaacatcatgccgccgcttttgcctgaaggtctcactctttttgtagacaaagtgattccgattttgcaagaacggggcgtgttcagaaaagagtatgaaggaaccacactcagagaacatttcggactggaaaaaccggcaaaccgatatgccgactaaaggagggctcatcatgtcaagacaataccggctcgcaacggaggcagacgctgatgagctgctttcactgacactgcgggcgtatgaaccgatccgcaagctcggcatcaactttgccgcagcaacggcggataaggagctcgttttgaataacatacaaaaaaacgcctgttacgttttggaggaagacggacggattctggcgacgatttctctgcggatgccgtgggggccgaatcccgggccgtacggtgtccctcatatttggtggttcgccgtcgatcctgaaaccggaaaaaaagggacgggctcagacatgctggagtggctggagaacacagtgctccgcgatacattaaaagcgcctttcgtgtcactgggcacagcggacaagcatccgtggctgatcggcatgtacgagcggaaaggctacgtccgcgcaggcgaaaaggatttaggaaaaggccacatcaccatctatttaaaaaaacaattgcaggattaacattttaataggaaaaggcgggatttcaatgaagaagaaaacatgggctttgctgctgtctgccgcgcttttggcggtcttaacagcatgcggaaacggaaaagaaagcgaaggcggcgataacgtgctgcatgtcggcgctacgggacaaagctatccgttcgcatataaagaaaacggcaagctgacaggctttgacgtggatgtaatggaagccgtagcgaaaaaaatcaacatgaaactggactggaagctgcttgagttcagcggactgatgggcgagctccagaccggcaaactcgacaccatttcaaaccaggtcgctgtcacggacgaacgcaagaaaacgtataacttcacagaaccgtattcgtatgcgggcactcaagtcgtcgtcaaaaacgataacaaagacatcaaatcagtcaatgatctgaaaggaaaaacagtggcggccgttctgggctcaaaccacgcgaaaaaccttgagagcaaggacccggataaaaaaatcaacataaaaacatatgaaacacaagaaggtacgctgaaagacgtggcttacggacgggttgacgcctatgtaaacagccgcagcgtcctgatcgcccagatcaaaaagaccggtctgcctctgaaattagcaggagacccgattgtctatgaaaaagtcgctttcccgtttgcgaaagatgcggctcacgataaaatccgcaaaaaagtaaacaaagccattgaagacctgcggaaagacggcacgctgaaaaagctgtctgaaaagtactttaacgaagatatcacaaaggaagcaaagcaataagaaacggcggtgaaaatcgagaatgaacagcattgattggggatttatgttttcagcttttcccgcgttaatcgaagccttgccgatcacattactaatggccgtcgcggccatggtatttgccgtgatcggcggccttatattagcgcttatcacaaaaaatcgtattcctgtgcttcaccagctgtcaaaggtgtatatttcatttttccggggcgtgccgacgctcgtgcagcttttcttaatttattacggcctgcctcagctctttcccgggatgagcaagatgacggcgttaactgcggcgattatcgggttaagcctgaaaaatgccgcctacctggctgaaatcttccgcgctgcgctcaactcagtcgatgaggggcagcttgaagcctgtctgtctgtcggaatgacaaaatcccaggcgtacagacggatcattttcccgcaagccgtcagaaacgcgcttcccgcgacgggaaatacgtttatcggcctgttaaaagaaacatcgctcgcttttacattaggtgtgatggagatgttcgcccaaggaaaaatgtacgcatcgggcaacctcaaatattttgagacgtatttagccgtcgcggtcatgtactggattcttacgattatttacagtgtgctgcaggatctgctcgaacgggcgatcagcaagccttatcgcacataggaggaggctcaggatgatacaagtcagacatattcgaaaagcatttaaagatcttaccgtacttgacgggatcgatcttgagatcaaaagcggcgaagtcacggccatcatcggcccgtcaggctcgggaaaatcaacgctcctccgctgtctgaatctgctggagcgcccggatgacggcatcattgaaatcggcgatgcaaagctgaatgcagcgtcctattcgcgcaaagacgtacacaagcttcgccagcagacggcgatggtgtttcagaattacaacctgttcaaaaacaaaaccgccctgcaaaatgtgacagaggcgctgatcaccgcgcaaaagaaaccgaaaaaagaagcggaacagatcggtatggacctgctgcggcaagtcggtttagaacacaaagcggacagctacccgattacgatgtcaggcgggcagcagcagcggatcgggattgcgagagccttggccgttgatcctcacgcgattttactggatgaaccgacttcagcccttgaccctgagcttgtagcaggggtgctccaagtcatcaaatcaattgccgaaaaacagacaaccatgatcatcgtcacgcatgagatggcttttgcgcgtgaagtagccgacaaagttatttttatggcggacggacgcatcatcgaacagggaacaccggaggagctgtttgacaatccgcagaacgaacggacgaaaaaattcattaagcaagtgggagagcctgccgaacttgtctaagaagggaagaagaagaaatggcaaatgaaacgtatgaatcattaaacaaacgtttaatcaatatccgccgcgaccttcatgaacaccctgagctgtcaggcgaggaattcgaaacgacgaataaaatccgccgctggctggaggaagaaggaatcacggttcttgatgtgccgaaacttcaaaccggagtgatcgctgaaatcaaaggagataaaagcggccccgtcatcgccgtcagagcggacatcgacgcactgccgatcgaagagaaaacaaaccttccgtttgcttcgcgcaacagcggcgtgatgcacgcatgcggccatgatttccatacggcatctatcctcggcacggctttcttattaaatgagagaaagcatgagctgaaaggaacggtgcggtttatttttcagcccgcggaagaaatcgccgccggagcaagacaggtcattgaagccggcgcgcttgacggtgtatcggcgatattcggcatgcataacaaacctgacctccccgtcggcacggtcggtctgaaagaaggcccgcttatggcgagtgtcgaccgctttgaaatcaccgtgaaaggaaaaggcggccacgccggaatccccgacaacagcattgacccgattcaggcgacagggcagatcatcggcggcctgcaatcgattgtcagcagaaacatcagctcgcttcacaatgccgtcgtcagcatcacaagagttcagggggcagttcttggaatgtcattccggaccatgttgaaatggaaggaaccgtccggacgtttcaaaaagaagcgcgggacgctgttccgaaacatatgaagcgggttgccgaaggaatcgcggccggattcggggcagaggctgacttccgctggtttccttacctgccgtcagtgatgaacgatgcccgattcatacaggcggcggaacaaacggctgaaagcctcggacttcaaaccgttcgggcagaacagtcgcccggcggcgaagacttcgcattatatcaagaaaaaatccccggcttcttcgtctggatgggaacaaacggaacagaagaatggcaccatccagcctttacactcgacgaaaaagcgcttccgaaagcggctgagtttttcgcccggcttgccgtcaatgtattggagcagacggaatgaatacggaaaatctgacggccggacttgctcaggccgtcatgtcgtctgtgccggaaacatccgccgaagcgatgaaagaagcgcgcaaaggactgcttgattttacagcggctgcttttgcggggagacgggatacaggagttgaaaagctggtaaaactggccgaagaagaaggcgggatgccgatagcgccgcttatcggcagaaatcaaaaaaccacgccgtcccaatccgcgctcattaacggcttcatcgcacatgcgcttgattttgacgatgttcattctgatgtaagaggacatccgagcgcggtcatcctcccggctttgattgcagccgcatcagccggccggatagacaagagccgttttctcggtgcttatgtgacgggaatcgaagtgatggcgcggctcggcgagtcagctggaagggatcattacgagaaaggctggcacaatacaggaacgttaggtgccatttcggccgcatgcgccgtcggattcgcagagaatctgaatcaaacccaattacagaaagcaatcgggtttgcggctgcccgttccggaggcatgagagtgcaattcgggacagaaatgaagccgctccacgccggcctggccgctcaagccggggtgttcgccgtaaagcttgcaaaggccggtttcggcggctcagctcatgcgctcgacggggagaaaggttttttcggactgtacggcgatcttgaacgggcagaaaccctgcttgtaaacgggtggggaaacccttggcggatcgtgagtccgggactttggtttaaggtttatccgttttgctcggcggcccatcatgcggcggacgccattctcaagctgaaggccgaacatggtctcactttcggccaaacggaacggattgacgtgatttatccgccgggcggggacgccgcattgacagaacggcgtccgaaaacaggcgaagcgggtcggttcagcgtagaatatgtgatcaccttagctttgcacggtaaggatttttcagttgaacatttcacatccgagccgattccgcaatcccttcaaaaaggatttgagcggattcaccgcagctgcgatgaccaaattcagccggctgacaacgccgttccgaagggccgttttacaattgtacgggtcacggtttccggcggtcatgtctatgaagcacgtatcgactgtccgaggggagcgccgggaaacggtctttctgaaaaagacattgaagacaagctccggctcgctttgccgggagaagagaaaaaggcggaagaattgatcaaagcagccggacaatcaaatattgaccgttatttacagctgatataaataaaaagagcgaggggatgcagccctggctctttttacgttcacttctattgaatagggggatatagggtgcgcccctgtctgcgctggcaggggcgcggtatcaggaaacggccgtgccgttttctttgaccgtgaaacttcctcttgataagcggatgttgatatcagacactttggcaatttgttcgtcgtgcgtaaccatgatgacgcatttgccgtctttatgcgccagatcctgaaagagccggacgatttcctttgacgtatcctcgtcgaggtttcccgtcggctcatccgcgcaaatcagatccgtgtcacagcagaaagcccgcgcaattgaaacgcgctgctgctgtccgccgcttaatgtcagcacccgctgacgggcctgctgttcggtgatgccgactttatccagcatgctgagcgcggacgcatctttgttgttctccttagatccggtaatctccatcgcggttgtgacgttctggagcgccgtcatatacgggatcagatgatgagattgaaagacgatagagacatattgatttctgaatttggttaatccgattttgaagatgtcttctccgttataaaggatgcttccctctttaggtgtgtcaaggccgcccgccagagacagaaacgtggtttttcccgttccggaggcgccggcaattgtataaaacttccctttttcaaagctgatcgttatatcctgaaacagcggctgtgatttatcttggtaccagtagccgatctgttgaaaggttaataggctcattatgctgcctcctcttattcctgcttggtcaggatcgttttagggtgaagccgcatgactgatacagacggcagtaatgtggcgatgacggcaattgcgacgccgatcccgccgagaatcagaaggtcattcagcgaaacgtttacctgcattgtactgatgacatctgcaccggatgaatgctgaccgaacatgccgtctccccgcggcatttctcctccgccccagccgcttgtttgctgctgggaatcatcggctgagctgacctgctgggaaagaagctgatttccgagctgattcgccacaaggctgcccgtgacggatgcgatcccgatggcgataaccgcgacaatcagaatttccgttaagaattgtccgatgagcttccagcgcttttcgccgatcgccatcaagacacccatttcatacttgcgttccctgatcgacatcatcacgatcaatccgagaatgaccgcgcccgcgatggatacaaggtacaccacgtttttagaaaatgacgcgacattttcaatcgggccggccatttgctgatacacctgatcatttgtcgtcagcgtgtaggttttatcatctatagatgtttttttcgcagccgcaacgaatgagtcaatatattttgcatcatccatataataaacggctgagctgattctgtttttgttatcagacccttttaacgccgcagctgcggtgtaaggcgtatagattttattgtcagggtttaagaatgaaaaatgctctgcctgatcgtctcctgatgatgttgttttataaattcccacaattttaagctttgtactcacagaatcatccgctgctgaggaaactgtaatggagccgccgaccttcagcttgttttgatctgccagcgtttcattgatcactgcgacttttgcgtccgcatctgtttttgtgatggcgcggccatcagtgatttttgagctcccgcctgtgaaatcatcaagcagcgccgtagagagcacgccttcgaccgaaatatccgctgaaatcatctgtcttccgccgccttgaaaacggcttccgccggaactgttatcggctgattcgtctgagctttttatcgcgtcaaagctttctgcgtttgctgacgctgtcgtgaggaagttgtaatttttaacgtgctgtaaagatgtaagtttcttggcatccgagacggaaatcggcgttgattcaaacgtcctcttttcaccgtctttttgctgctgcgccatttgcttttggcggtcagcctggagtgtgacgctcccgccgagctgctgccttgccagttcgcttgatttctttgccgctgactggatcgtaagaccggacaggacaaaaatgcaaatcactgaaaacacaaccagctgcaaaaacgtttttcccttttttgccttcatgctccaaaaggctctttttataaagttcatgtctgttcctccgtgtgggtgtcagatcttgtaaaaccagccttctttagaaccggttatccgatatgtatatagtaggagaaatgtatgaaaaaaatatgaacaaactatttccgggtgatgaaataaaaactaacaattgtgaaacgcgaaaatatccgggtaaaatggtgctattataagtaaaagcgtcaagataaacggaggacccaatgaagatattaatgatagaagacaatataagcgtatgcaccatgacggaaatgttcttttttaaagaaggatttgaagccgaatttgtccatgacggagtggaaggctatcagcggttcacggaagaggactgggatttggtcattctggatattatgcttccatctatggacggagtgacgatctgccggaaaataagagagacgagcagtgtgccgattattatgctgaccgcaaaggacacggagtctgatcaggtgatcgggtttgaaatgggagccgacgactatgtcaccaagccgttcagcccgctgacgctagtagcgcggattaaagcggtgatcagaagataccgggcgacggggcaggccgtaaaaagcggcgacttgatcgaaacggcgtgtttttcaatcaataagaagacgcgggaagtgtttctgcatggaaagcctgtcgagaatctgacgccgaaggaattcgatctgctcttttatctcgcacaaaatccgcgccaggtcttttcgagagagcagctgcttgagcaggtgtggggctatcaattttacggcgatgaacgtacggttgatgttcatattaaacggctgcgcaaaaaactgtccagtgaggaaaaaccgtttttatacacggtgtggggggtaggatacaaatttgatgaggattaaatacttatatcagctgctgttaagccatgtcagcattttgattttggcctttttcattatcatttccctgttttcgcactttgtgaaagattttgcgtatcaaaataaagtggatgagctgtcttcttacgcccagcagatcacaagtgagctgaacggacgcgatcttgatctgcgccgcctgtatccgtatcaggacatgttaaaaacgcgcgagaccaggtttattatttttgatgaacatcagcggccttacttttttcctgacgatatgccgccgcgcgagaagctcaaaagtaaagagtggcacatgctgaagcaagggaaaaccgttcagatcagagcggagatgaaccgttttaatacggagggcttggaagtatcgcttgtcgcaaaaccgcttttgatcaacgatcaatttaaaggcgcggtgctgctcgtgtctcccgtcagaggggtcgagcagatgatcagccaggtcaaccgctatatgatttacgcgattatcagcacccttatcatcacgattctgctgagctggcttttatctaaatttcacgttaagcggattcagacattgcgggatgcgaccggaaaagtggcatccggggattacgatatttcgctcaagaacagcggcggcgatgaaatcggcatgctggcgtccgatttcaacatcatggccaaaaatctgaagcaatcgagagagcagattgaccgcctggaaaaacggaggcgccaatttatcgccgatgtctcccatgagctgagaacgcctttgacgaccattaacggacttgtggaggggcttaacagcaacaccatcccggaaaaagataaagagaaatgcttctcgctgatcagtgaagaaacgaagcggatgctcaggctcgtgaaagaaaatctggattatgaaaaaatcagatcccagcaaatcaaactggacaagctcagtctgccgctcatcgaggtgtttgaaattattaaagagcatctcaatcagcaggcggaggaaaaacaaaatcagctgcggattcaggcggaggacggcgtcaaagtgttcgccgattatgacaggctgatccagattctcgtcaacatcacgaaaaacagcattcaatttacgcaaaacggagacatcacgctgcgcgggtatgaaggctataaagaaacggtgattgagatcgaagacaccggaatcggcatctccaaagaggaaattgagcatatatgggagcggttttataaggcggacgtgtcccggacgaatacggcatacggcgaatacggactcggcctgtccatcgtcaggcagctcgttgaaatgcacaagggcacgatagatattgccagcgaaaaaggaaaaggcacgacgtttacaatccgccttccgctgaatacgatacatgaatcatcttgaaaccggcagtcccgtctggctaccggctgttttatcttcactcggaaaattgcgctctgccgaaacaaagtttgcgtgtttttcgggatggaaagacacggaaacgtgataaaataactggtaaacaggtcttggatggggagggtgaaggaatgaagagcgggttaattccttcttcagcagtcgggcagaaaattaacgagtggtatcgatacatcagaacattcagcgtgccggatgcggagatcttgaaggccgagatcaaacaagagcttgaccgtatggagcctgattcaaacttagtgctttattattccctcatggaatttcgccatcagctgatgctggactacttggagccgctggaaaaactgaagatagaagaccagccgaccctgtcggaaattcttgataacattgataacagccaggccggcctcaaagggcttctcgattattacgtcaactttttcaaaggcatgtttgaatttgataaaagagaatttatctcagcgattacgtattataaacaagctgagaaaaaactggccttcgtatcggaccacgtggaacgggcggagttttattttaaagtggccgaagcttattatcatatgaaacaaacgtatttttctttgatacatataaaaaacgcttatgaaatttacgtagagcaggacacatataacgtcaggatcattcaatgccattttgtattcggcgtcaatttaatggatgaaaggcgctttgaacaggcggccaaacattttcagcacgctttgcaaatggccgaaaaagaacaaaaagcgcagcttgtcgggagggcgctgtataacctcggactgtgctactacaatcaggaccgcatcggcgaagcgattccgtactttgaacgggcggttgatacatttgaatcacaaagaatcgtcaattctcttcctcaagcatatttcctaatcacactcatttactttaaactcggaaaaaaagaaaaagcgtcggaatatcacaagcggggatatgaatatgctaaagaaacagacgatcccgtttacacggtaaaattcgaatggctgcaggctctgtatcaggcgaaaccggatgaggaaacaatcagcgcgtgtttccgttacctggaagataaaaatttatacgccgatatagaggatttagcactagaagcagctaaatattactatgaacaaaattgctttaagatttcttctgactattttctgaaagtcgaagaggcaaggaaacaaatacaaaggagtgagggtttgtatgaaattgaaatctaaatggtttgttatttgtttagcagccgccgcgatttttacagtgacaggtgcaggccagacagatcaggctgaattccatgtagctgaaagaggaatgacgtgagaagaaaataacctgaacaaaggaaaagactgcccgggaatgttcccggcagtcttttttttgcgcggccggacttggacagcggcggaaaacaaaagaaaacgccgcaggtcaaaacccgcagcgtcctcatatagacggagtgatgcttagaaaccgccaacataggcagtacctacaataaccaacaggataaataaaacaacgatcaaagcgaaagagctgattccagaatatcctgacatgagcttcacctccatattgtctataccatacaatatgtaaaagaagctgctttgtaagggatattagtggacaagagaaaaaagaggcggtgtcctatgggagtaagactccggcgaaaaactcgtcatacagcgcccgcaccgcttgtttttcctgttcttctttcaccccgaacatcatgctgacttccgatgacccctgattgatcatctcgatgttgacgccggcttcggacagtgctttggatgccctggcggttgtgccgacattatggcgcatcgcttccccgacgaccataatcagcgccagattgtgcctgactgtgacttcatctgcttgaagttcctgcttcagacgggtgacgagcctgtgttccagttctgagtccatctgatcgtgccgaaggatgatcgtgatgtcgtcaatgccggatggaacatgttcatacgtcaatccttcttcctccaaaatgtgaagggctttgcggccgaaaccgatttcccggttcattaaatatttgcttatgtaaatgctgcaaaagcccgtgtcgcttgcgatgccgatgactggcccgttcgtattgtcacggctgctgacgacgcgcgttcctttcgcctccggattattcgtattcttaatctgaacggggatgccggcccgaaaagcgggaatcagcgcttcatcatgaaaaacggaaaacccggcataggagagctcacgcatttcccgatacgtcagttcgttaatctctttcggatgccgcacgattgacgggttgacggaatagacggcgtccacatcagtaaagttttcgtacaggtcggcttttaagccgctggcgagaatggagccggtaatatcagaaccgctccgggaaaacgtcacaatctcatgctccttcgtgtaaccgaaaaatcccggaaaaatgatcaagccttcacggtttctcagacggtacaaatgatcataagactcagggagcacctgagcgcttccgggttcattcgtcacaaacagccccgcttctttcgggcttacgtattcggctttcacgccctgccggcggaagtaggccgcgatcagcttcgcgttgttgtcctcgccgctcgctttcaccgcatccatatactgatcgggattggctttgctgctgtttaagagagcgaataggtcactgcggattctttctataatagagaaatccaggttcagctcacgcgcgatggcggcgtaccgttcaatgaccggttcggcaagctcgggcgctgcaccattttgcaaataatgctccgcacagcggattaacagatccgtcacctttgtatcgtccgagaagcgttttcccggcgccgatacgacgacggctttccgcgagggatcagccgtcacgatttgaaacactttctcaagctgggctcctgacgcaagagagctgcctccgaattttacaactttcatgatttacatcccctaatatttaaattttctcacaaatttaatttttattatctctctttcaaacatgtaaatcaaggattttttctatgtggggagaacatttgtattttcgtggaggaattttgccgctgtttgtcagatttgtttcccgcaagcgtgtcatcatgtgcaaaaaatgataagcagccaaatgaaggttatagaaaatcctgcaaattcttgatagactgattgtaagacaatttagtgtacggcccgcggatgaccgtttttgaaagcaaaactgtattgactgcgcttggaaagatgataagattatagttgtcgttgataatgataatcattacgagtggggatatatgggagttgtttggcaatcagtcataccgtttgtgatgggtgcagggaggcagcatgaagctacgttacttacttttgctactggcggttttggcgtgtacttctatatttatcggtgtagaagatttgtcgccgctggatatttttcatttaaataaagaacaggcaggtacattgtttgacagccggctgccgcgtttggtgagcattatcatcgccggcatgagcctgagcatctgcggattaatcatgcagcagatcagccggaataaatttgtatcgccgacgactgcgggaacgatggactgggcaaggctcggaattttgatttcattaatgctttttacgtcagcgagcccgcttgtgaaaatgtctatcgcttttattttcgcgttggcgggaaatttccttttcatgaaaatcctcgagagaatcaagttcaatgatgcgatttttattcctctcgtcggtttaatgcttgggaacatcgtcagctcaatcgccacgtttatcgcatataaatacgacctgatccaaaacctgtcatcttggctgcagggagatttctcactggtcgttaaaggccggtatgagcttttatatctgagtatcccgctggtgatcatcgcttatgtgtatgcggataaatttacggtggcgggaatgggagagagcttttccgtcaatctcggcctgaaatacaaacgcgtcgtcaatatcggtctgattatcgtgtcgctcatcgcttcactggtgatcctgaccgtcgggatgctgccgtttctcggtttgatcattcccaatatggtgtcgatttacaaaggggacaacctgaggagcagcctgcctcacaccgctctcttgggcgctgtttttgtgctgttttgcgacattttgggaagggtgatcatcttcccgtacgaaatttccatcggcctgatggtcggtgttatcggcagcggcatcttcctgtatatgctgttaaggagaaaagcatatgagtcataataaaaaaattacgctgctggcggcgctcgccataatatgtatcggattctttctgttctacggactgggcaattgggaatactccctgccgagacgatgcttcaaagtgcttgccatgatgctcacagggggagcgatcgcgttttcaacggtcatcttccagacgattacaaataaccgcatactgacaccgggcattttaggcctcgattccctgtatatgctcattcagaccgtcatcgtgttcctgttcggttcaatgaatatcgtcatgatgaacaaaaatcttaatttcgtcatctccgtcgggctgatggtgctcttgtcactcgttttgtatcagctcatgtttaaaggcgaggggcggaacgtgtttttccttctgcttgtcggtgtcgtgttcggcacgctgttcaacagtctgtcatcctttatgcagatgctgattgatccgaatgagttccaggttgttcaggacaaaatgtttgccagctttaacaatatcaacaccgatcttttaggatttgccggtgctgtctttcttctgacaggcatttatgtctggcggttcacgcggttttttgacgtgctgtcgctcggcagggagcacgccgtcaaccttgggattgattacgataagcttgtgaaacagatgctcatcgtcgtcgccattcttgtgtctgtctctacggctcttgtcgggccgattatgtttttaggactgcttgtcgtcaatctggcgagagagtttttaaaaacctacaggcacacgtatttaatcgcgggttccgtcctgatcagcatcgtcgcgctcgtcgggggccagttcgtcgtggagaaagtgttcacgttttccacgacgctgagcgtcatcattaattttgccggcgggatttattttatctatctgctgttaaaggagaataaatcatggtagaggtcaaaaatgtaagcaaacaatacggagggaaaaccgtccttgagaaaacgtctctatccattcaaaagggcaggctcacctcgtttatcggtccgaacggcgcgggaaaaagcacgctgctgtctatcatgagccggctgattaagacggattccggagaaatcacggtcgacgggcaagagatcggggcctgtaaaagcaacgatctggcgaaaaaaatcagcatcctgaagcagacgaaccaaatcaatatcagactgacgattaaagacctggtcagcttcggcagatttccgtattcccaagggaaactgacggatgaagattgggtgcatatcaaccaggccctcagttatatgaagctggatgacttaaaggataaatacctcgatcagctcagcggaggccagtgtcagagggcgtttatcgcgatgatcatcgctcaggatacggactatatttttctcgatgagccgctgaacaatttagatatgaagcattccgttgaaatgatgaagctgttgaagcggcttgtggaagacttcggaaaaacggtcgtcgtagtgattcacgatatcaacttcgcatccgtatattcagaccatatcgtcgcactgaaaaacggacggatcgtcaaagaagggccggcggaagagatcattgaaacctccgtgcttgaagatatttatgatatgaccatcccgattcaagagattgacagtcagcggatcggtgtgtacttttcttaaaaaccagatgaggtgaaagtcatgaaaaaattcgcattgctattcattgcgctagttacgatttttgttgtttctgcatgcggaaacggggacaaaacatcaggcaaatcaaaagaaacaatcacaatcaaagatgatctgaacaaagaaggagtcaaagtgccgaagaatccgaaaaaagtcgtcgtattcaacttcggaatgctggatacgatggatgaactcggtttacaggatcacgtggcgggacttccgaaacaaaaccttccaaaatacttatcttcatataatagtgataaatacgccaataccggcggtttaaaagaaccggattttgaaaaagtcgcggatattgatccggatttaatcattatcgcccacagacaatctgattcttataaagagttctcaaaaatcgcgccgacgatttatcttgatgatgactatacaaactacgttgacagattcaagcaaaacaccgaagtgatcggcaaaatctttaacaaagaaaatgaagtgaaagataagcttgcgaaaattgacaaatccattgccgatctgaagaaaaagacaagcagcacggataaaaacggattagtggtgatggcgaacgacggcaaaatcagcgcgttcgggtctaaatcaagatacggcttcattcatgatgtgttcggcgtcaaaccggctgacaaaaacatcgaagcctcactgcacggacaaagcatttcctatgaatatatcgccaaaacaaaccctgattacatgtttgtcgttgaccgcggaacagcgatcggcacaaaatcttcaacaaaacaagtggttgaaaatgattatgtaaaatcggtgaaagccgtgaaaaacaaccatgttgtctaccttgattcagctacatggtatttatcaggaggcggcctggaatccatggcgcaaatggtgaaagaagtaaaagacggaatcgagaagtaaaaaaagaacccggtcacatacgtgatcgggttctttttggtttaccgcgtaacggcctgctgctgctcgggctgacgcggttttttcttcaatgtaaaagataggaggaagccggccagcgcgatgcaggcggctacgacaaaggccgcattcatgccgtgcagggcggcgtttgccggagttgacgcattggcgtgcgcggcctggctgctcatcacggaaaccagcagcgccgtaccgatagaaccgccgacttggcggacggtattgttcatggctgtgccgtgcggaattaagtggcgcggcagggcgttgattcccgctgtcgtcaccggcatcataatcatggctgttcccaaaagccgtgcggtataaacgacgacaatccaaatgagagacgtcgagtccgtcagattcataaacggcagggacgtgagcaggatgatgaagaatccggtcatcgcaaggccttttccgccgattctgtcaaacacccggccgataaacggagacatcatccccatcacaatcgcgcccggcaaaagcattaatccggtatcaaacgcggagacgccccggactttttgcgtgtaaagcgggagaatggtttccgttccgatcagcagcgcgaaaacaagcgttccgagcagggtggtcaggctgaaaatcccgaaagaaaacacacggaattccagcatcggttttttgagcttcatctgtcttgcgataaagaaaatcagcgcggccgctccgacaagcagcgaagtcagcacttcagtactggtccatcctgaggaaccggcgcttgagaagccgtaaagcagcccgccgaatccgagggtcgataagatcacggataaaatatcaatctgtgtttctcgtaatgtcgtgacgtttttcatcagaataatcgctaaaagcaaatcgatgactgcgatcgggaagatgatataaaacaaagaccgccaagagaatgcttcgaccgcccatccggaaagcgtcgggccgatcgccggcgcgaacgaaataaccaagccgaccatacccatggcgcggccgcgcttttccatcgggaaaatcgtgagaaataccgtctgcatgagcggcagcataattccggcgccggccgcctgaataatccgggccgttaagagcaccggaaagttcggggcgaatgcgccgacaatggtgcccaccgtgaaaatactcatagcggaaatcaggagggtgcggctcgtaaatttctctattaaaaatgcggtaatcggaatcaaaatcccgtttgtcagcataaacgacgttgtcagccattgcgctttgttggcatctatattgaagtcattcataatgtgcggcagcgccgtgataagcagtgtctggttcaaaatggcgacgaacgctcccgccaaaagaatcccgacaatgacagagcggttgtatggtgcagttttaatactcttattcaagctgattccttctttctttatagtttgagcaatgttttaacggctgcaagcggctggtgcagcggtccggcctgctccaaataaccgatgagcgcttttataagaaaatcccgcggctgtttgtccgctgattctttctccagcataaccgccgcggaagcgagtcctgcggcatcatatttttcctccggaagggctgagacggcttctttcagttccttcaggctttcagccagcaatacggttttgtcttttggctcaaatgaggaagcggaggcggtataaaggtcaatcatctcctgaggcaaagccgtttcggttttcctgttttcgacgatgagattgagatggcggatgataaagtccgtgagcggctccagggcgagcggttctttttccagcttaatcagcgtgatgcattctctcaggagcccctgcaggacgatcaccagctcccatacataaggaataatgtcttcgccgtacgtctgaatcagtgaatcgcgatgccagcagataaaggtggagcgggccctgtgaatatgccgttttacccgctcattaatggaagaggggcttccgtacatcagcatattaaaaaactgctggttgcgcctgaagccttcaagctcagccatcagttttttggcaaaccgttcctcaggggagaggctcgtttcttcatttaataatgaagcggccgctaccatctgtttctggttaaaatcgagcagctccaggagcaggtcttcctttgattcaaacagcttatacaaagatgctttggagactttgcactcctctgcgatcgcctgcatcgagaccgacgaaaagcttttcccggaaaaaagcttccttgccgccagcagaatatccgttttcttatcattcataagcccagattccttctttcgtcacaatagaaaacccatcggttcacagaaaaccaatgagtatatgatgaaaatattaacaaaaatttttacatagtgtcaacgcttttgtttgagaaatagaaaaaacctgccggagtgttccgacaggctgatacgtttatttatccgtcttaaatccttgtttttcaagcatttcacgaatgtgaggataataaacctgcttatagtaggaagtgatgccttgtgaccagtttcttgtttcctgtccgtcggtgcgttttttcatgtattcggacatctgcttgtcataggcctcgatatgggttcttaaatcttcttcttgatacgtttcatgatgcagaacggctgcttgcggcagacgcggttttttcgcggagcggtctgccggatggccgatgacgagaccggaaatcgggaaaacgtatttcggaagtttcagcaattcaatgatttcgtcaggcttgccgcgcacggcgccgatcggcacagtgccgagtcccattgattcagccgcagccgttgccgtacccagcgcaatcccgacatctacggctccgactagaacggactctaaaccgttcgtgatctcaagcggtgtatcattatattcttcaagcgcaattttggcgcggttaaaatcagcgcagaataaaaggaaaacaggcgcttggtcaatccacggctggccgccggccaattcggatatttttttcttccgctccttatctttcaccgcaataacggtaaattgctggccgttaatggaagtcggcgctgcctgagttgcttggatgataaggtccagctgctcatccgatacgggttcatctgtgtagctgcgaatggaacggtggtctgttaatatttgaaggacttcgttcatgtcattcatcctttcgttactctgacagttctgtgcggacgacgtcaagcggcgcactcagcacttcttttgcttttgccacgaatccttggaaatggtcagttgcgttgtggaatttcatcgcttcttcatctttccattgctcaagcataacgaatgtattttcctcaccgactttttcgaaaagatcgtattgcacatttccttcttccgcgcgtgaatgctgaacaagtgattgtgcttctcctaaaaattcctcgcgtttatccgcttttactttcatgtaagcctgtaagacgatcattgttattcctcctgattgggtttatttgttatagttcgaatattatcgaactaactgtaacatgtttcgcagtgaatggtaaaggaaaaaccctcaccgcctaaattgtcacccgccgcttttatgtgttacatttgactcatgaacattccaaaccatcctgaaaccgaccgcttacagctgacaaaggttcttcatgctctgagtgatccgctccgcttagagctggtcaaacaattggcggaaacaacagaaaaaacgtgcggtacctgcgctgatgtccgggtcgccaaatcaacgctgtcccatcacttcaaagtgctgcgggaagcggggatcgcccaagtgcgcatagacgggaagcaccgttattattccctgcgcaaagatgatttacaagcggcgtttcccggcctgctggaggcgattttgcagacagaaccggaccgctggtaaataagtccccgaattccgggggtttttttatgcgtcgaaaaccgcccggtaaagcctgaggacgccatcttgaatatcgctctccttcaggcgggcgaaccccagaatgagctgcggcttatttgaatcgcctcctgctttcagacggaaccggctcatcgcaaacagatcgagctgttctgcatccgcccgtgccaaaatctctttttctgaacgggcgcagtcaaactcagtgacaaaatgaagccccgcattggcgccctttacactgattctttctccgaatatttcttctaaagccgaaatgaggcgttcccgcatgttcttataatgctgcttcatctttttaatatgtttctgatattcacctgagtcgataaattctttcagcgcgagctgggcaagcgtgctgcacgtatgcaggtcatacgctctctctttgaacgtccgcaaaagcccgggcggcagaaccatatagctgatgcgcagacctgggaaaagggattttgaaaaggtccccatgtagatgacattttgaaaccggtcaaggctttgaagcgccggtatcgtatcggcgtcatatttaaattcactgtcataatcatcttcaatgatgaagcggccgttctgttcggcggcccagtttaaaagctgaatccgccgggaagcgggcatgatcacgcctgaggggaattgatgggaaggcgtggtgatcaatacacagggccggcgtttttcgatttcggccatggacatgcctttttcatcaaggctgatcgtcgcaacctttttcccgaggttttgcagcagccggtacatcctcatatatcccgggttctccatggcgtacagcgcgtcttttggcagcagttccgtcagcagctgcgtcagcatttgcgtgcccgccccgagcacgatttgttccgggcggcatgtaacgccccttgtcagggaaataagccgcgaaatggtttcacggacttcatataagccttgcggatggacgagttccccgagtgtatgaaatgaacgggcggctgctttatgctcacagcggaaccagcttttcaggggaaaatgcgccgtatccacgctcatatgagaaaacgaaatccagccgctcttatccggctcccgctcttttaaatcttcaggcaatgagagcgaaggcgtttcttcatgataaaccgtatcaatttcctccacgaaaaagccttttctttcgactgcatataaataaccttccgaaagcagctgctgataagctgaattcactgaattcacgctgaccttcagcgtctcggcaagctcccgtttagacggcacctttgtatgaggcatcaggctgcgtttcaaaacggccgcttttatgtgctgatagatctgctgatagatataatccgccgtttccgaatgattaatggaaatcgtcagcatccagaccctgctcctttctgataccatggataaattgattttggtacttttcatcataccaaaaagaagtcagaatgataagaaaacaatatagggggatggaatctatgagtcgaacagcatcatcggaagtgacaactgcccagtggcagcaaaaacgggaccaattcgtttccaagggggtcggcaacggaaaccgcagcatggcggtaaaaggggaaggggcgcttttgtacgatttggacggcagacgattcattgattttgccggagcgatcggaacgctgaatgtcggccattctcatccgaaagtggtggaggccgtgaagaaacaggcggaggatctgattcacccgggatttaacgtcatgatgtatccgtcttatattgagctggccgaaaaactttgcgcccttgcgccgggagatcatgcgaaaaaagcgatttttctcaattcgggggcggaagcggtggaaaacgccgtgaaaatcgccagaaaatatacgaagcgccaggctgtcgtgtcatttacaagagggttccacggccgcacgaacatgacgatgagcatgacgagcaaggtgaagccttataaatacggtttcggcccgtttgcctcagaggtgtatcaagcgccgtttccttactattatcaaaagccggccggcatgagcgacgagcagtatgacgactttatcatcagcgcttttgaggatttctttatcgccgcagtcgcaccggaaaccgtcgcctgtgtcgtaatggagccggttcagggagaaggcggcttcatcattccttcaaaacgtttcgtgcagcacgtcgccgctttttgtaaaaaacacggtatcgtttttgtagcggatgagattcagaccggttttgccagaacgggaacgtattttgcgattgagcatttcgaagccgttccggatttgatcaccgtatccaaatcacttgcggccggattgcctctgagcggtgtcatcggccgggcggaaatgcttgatgccgccgcgccgggggaactcggtggcacatatgcgggaagcccgctcggctgtgcggctgcgctcgcggtcttggatattattgaagaagaagggctgaatcagcgttccgaagagatcggccggatcatcgagcatcaagcgatcgagtggaaaaaagagcatgcctgcatcggagaagtgcgcagactcggcgcgatggcggccatcgaaattgtcaaagatccgtacacgcgggaaccggacaaagcaaaagccgcggcgatcgctaaaacggcgaacgagaacggactgctgctgctgacggccggcattaacggcaacattatccgattcctgacgccgcttgtcgtgacggatgagcagctcaaagaaggcctttccattatcgaagcagctctgtgagttcaattattggaatcccgccggatgtgtctgctatcatgaaagtgtgagatacatcaacaagcattcaatggttttactataggaaagaaaggaatgttcaatatgccagaacaattaacagtgtacaacccggcaacgggagaggcgatcgaaagcatcccccagcagacggccgaagatgttgaaaaagcgattgaacgttcacatcaagcgtttcaatcatggtccaaaacatcagcgggagaacgtgcctcacttttgagaaaatggtatgagctgattgttgaaaataaagaagaacttgcggaattaattacgaaagaaaacggcaaaccgtacgaagaagcggtcggagaagttttatacggcgccggctatattgaatggttcgccgaagaagcaaaacggatttacggcagaaccgtacctgcgccgacaacgggcaaacggattgtcgtcacccgtcaggcggtcggcccggtagccgcgatcacgccgtggaatttcccgaatgcgatgattacaagaaaagccgcgcccgctttggcggcaggctgtacgttcatcatcaaaccggcggaggatacgccgctttccgcttacgcccttgcgcgtctcgcatatgaagcgggaattccgaaggacgtgctgcaagtggtgatcggtgacggagccgaaatcggaaacgtcttcaccagcagcccgaaaatccgtaaaattacctttaccggctcaacgcctgtcggcaaaatcctgatgaaaaacagcgccgacaccgtaaaacatatgtcaatggagcttggcggacatgcgccgctgatcgtggatgaagacgctgatcttgatctggcggtagcccaaacaatggcctctaaattcagaaatgccggccaaacctgcgtctgtgcgaaccggctgatcgtacacgaatccgtgaaagacgagtttgcgaaaaaactgagtgaagaagctgcgaaactcaaagtcggaaacggtcttgaaaaaggcgtaaacgtcggccctgtcatcaacaaaaaaggcttcgataaaatcgtcgggcaaattaatgacgccgtggaaaaaggtgcagaagtgctgacgggcggaacgtatgaccaaaacgacgaaaaaggatgctatttcgtgacgccgaccgtgctttcaaatgtagatacatccatgaacatcatgcatgaagaaacattcggcccggttgcgccgatcgttacgttctcagatattgatgaagcgatcaagcttgcgaacgatacgccgttcgggcttgcggcttatttcttcacagaaaactaccgccgcggcatctatatttctgaacagcttgaatacggtatcatcggctggaatgacggcggtccgtccgcggttcaagcgccgttcggaggaatgaaagaaagcggcatcggccgtgaaggcggtacggaaggcattgaaccgtacctggaaaccaaatacatgtctatcggactttaatgagccgaaaagaaagccccgcttctaagcggggcttttttattgagcggtctgccggtgaatatcgccggcaggcttttttgatcttgcgggaataatcggttcgattccagacaaaataacagcaaatacgattgaaagaaggtcgccatcatggatatattactggctcttctcccggctttattttgggggagcatcgtgttatttaacgtcaaattaggcggcgggccttacagccagacgctgggaacgacaatcggggcgctcatcgtttcgtttgtgctgtatctgtttgtccatccggtgctgtccgggcgcatttttattgtcggcatcatctcggggctgttttggtcgctcggccaaagcaatcagcttaaaagcatacagctgatgggcgtttcaaaaacgatgccgatatcaacgggaatgcagctcgtctcgacttctttgttcggtgtgatcgtattcaaagaatggtcaaccccgatcgcgattacgctgggtattctcgcccttatttttatcatcatcgggattgtgctcacatctttagaagataaaaaggggcgggcggacggagaaccgggaaacttaaaaaaaggcattgtcatcctgctgatctccacgctcggctatttggtctatgtcgtcgtcgcccggctgttcggtgtatccggatggtcagcgcttctgccgcaggcgatcgggatggtcatcggcggactgctcctgacgtacaagcataaaccgtttaataagtacgccctcaagaacattctgccgggaatcatctgggcgctcgggaacatgtttctgttcatctcacagccgcgcgtcggagttgcgacaagtttttccctctctcaaatggggatcgtcatcagcacgctcggcggaatcttcattctccgtgagagcaaaacgaagcgtcagctggtcgccattgccatcgggattatcctgatcattgtagccgcggtattcttaggcgttgcgaaatcaaattcataacatatgcaggaggtttgaacatgtacacggatttaaaaggaaaagtcgttgccattacgggagcttcatcaggattaggaaaagcgatggcgatccgcttcggacaggagcaggcgaaagtcgtggttaactactatagtaatgaaaaagacgcccaaaccgttaaagaagagattcaaaaagcgggaggcgaagcggtcatcgttcaaggagacgtcacaaaagaagaagatgtcaaaaacatcgtgcagaccgcagtgaaggaattcggcacattggatgtcatgatcaataacgccggcatggaaaatccggttcagtcgcatgaaatgccgcttaaagactggaacaaagttatcaataccaatctgaccggcgctttcttaggaagccgcgaagccattaaatattacgtagagaatgatattcaaggaaacgtcattaacatgtcaagcgtacatgagatgattccgtggccgctgtttgtccactacgcggcgagtaaaggcggcatcaaattgatgacggaaacgctggcgcttgagtacgcgccgaagcgcatccgtgtcaacaacatcgggccgggcgccatcaatacgccgatcaacgcggaaaaatttgccgatcccgttcagaaaaaagatgtggaaagcatgattccgatgggatatatcggtgagccggaagaaatcgcggctgtcgccgtctggcttgcttcaaaggaatcaagctatgtgaccgggattacgctgtttgctgacgggggaatgaccaaatatccgtctttccaggcaggccgcggataagaaaaaaagcgatcgcaggctctttagagccggatcgctttttgcttacacacgttttttctttacaagcgccgcgatggaaaggataattgccgcagctgacagaacgatggccgcaatatcaagcgctgatacgccggatttgctttcttcgtttgactgttcagctccgtgcgcatccgtcacgctcgccgatttcgttattttcgtaatcgagtgaggcgtgtcggctttctcatcacccgtccattctacaatgctgccgtctttgtaatattggtaagcgtcccaagcggcatctccgctcttttcaggatttttcgcaacgaacgtgaactgctggaattggccgggctgaatgccgccgtcctttgcttcccaagtgacggagaccgctttgtcatcatgtttggatacggatgttttccagcccggaatcggctgatactgctgaaattcaacgccggcgggcattttcagcacgactttcgttgtcggctcattcttttccacaggcactttcatcgtgtacgtttcccaagaaccggccgcggattccgcgggtttgactgagacgtgggcgcttgctgcagccgtaaaaccgacgagtgacagggtcacggcggatatgaatattaaagctttttttttcaacatgagatacactccttagtttgtcgttgagaatatttggttgatttcattaaaatcgtttgtcagtccgtggactttgatcttccagtttcccttttcggtgatggacaggttggcggcttcgaatgtgccttccttcgtcttcttcaaatcaaaggtgctttcatgctgtttgccgctgaagcccgtctggtaaacagtgaccgtaaattgctgaatgtcttttactaagctgccgttatgatcggtgacaatgacttgaaattcatttttacccggctggttcggcgtaatgtgcaaggatagggtttccccgtttccgatcgtttctgagccgttaaaaggcaatggcgcgggcggaggcggactgggcaggcttgtgaagacggcggttgtgaataacaccgcaatgcctagtgcccattcggcctttatcgttgcgctgatgctcctttttctgctgaacttcgtcatccatacgtgaacggcgccgagcgcaagcatgatgacaaacagtccgattttcaaaaggagcgtcttgccgtaagcggtgtgaaagagtgaatcgaacgagcggataatgaaaaatccattcagcactcctgaaaataacagcacgccgacagaggcgaacgcccaaggagaaaaccgtctgaccgtttcccaagcgatggttttatcgggttctctccactctgatgaaagaagcagcacaagcgcggcgataccgcccatccatacagacgcggccgataaatggagaaagtccattgcgatgccgaccgctttttcgtcgataacggccgcatgcccggcgaatgcttttgccaaaagcgaagcgaagaagaataacagcggcgccgtccagtacgcaaatgaccggaatgctttcttcttcagcagcgggatcatggacagggcgagcaggataaataagctgatctggatcatccagacgtacccgcctgccgttttcagaagcgtttcttttacatagtccggctgaaacgcggcgctccaagcgccgcccgcgttttctttcgtctggatcgggagctggcacacgagcgcgagccccgttaaacataaagaaatcacgagcagctttacagttcgttttgcttttgatgaatcttcattatttctgtaccaaaacagatggaaaaaagccgtgccgataaacagggagagagcggtgtacaaaataccgcggtcgatggccgcttcgggatgaagcgccgcttgcgatgatgtctgctcctgaagttctccgccggcttttccgatgctgaaagggatgacgccggataccggatgtccgtcggccgataccgcgttccattccgctctgtaaatatcatgcggcagattttttttcaatgccgcggtcatgatgcgggcattatttttttgaatcaccgttttgcccgcgtcaacccgttcaccggatgaattatagaccttaatggagtggaagccttcttcaatctgttcattaaactcaatttcaatctgcttcggcgcttgttttaattcgctgttctcacccggatttgagtttgtgatgtaggcgtgggcgaagcttgttttcggaatcaaaacaaggaacagcaaaaagacgagccagcgtttgttctgtctcatggatgatgacaccgccttccggttggttgttgttatgtcttgctgcaggtgcatcccttctgcctgtcgtgtaagatgatgtccgccgcctcgtcaaaggtgcaaatgaccccgccgaatcctttttgaaaccgttctgcgtaatcaagcgttgagaagggaatcgcctgaggccggcagcagtgaaggtcaatatcggcatggactaaaaagtatgcggaagctgccgttagcgtcgtctgaagaagaaaatccttacaaatgacgtgggacacttcatcctttttatcctcataccgcaaaatcgcgcaatgaatgcagcacatctgctcaacggtttgtgaaacggtaataagctgaacagaatacgaatgctgaatcggccgcaggcaatagccgcattgattggcgcttcgttctgaagcgggagggagcgtaatgccgccgggtgtccggataatccggtttgcatccgccagctgattgacgtctctgtacacggtcatctcggagacgccgaatctctcgcttatgtcagagattttcagcgcgccctcttctttcagccattcaagcaaggtttgctgtctgtgaatcggaagcaattctgcatcctcctttttatgcgaatgagtgatgaacctccctctaagagtagatgttttcacaaatgcacacaagagcctgatgataaaatatgtgaaaaaatgttgaacaatcacaaatgtaaaacacgcagtcagactctgttataatagaagagttgaatggaggaataaacatgaaagaaacgacctgcccgaactgcggcaagccgattacaggcgacatggtcagatcatcgatgatcccgtgccagtttcagtgcgggcattgccatgtgaaattgcgtgaatataaagtatcagctccgattatggctgcggccattgcgatcacggtgcttttgatttatcttgtgcagatggccagaaccgccgtcatgccgatgtttccggcagcgcggtatgtgccggccgccattttcgcgctcgtatgtgcgtatccggtgtttattgtcagtgagcggctcattgccaagctcgtcgtcacaaaaggacacattatatacagaaagcggtaagacacctttgatgaggtgtcttttttttgttaaggatttgtcacagtctctgtgccaaactcctctttacttttcattgaatggggattgtaagcgttttatgatgaagacacaggggagagagaaaccccgtgtcttatttattttcatctgaaggcaggcaaacagggagggaatgaacatgcagcaagaacagcaagctggcatgaaagtgaagatacagcggttcggcagttatttaagcggtatgatcatgccgaatatcggcgcatttatcgcatggggaattatcaccgcgctgtttatacctaaggggtggtttccgaatccgcagctgaatacattggtaagcccgatgattacgtatcttctgccgcttttaatcgcatatacgggcggaaaaatgatctatgatcaccgcgggggagtcgtcggagcgacggccgccatcggagtcattgtcggagcggacattccgatgttcttaggggcaatgattatgggacctttgggtggttatctcattaaacaattagaccgtctgtttaaagataaagtcagacagggttttgaaatgctgatcaacaacttcacggcgggaattatcggcgcggtgctgacgattatcgcgttttatgcgatcggcccggtcgtcctgtctcttaacaaattgctggcggcgggtgtggaagtcattgttcacgcgaatttgctgccgattgcaagcgttttcgtagagccggcgaaagtcctgttcctgaataacgcgatcaaccacggcattttaagtccgatcggaatcgagcaggccgccaaagcgggaaaatccattctgttcttagtggaagcgaaccccggaccgggactcggtattttactggcctatatgttctttgggaaaggctcttcaagatcgacagctccgggagcggcgatcattcatttcttcggggggattcatgaaatctatttcccttacattttaatgaaaccgatgctgatcctcgcggcgatcgccgggggagcgagcggactgctcacattctcgatctttaacgcgggtcttgtcgccgcatcatctccgggaagcatcatcgccattttggcgctgacgccgaaaggaagctatctcggcgtgctggcgggcgtcatcgtggctgcggccgtatcgtttatcgtctcggcgcttattctgaaatcgtctaaagcgggcgaagaagatttgacagccgcggcggaaaaaatgcaggaaatgaaaggcaggaaaagtgaagcggcggccgcattggcagacaaagaggaagagccggaaaacagcgccgctgatatttccgctgaccaagtcagccgcattatcttcgcatgtgacgcgggtatgggatcgagcgcaatgggcgcctccattttaagaaacaaagtgaaaaaagcagacctggatattgatgtgacaaatacgtcgatcaataatcttccgaatgacgcggatatcgtcattacgcataaggacctgactgaccgcgcgaaagcgaagctgccgcaggcggtgcacatttcggttgataatttcttaaacagcccgaaatacgatgaactgattgaaaagcttaaaaactaatcaaacagaaagagggatcttcatcatggaagtattggctaaagcgaacatcaaactgaaccagacagtgaactcaaaagaggatgccatccgcctggcgggacagacgttgattgataacggttacgtgaagaacggctatgtggaaaaaatgttcgaacgtgaagaaacatcatccacgtttatgggaaatttcattgcgatcccgcacggaacagaagatgcgaaggatgaggtgcttcattcaggcatttccgtcatccagattccgaatggtgtggaatacggtgaaggcaatacggcaaaggtcgttttcggtatcgccggaaaaaacaatgaacacttagacatcctgtcaaacatcgccatcatctgctcagaggaagaaaacatcgaacggctgatcaatgcaaagacggaagaagaactggccgctattttcagcgaggtgaactgacatgattgcccttcatttcggagcgggaaacatcgggcggggctttatcggcgccctgctccatcattccggctatgacgtagttttcgctgatgtgaatgaaacgatggtcagccttctcaatgaaaagaaggaatataccgtggagcttgccgacggcggcaggcagacagaaatcatcggccccgtttcagccatcaacagcgcggtgcaagaacaagagctgtacgggctgatcaatgaagcggcgatcattacgacggcggtgggcccgaacgttctcagactcatcgccccgtccatcgcggaaggtctgaagcgcagaacgtcctctgagcctctcaatatcattgcctgtgaaaatatgatcggcggcagcagttttctgaaaaaagaagttttcggacatttgacggaagcggagcgggaactcgtgaaccggacagtcggcttcccggattctgcggtagatcggatcgtgccgattcagcaccatgaagatccgctgaaagtatccgtagaaccgttttttgaatgggtcatagacagaaccggctttgccggcgatcagccggtacttaaaggcgcgttgtttacggatgatcttacgcctttcattgagagaaagctgtttaccgtcaataccgggcatgccgtcacggcgtatgtcggctatcagcgcggattaaaaaccgtcaaagaggccatcggccatccggaaatccggcgtgtcgtgtacgatgcactttcagaaacgggcgagtacttggtgaaagcgtacggctttaagcaagccgaacacgagcagtacatgaaaaaaatcatcagccgctttgataatgaatacatcacggatgatgtgacaagagtcgccagatcaccgctcagaaaactcggagcgaatgacagattagtagggccggccaaaaaaataaaagaaccgaatgcgctggcggaaggtatcgccgccgccctgcgctttgactatcaggatgatccggaagcggttgagctgcaaaagcttatcgcggaaaaaggcacgagcggcgttcttcaagacatttgcggtattcagccgcatgaaccgctgcacggcatcgtgctcaaaaagctcaatcaataaaaatgaacccgcgtcggggggacgcgggttttttcttgcgttataatgagagggaagggaggctgcgtgatgaatcagaagctattgccccatcgttttccgtttcttttgattgacggcacgacgaacagtgaagccggaaaatgggcggctgcttacaaaaacatcagtgaaaatgactggtttataactgaataccaaagagagatgccattttcgctcgtcgttgaagcaatggcccaaacggcggcttgcgcgggaattaccggcggtgacggtctcggtctcttatccgcggtgaagaaagcggaaaggttaggtgccgctttgccgggagaccgtctggatcttttttttgaggtcacgcgaatcagacgcggttttgtgttcggccgggcgaaagcgtccgttgccgggaagcctgtggcggaagcggagctcagcatatttatccagccatcgtaaaaaaagccgcctccaccggcggctttcggacaagcgtgttattttgtatcataatctctctcactttgtgaattgtccctctggtcatgtttgtgtttttcgtcattggcgttttccttcagctcttccagcggaatcggatccgttaaatcatgatgttcaggattttcattcggtttgttcttttgttttctttctttcatcctccatcacctcaatatttcttttcctcaacgctcgccccgccaaacgcaggaagcggttttttgttcctgtgggtcatatgtattaaaatagagacgactacaatataaaaagtgaggtacatatatgccgatacaaagagaagacgcagatattaaactgatcgcgattgatatggacggaaccctgctcaatgacgagcagctcatcccggaggaaaaccggcgggcgatcaaggaagcggaggcgaaaggaattcacgtcgtcatcagcacaggacgcacgctgatgacctgccgcgaactggctgagtctctcgagctgtcatcctttttaatcacggcaaacggcagcgaaatctgggattccaactttgagctggttgagcgcaagcttcttcataccgatcatattcaaaaattatgggatctgaggaataagcacaacacgaatttctgggcctctaccgtcgatagagtgtggagaggggaattcccggaaacgattacggatcatcagtggctcaagttcgggttcgaaatcgaggatgatgaagtgcggaatgaggtgctgaaagagctcaaggaatacaaggagctcgaaatcacaaactcaagtccgatcaacatcgaagtcaatgccctcggtatcaacaaagcggctgcgctggcgaaggtatcggaaaaactcggcttcacgatggaaaatgtgatggccatgggtgacagtctgaatgacattgccatgatcgaaaaagcgggtgtcggcgtcgccatggggaacgcgcaggacatcgtgaaagaaacagctgactgggtgactgatgtcaacacggaaaacggggtcgccaaagcgatccgccactgggtgttataatagaaaaaagagagagtctcagcatgaggctctctttttttgttttgtcagatttgtgactaggtccatggtaggttttctgacaaaaggatgttcaaacttgtcagaattaaatataatgaagagaaatccaacaattcggaatagtcgttccaaatatcggaatgataataaaataaaacgtttacaatacaggagggagcttatgtttcagattgacatcaattgtgatttaggagagagtttcggtgcttataaaatcggactggatgaagagattttggattatgtgacatctgcaaacatcgcctgcggctttcatgcgggtgatcccagcgtgatgcgcaaaacggttgcgcttgcggcggaaaaaggcgtgaaaatcggcgctcatcccgggctgttcgatctgcagggattcgggcggcggcagatcgcgattacgcccgaggaagcgtatgatctgacgctgtatcaaatcggcgcgctgtcagggtttttaaaagcggaaggtgtcgagatgcagcatgtgaagccgcacggcgctttatataatatggccgccgtcaatcccggcctgtcaaaagccatcgctcaggcggtctgtcattttgatcccgggcttattcttttcgggctttccggaagcgagctgattaaagcgggagatcgaatcggactgaggacggcaagcgaagtgtttgcggaccgcacctatcaggaagacggcacgctgacgccgcgttcagagccggatgcgctgattcaggatgacaaaaaagcggtcggtcaagtgattcaaatggtgaaagacagcacggtgacatcacgtaagggacaagctgtaaacctgaaagcggacacggtctgcattcacggagacggcgcccacgcgctgacattcgcaaaaacaatcaaaaaagaattaaaagcggcagacattcaaatcagcgcgcttgcaaaagactgagcagcagagggaggaagacagcatggagcaaaagaaaaaaacagccggaaaggcttccggcaaatggtcgcttcttttaggcgcgacatttttgatggcgacatcatcaatcgggcccggctttctgacgcaaacggccacgtttaccaatacattggcggcaagcttcggctttatcattttaatttctattattttggacattttcgcgcaaaccaatgtatggcggattatcgcggtttccggaaagcgcggccaagagattgccaatatggtgcttccgggcgccggttatgccattgcttttctggtcgtgctcggcggacttgcgtttaatatcggaaacatcggcggcgcgggtctcggtcttcaagtattattcggaatcaaaccggagatcggcgctttaatcagcgcagcggtcgcggtgctgatttttgtcataaaggaagccggaaaagtcatggaccgttttatgcagatcgccggaatcgtcatgatcgtattgacggtgtatgttgccgtaacgacgggtccgccggtcggacacgcggttgtaaaaacttttatgcctgatcatatcagtgtgctggcaatcgtgacgcttgtcggcggcacggtcggcggatacattacatttgccggaggccatcgcttgcttgattcaggcatccaagggaaggaagtcattcctcaggtgacgaaaagctccgtcacaggcgtcttgattacatctgttatgcggattgccctgtttctcgccgtgctcggcgtcgtttcaaagggcctgcgcatcgatcctgataatcccgcggcttctgtattccggcttgcggcgggaaatgtcggctataaaattttcggcgtcatcatgtggtctgccgctatcacgtctgtcatcggcgccgcctatacatcggtgtcattcttcaaatcgttttcggcaaaaatcgaaaagcactcacatggcgtaattatcggttttattattgtatccactcttatttttgtcacgatcggccagcctgccaaaattctggtcgcggtcggttcgcttaacggcttaattctgccgcttgcattagcgatgattctgttgggcgcctataagaaaaaaatcgtcggcgattacaagcatccgatctggctcacgattgcaggggcgatcgtagtggttgtcatggcggttatgggcatctatacattattctcgcaaatgccgcagctatggagctgatgatatgaaaaaccatatgagtgatatgagtcccgaagaagtcagacagcttatcaggaaagggcagatgaccgggccgacggcggggttggccgcttcttacgcacaagccaatctcgtcgttttgcaaaaggatcttgcctttgattttctcttattctgccagcgtaatcaaaagccttgtccggtgcttgatgtgacggatgcgggttcacccgttccggcaatagcggcgccgggagctgatatccggacggactttccgaaatacaggatttatcggcatggcgtgcttactgaagaggtaacggatattacgccgtattggaaggataattatgtcgggtttttgatcggctgcagtttttcattcgagcaggcccttattaatcagcacatcccgatcaggcacatcgatgaaggcgtgaacgttcccatgtataaaacaaatattgactgtattccggcgggcccgttttcaggaaaaatggtcgtcagcatgagaccgattccggaaaggctggcagtccgcgcggcgcaggtcacgtcacgttttcccgccgtgcacggcgcccccgtccgcatcggaaatccgcaaagcatcggcatcagcgatttgcatcagccggatttcggagatgccgtaacggtgcgggaaggtgaagttcccgtattctgggcttgcggcgttacaccccaggcggtgatcatggaagcaaagcctgatatcgtaataacacattcaccggggcacatgctgatcaccgatatacaaaatgaatcgcttgctgtcctgtaagtgagaaagaatacaacgaggtgatgacaatgatgcagtatagcggaaatacagcgcttgatatacagccgtacggtgattccgccgttatcatccgctttggcgggcacatcagcgaagaggtcaacagccgggtgcaggcggcggcagcctgtatggaagaacggccgtttccgggcttcgttgaatgtattccggcattcacaagcttaacggtcttttatgacgtgtctgccgtctcaaacataaaaaaaggcgtctctccttttgccctggtcaagaaagaagtgacagaacgtctcagccatataatgaccggccgcaaaaaagagcgccgggtgatggaaatccccgtttgctacggcggagatttcggtcccgatttagaagaggtcgctgaaatgaacgatctgaccccggaagacgtcatccgcattcatactgaaggcgaatatctcgtttatatgcttggatttgcgccgggatttccgtttttaggtggaatgtctgagcggatcagagcgccgagaaaggcgtcgccaaggccgtccatcccggccggttcagtaggaatcgcgggaatgcagaccggtgtgtatccgatatccactcccggcggctggcagctgatcggcagcaccccgctccggcttttcaggccggaagaacatccgccgagtctattgagagcgggtgatacggtgaaattcgtccggatcacagcagaggagtacagccgcatcaaggagggagccgaatgagtatgaaagtggtaaaacccggtctcttgacgacggttcaggacacggggcggacgggatatcagaaatacggtgtgctgggaagcggcgcaatggatacgatctctctgcgcatcgccaatcttcttgccggaaatcaagaaaaagaggcggggcttgaagttacgcttatggggccagggccttcctttgagttctcagaacccgcggttattgccgttacgggggcggatttcgcctttcatattaatggggagcccgcccctctgtggaaaccggttttgataaaggaaaacagcgtcgtctcattcgggccgtgcaagatggggagccgcgcttatctcgccgtcgcggggggatttgatgtgcccgccgtcatggaaagcaaaagcacgtatgtcagagcggggatcggcggcttttgcggaagagcgctgcaaaaagatgatgagctgccgctcggccgtatgacgccatgttcggaatcaatcgcgtaccgtctgagcgattctttcggacagtatggtttctcagcgcctgattggtctgtcagcagcagagggtttctgccgctgaaaaaaaatccggtcatacgagtgcttgaaggcgctcaatttcacgcttttacagaagaagcaaaattacgtttttatcaagagtcatatacggtcacgcctcaatccgaccgaatgggctaccggctgaagggcgctccgcttgaattgcgggagccgctggaaatggtatctgaggctgtgacgttcggaacggtgcaggtgccgccggacggcaatccgattattctgctggctgacagacagacgacggggggctatccgcgaatggcgcatatcatatccgccgatcttcccctcgtcgcccaaacgatgccgggggaacatattacgttccgggccgtttcgctggaggaagcggaaatgctgcttttggagaaggaacagcagctgaaggagctgaaagcaaggctcaaaatggaatggctgatctgacaaaggggctaaagaccatggaaaacaaaaacaaaaccgtcatcaaatcaatggaactgcttcatttgtttctcactgaaccgagcctgagcttaaatgagctggtttctctatcggaaatgccgaagacttcggttcaccggatggcaagctcactggaggaaacagggtttctcacccgggcggcggacggccgttatcagcttggtctgatctttttacaattcggccagctcgtctctgaacgtctggatatcaggaaaatagccaaaccgattatggaagagctgtgcagcgaagtggatgaggccgttcagctgatcatgagggacggggatgaagccatttacgtcgaaaaaattgaaggcacccaaaccgtccgcctgtatacggcaatcggccgccggtcgccgctgtacgcgggagcttgcgccagaagcattttatcgtttctgccggaagaggagattgacacatacattcagaagacaaagcttgccgcaatcgcctcaggcacgatgacggatcgggctgaactgcttcactccattgaaagatccttgcaatcaggttatacgatcagctattcggaattagaagattatacggcggcgatcggggcgccgattttcaatcacgaaggtaaggtggctgctggaatcagcatcgccggcttcgaagcccggttttcagaggacaggctgccgtatttaaccgaaaaggtcaaaaacgccgcacagcatatttctgagaaattaggttattgaccgagccaatttttcttcactcgcgtacattacaatatcgatagtaacgagtggaggaaagtaaatgggacttgtttatacggcgctgggggattctttgacgacggggaggggatccgggccgttttccgccggttttgtccagcggttcgggcgcatgatggcagaagatttacagacaagaaccgacgtatccatctttgccaaatcaggccttgagacgggagaaattctcgggcttatgtccttcccgtacattcagaggcggattcaggctgctgatatgattacgattacaggctgcggcaacgatttgatcgattcggttcaggcatatcagcaaacatcggacgcttcggtattcaccagcgtgtccagtcactgccatgagaactttgaaaagatgataaccaagattgctgccttaaaagggtcgcacccgtctccttatgagatccgcgtcttcaatttatacaatcctttcccgggcatctccattgcagaaaaatggatatcctcttataatgcgcacctcagcacactcgcatcggcgccgcacgtcaaaattgccgacgtccacagcgctttcaaaggaaaaatgaatgaatatctttcttatgaccgcgtacaccccaacagcaaggggtatgaagtcatggcatgcgtcctgcgggggctcggatacggaagcctcgcccgctcataaaccgcgcgctccttttcatggggagcgcgcttttcgtgctccttaaaacaaacttaaaattgtccgactttcgttctatccgcgcaaaaagtacgctagaataatgggggataaagacagaaatagaattgtgttcaaaaaatgataacagaaaggatggattgctttgctgcgcgccttaaaactgtcactcgcgatgctgattattatacttgcggccgccgcatttacgtatgcggaacatacctccgtcatacagccggttatgctcgtgtttctcggtgcggtcatgttcattcaggggctggaggaaaaacggaaagaaaacgacggctccgggaaattcaatatctataccgccgtttttgtatggtcgatctccttaatcggttttacgcttcacgcgatctgagtctgatagatcctgaaaatgctccacaacgggaaatggtgaataaaaacggtgcagtaaggctttccactcctgatattccggcgatccgcgaaagccttttgtatgatcttctaatgtctcccattccacaagcagcaaatatttatgcgtcttttccatacatttggacaaggaatgggacagataacctttcatgcccgcgataatcggctccgcccggcggaatgcctcttcgaattccccctcaagaccttcttttacatacagcatggctgcttctctgatcatctgaaattcctcctttttttaatagatacattgtataaaaatatgggccgtgacggccggaaaaacaaaaaaattttaaacgctatgagaaaaaaatccttgccagcctgatttggtttaggagaaaataacagttggaaggcaggggaattgacagtgaaaaaagggttatacctattacttttactcgcaggaatcataggtttgatcggctgctcgaaaacggaatcggccgaagacagaatgaaagatttcgtaaaagactggaacggcggtcattacgataagatgtaccaaagcctcacccaggatgaaaagaaaaaacgatccaaaaaggattttgtaaaacgatatgaaaccatttatgaacaagcaggggtcaaaaatctgaaagtcactgccgaaaaacaggacgaagacgataagaaaaaagatgacctccagcacatcgattataaagtcagcatggatacaaaagcagggaaggtcgcttttgaaaacacggccgtcctgaaaaaagagaaaacagacgatggagaatcatggaacattgactggaatccttcttttattttcaaacagctttccgatgacaaaaccgtgcagatcgcaaatgaggaaccgaagcgcggacaaatttacgacaaagacggaaaaggtctcgccgtgaataccgaggtgccggaaatcggcattatccctggaaaactcggcaaggataaagacagcgtgatccaaaaactgtctgaaaaactggacctttctgaagacgatatcaaaagcaaactgaaccagggctgggtaaaagacgactcctatgtcccgattcaaaaaatcagaccggatgatgaaagcaaggtcaaaagcctgcttgcattagacggcgtgacgaaaacgaaagtcagctcccgctactatccgtacggcgaaaaaacggcccatctgaccggctatattaaaaccatcacagcggagcagctgaaaaaagcgaaagacggccaatacagcgatacttccaaaatcggcatcgccggccttgagaatgtatatgaagacaagctgcgcggcaagaccggctggaaaatttacgtcccgcaaacaggtgaggtcattgctgaaaagaaagccgaaagcgggcaggatattcatgtaacgattgacatgaaaacgcagacgaagctgtatgattctatgaaagatgacagcggagcggcagtcgccctcgaaccgcaaacgggagagacactcgcgctcgtcagcgcaccgtcttatgacccgaacggctttcttttcggctggagcggaaaagagtggaaaaagctgaatgaagataaaaacaatccgttttcagcgaaattcaacaaactttatgcgccgggatcaacgattaaaccgattgccgcggcagtcggcctgacaaacggcacattgaaagcatcggaaaagaaaaaaatcaccggaaaagagtggcagaaagattcgagctggggcggttaccatgtcacacgcgtatcagagcgcctgaatgaagtggatctcgaaaacgcgctgatcacatcggacaacatctactttgcgcaaaatgccatagatgccggagcggacgcgtttacaaaaggattaaaaacatttggctttgatgaagagattccgtaccaatttccgattgaaaagtcctcaatcgctaacggcaagctagattccgagatccttctcggagatacgggctacggccaggggcagatgctgatgtctccgctgcacttagcggctgactataccgcatttgtaacagacggaaatctcgtcaaaccgacattgatcaaagacggagaaaaaacaccgcaaatctggcataagcaagtggtgtcgaaagccaatgccgaagaaatcacgaaagggctgagaggcgtcgttgaagatccgcgcggctctgcatatcagccggccgtaagcggcattaccgtagccggaaaaaccggtacagccgagctgaaaacgtctaaagaagataaagacggcaaagaaaacggctggtttgtcggttacgattataaaaagaaagacctcttgatcgcgatgatgattcaagacgtcaaaaaacgcggcggaagccattacgtcgttgaaaaagcgaaaaagcagtttcagaatcattaaatgacgatttttgcgggctgaaaggaaaatcggccgccgaagcagaatgaaacagcatgggcaattcctgaaaacagagatacaagaggctctaagaaaaagggggatttcacatgcagcgcattcaattggctgaagacctggaattttcaagagtgatacacgggctttggcgtctgaacgaatggaatgtttcagacggagagctgctgaatctgattgaatggtgtatcagccaaggcatcaccaccttcgatcatgccgatatatacggcggttatacgtgtgaaaagctgttcggcggcgctttgtccctttcgccttcaataagggagcgaatcgaaatcgtcacaaaatgcgggattgtcattgaatcaccggagcggccaggaaacaagtcgcatcattataatacgtcgaagtctcacatcttagcgtcggcggagcagtcgcttttgaatctgaatacggattatctggatgtgctgctcattcacagaccggacccgcttatggacccggaggctgtggctgaagcgtttcacgcgctgaaaagctcgggcaaggtcagatatttcggggtatcgaactttaaagcgcaccagtacagaatgctcgaatcctatttggatgatccgctcgtcacaaaccaaattgaaatctcggcgtacaagctggaaaatattcatgacggcacgctggatttctgtctggaaaaacgcattccgccgatggcgtggtcaccgcttgcgggcgggagcgtctttacaggacaatcagataaggccctccgaatccgtgccgcgcttcgttccgtacaggaagaaatcggcgccgcttccattgacgaagtcatgtacgcatggctgttcacccacccggcagacatcatgccgattgtcggcagcggaaaagagaaccgcatttccgccgcggtgcgtgcatccgcgtacaaactcagccatgatcagtggttcaggatttataccggtgtccaaggctgcgatattccataaacagaacaaacgcccggaaggtatcttccgggcgtttgtttatgtggtgtgcaatgtctaaaaacaagtaaggtcactttgaagtatagccgtgcggatcaagagtaacaagcgtcatggcatattatctgacacatttttctttttcaatactgtcacacggtccagtgccaaattgccatttgaaaatggttgaataatcattgaaagcgttttatattataatttacaccactttccccggcagcactccccatatgccatacttctcacaactagaaaatctggaggcgcgtttcatgtatatgacagcgagagaacaaaaattaatgaaacatctattactgcagaaccgttacgagacagtgcatgaactggcagaagctttacaagtcagcacaagaaccgttcaccgcgagttaaaaacaatcaaaccgatgatggaatcattcggtctggcacttgataaacagcccggcaaaggactgaaagcggtaggaaacccggaggacaaacaaaaactcctgtcagacctgtcctatgaacagcatgaatacagcgctgaggagcggaaacttttaattctatgttcactattagagtcgcaagagccgatcaagctctacagtctggcgaacgaattgcaagtgacaaacgcgacaatcagttatgatctggatgagctggagacctggatcgcgcccttcggcttgacgctgatccgaaaaaggggcttcggcatacagctgacgggtccggaaaatgcgaaacggaaaatcgtcggcaatctcatcgtcaaccggcttgatattcagagctttttggaagcggttgaattcaatattaaaggaaaacctgacgatgctgaaaaaatgttcggggtcgtaaataaagcggaacttttgaaaatggaccggctcttgattcagctcaaggaaaaaatcgcgatcgccttatctgacagctcatacatggcgcttgcggttcatttaacctttgcgatggaccgaatcagactcggagaaaccatcacgatggaggcttcggaactaaaagcgctgcagcagacgaaggagtacggctctgcgatggaaatggcaaaagagcttgaaaaagcgtttggcgtttcaattccggaagctgagatcggttatatcaccattcatttgcggagcgccaaccgccaatacaaaacggaattcaaaccggaaaacattgaagttgaaacggccttgcaaacgaagcagctgatcggcttcatttctgaaaaaatcaaaattgatctgacggaaaacggttctttatacgacggtttaatcgcccatctggagcctgcgatcaaccgggtgaaagaaaatatcgacatgtacaacccgatgaccgagcaaattaaacgcgactactttctgctgtacatggccgtagaagaaggaatggaaaaattctttccggggcttcttttctctgatgatgagatcgctttcatcgttcttcacttcggctccgctctggaaatcaaacgggaagaagcgaagatcaaagcgctgatcgtctgttccagcggcatcgggtcgtccaaaatgctcgcatccagactgaaaaaggagcttccggaaatccgttcctttgatatgtcttccctcatcgaactgaaggaccgagacatcaccgcgtatgacatgatcgtatccaccgttccgatcccgtatggaaacattgattacgtcatggtcagtccgcttttaaacgaagaagacgctgatcaggtgaagcagtacatcaaaagaaaaattccgctgattcttgacaaaaaaagaaacggtaaaagagaagagaagcagccggagacgcctgatatgctggaagcggccggccgtatggcacattatgcggcggttatccaaagcgtgctgcggaacttttcgatcaaatccattgagtcaaacacggcgtacgaactgtttttgaatcgtttgtttgccatgcttgagcaagaaggatttgtccgtaatgccaaacaaaccgcacagcgccttgcagagcgtgaacgacagggcggactcggcattccgggaacggcgatggcgctgtaccatctcaaaaatgaagaaattgtcacgccttttttcaaaatttatgatttgacagctccatgcagtgtcaaaggcatggacggaaattccctgaccgtcggccgcgctttggtgatgatggcgccggctgatatgcccgctgaagggtcggaaatactaagtgcggtcagctccgccatcatcgagtccgaagacagtataaaagccttccagacggaggatgaagccgatttatacaaacgtttaaacaagctgttttatcatttcattcaggagaaaggacagcggtaaacagaaagcgcacacctcatatggggtgtgtttttttctgcatgtatgagggtaaggggaagggaagaaactaaaaacatgggactattgtatcattcacgaatggaatagttctaaaacaaaattgttttacaagttatattttttggtttaaaatgggttgcgtgaggaagaaaatctgacagagttttttgtgatttatgattatgggagatgaaaatatggagacattacagcatatgattctgcatgacatttcaaatagcgaagagatcgaagctgtaaaaagcggtgcgcataccctgacctacgcggaatatcgaaaacgaatcaaccagcttgcacaagcgcttcttgataaaggaataaaaaaaggcgacagagtggcgatgctttgcaaaaacggccacgcgtcatccattgtcatgtttgcggcactcgaaatcggcgcggttgttgtgccggtcagctggcaattaacaccttacgaaatgaaaggcattttagcagcctgtgaaccgaaagctgtctttttcggcactgaatttaaagagattatggaagaagttcttcctgcgctggtatcttctcttaaactgaagatcgagacaggaacagctgcggagacaacgcctgagtttgacgctttattgacaggctccggtgatacaccggatgtcgaaacggtgtctgaaaacgatacggcattgctgatgtttacctcaggtacaaccggcaatccgaaacgctgcatgatcactcacggcggcatatacaactacgtaaacgcgacattggcttacacggggagaatgcagcatgtccgcttcttagcatgccatccgaattaccatacgagcgcgattatctgccagatggtcggcacgatgagcggaacgacattcattatgacagacaatcaggaccctgtggaaaacttgaagctcatcgaaaaagaaaaaattcaaaccatcatggcgctgccagtctatttcacatacctgctgaaagcatgggaaacgcaccagactgacatgtcttctatcgtttatatgatgacgggaggcacaaaggtgccaagcagcctgatccagcagtatctcgacatcggcatcccgctcatgcacggatacggaagcacggaagcgtggggcatcagctcttggaatccgcaaatgggaatggataaagccgcttccgcgggtaaaccgatggaagaagtggacgtccgcgttgtagatccggaaacaggtgaagtccttccgcaaggctcaattggagaagtcgttgtgacaagtccgtttttattcaaaggctacgaaggtaacgaagaagcgacacgaaaagtgctgaaagacggctggttccataccggcgattccggctatgtggatgaagacggatttatctttatcaccggacgttataaagatgtcatcatctacggcggcgataatatttatcctgaccagattgaagaagtcattcagcaagtgccgggaattctcgaaacggcggttgtcggtatccctgatccgctctacggcgaaaagccgaaagcgttcatcgtgacaaacggcagagaagacctgacagaagaagaagtgacccgattccttcaagaacgtcttgctgcctttaaaattccggacattgagttcgtcagcgaacttccgaaaaacaaccttggaaaagtgagaaaagacgtgctccgcaaacaagcggtacgttcataatagagaacaaaaacccggctgccagccgggtttttttcttgcgttccatgtgaaacatttttctccgaaaacgttttgaactgtctcaatcatgtttatccggaagacagcagaggtagacaagaaatatgacaacgaaccagaaggaggaacttgacatggaaaactatccgaaggaattcccggcggaatcacaaaaccgccagccgggcattgaaagcgaaatgaatccggcgcctgtttacgaatacaaagaatataaaggcgctgacaaattaaaagggaaaaccgcgctcatcacagggggcgacagcggtatcggacgcgccgttgcggttgcttacgcgaaggaaggcgcaaatgtcgcgatcgtctattttgatgaacacgatgatgcggaagatacaaaaaaacgagtggaagaagaaggcgtaaaatgtctgttaatccccggcgatgtcggtgaggaagacttttgcaatgaagccgttgaaaaaacggttgaagaattcgggcgtcttgatattctcgtgaataacgccgcggaacagcatccgaaagaaagcattaaagacatcacaagcgagcagcttcacagaacctttaagacaaacttttactcacaattttatttgactaaaaaagcgattgattacatgaagccgggcagcgcgatcatcaatacgacatccattaatccttacacaggcaacccgcagctgattgactacacggctacgaaaggcgcgattaacggttttacgagatccatggcgcaagcgctcgtcaacgatggtatccgtgtcaacgccgtggcgccggggccgatctggacaccgcttattccggcgacattctcagaagaaacagtcgcttccttcggtcaggatacgccgatgggccgggcaggccagcctgttgagcatgtcggctgctatgtgctcttggcctcagacgaatcctcttatatgaccggacagacgctgcatgtcaacggcggcagatttgtgaccacataaggaggctgaccgatgacgatatcgaaacatgacgtgaatgcatactatcaaaaagcgggaatcgttctgactgatgatgaagtcgaagacattcaaatcatggattacggcttaggcaagcttgaggaaaccgggcttcagctgtttatttacgtgaataccgaccgctactgttcgaaagaattggtgctcttcccgcgccagacgtgtccggaacaccgccatccgccggtcggcggcgagaagggaaaacaagagacattccgatgccgctgggggaaggtgtatctctacgtggaaggcgaaaagacagagaacccaagcgtcctcccgccggaagaagacaaggaatactacaccgtctggcatgagattgtgcttgagccgggcggacaatacaccattccgccggatacgaagcattggtttcaagcgggagaagaaggggcggtcgttacggaaatgtcatcgacaagcacggatgatcacgatgttttcaccgacccgcgcatttaaggatgaggctgcacgcctcatcttttttgtatggaaaaaaataaatttacctgtataatggctaataaaggaaagaaggtgcggtcgtgttttcctgtcaaatccgggaacatctgacgatcagattgcttgccaaagaagatacggacgaattgtattctgttatgaagcgaaatcaaaaccatctcagcgaatggctcagctgggcggaagaactggctgacatcgatacgtaccgcgatgtgatcatccccgaatggcgctataaatatgcggaagagaatgggtttgacgccggaatttttgtgaagggccggttttgcggcatgatcagcatccataatgtcgatacagtcaatcaaaaagcagagatcggctactggctggatcgagagcatgaaggattcggcattatcaccgcaagctgccgggcggtcatcacccatgcatttcaggacctcgggctgaaccgcatcatgatcagcgcggctgaaaaaaacacgaaaagcagggcggtggcggaacggctcggatttcagaaagaaggactgacgagagaaggcatttttgtacagggcgcctatcatgacacggtgaactacagcatgctgaagcgggaatggagcgaagatcggcagaagagcacatttcttggtttaaatgtctccccaatgtggaaaagtaacagcggagacgttaaaaaggagtgattcttcatgaatcaaaatgaaatcaaagaaaaagtgcttgaagtactggatcatcataaagtcggttcgcttgcgacggtagagcaaggcaaaccgcattcacgctacatgacatttttccatgacggcttaacgatttacacgccgacgagcaaagacactcataaagcggaagaaattgaaaacaatccgaatgttcatattctgttagggtatgactgtgaaggattcggtgacgcttatgtggaagtggccggaaccgccaaactgaacaactcagcagatttaaaagaaaagctgtgggatccgaaactggaacgctggtttgacggaaaagacgatccgaacctggtgattctcgaaattgaaccgaagcagatcaagctcatgaatgcgggtgaaaaaacgccggccgagctggaactttaataaatcatttgattattcaggggcaatctgttatacttaactgctaagtgacaacatgcaaataaaaaagaaagtaaacttcttttttctgttttgatatagaagcttcaggcttcaacggacagcttgaaaaaaagctgagcttattcttttccttctgatattcgcccctaacgaagagatggaaaaaagactttttgttttacaattcacaccggcgcggcttcggagccgcagtgacgattgagaggtagggctttcgttgtcttgtgttcaagaacttccatggtgtttactttcgaagaatgattctgtcggaactgttaatacgaatcacccgcaggctaaggcgggcaaccatatattatttatttgcgtaagaaaagaataagacaaaaccgcgccggacatccgggcggtttttttatgtaaacggccgaaaccttgccgcagtctgcagagtctaatcagtatgaaaagatttggaggaatcatacattgcacgttattacttcacaagtactgtttatcttctgttttctgctgctgatacattcgattgaaacgcttgcctatgcaacacggctttccggcgcgagagtcggatttatcgcgtccgcgctgtcattatttaatgtcatggttattgtgtcgcgcatgtcaaacatggttcagcagccgtttaccggacatctgattgatgccgccggatcaaacgctctgtctgttgtgggcgctcagtttcgatttttaatattcggctccacggtcggaacgatgctcggcatctgtcttttgccgacattcgtcgcgttattctccagggcgattatacacttggcggacggaggaggctccgtcatgcaggtatttaaaaaaggattttcactgaacgggctgaagcatgcgcgttcttatatcagactgccgtcagtctcctatttaaaggggcttcaattccgaatgattccgaaacgcttgtttgtcattaatatggtcattacgtctatttacacgatcggtgttctgtccgctctgtacgccggccttctggcgcctgagcacagcacgacggccgttatggcatcaggcttaatcaacggcgttgcgactatgctgctggccgtgtttgttgacccgaaagtctccgtactggcagacgatgtggcgaagggcaagcgcagctacgtctccttaaaatggacctcattgacgatggtcacatcaagggtcgcgggcacgcttctcgcccagctcgtattcatccccggcgcttattatatcgcctgggtgacgaaatggatgtaacgcatgaaaaaagctcctctgcagaagaggagcttttttattgataatttctcaggccgcgatcataaataaaattaccgaacggaataaaggccgcgataaaaccggcggctgaccatttcacatgccatttgacagtaaacgccgcatacgccagcaccgccagataaatgataaacaaaccgccgtgaatggaaccggcaatggtgacggcgagcggatgatgagcccaatacttcagcggcatcgcgataaacagcagcaccaaaagcgacattccttcaataaaccccatcgtgcgaagtctgccgatcggcgtgtgtaacatacagctccctcctgtcggacatcttttttcctctatactataagcaaagggcagtcctaatatgaccatttcgcgtcagttcctgaaaaaaccttcatgatttcagcctgttgttcttgtcatttttcggatttctcttgataatatagccaaaagggtaaggaaggactacagtcatgaaactagataatgtggatctgagcatcattaaagagctgcagcgggacagccgcctgtccatgcgggagctgggcagaaaaatcaaattgtcagccccgtccgtcacagagcgtgtcagacagcttgaatccttcggcgttattaagcgctatacattggacattgatcaaaaaaagatcgggctccccgtctcctgcattgtcgaagcgacggtgaaaaacggaaaatacgatcaattcaaaacctacattcaatccattcccaacattgaattttgttttcgggtcgccggggcggcgtgttatatgctgaagattaacgcggacagtctggaaacgatcgaacacttcatcaaccgcacctctccgtatgcccaaaccgtgacccacgtcattttctcagaaattgacacaaaaaacgtcctcgattagagagagcgtgaggaagtctgttataataacaggatgagtgtgaaagaaagagaagtgaaaagcatgtcaaaaacagttgtattagctgaaaaaccttcagtcggccgggacttggcccgtgttctgaagtgtcataaaaaaggaaacggatatcttgaaggcgaccgctacatcgtcacatgggcgctcgggcatctggtaacgctcgctgaccccgaaggatacggcaaagaatttcaatcatggcggcttgaggatcttccgattattccggagcctttaaagctcgtcgtcattaaaaaaacaggaaaacagttcaatgcggtcaaagctcagcttgtccggaaagacgtcagccagatcgtaatcgctacagacgcaggacgggaaggggaacttgtggcccgctggattatcgaaaaggcaaacgtccgcaaaccgattaagcggctgtggatttcctctgtgacggataaggcgattaaagaaggatttcaaaagctccgcagcggcaaagagtacgaaaacctgtatcattccgctgttgccagagcggaagcggattggatcgtcggcatcaacgcgacccgcgccctgaccacgaaatttaacgcgcagctgtcatgcggacgcgtccagactccgacactggcgatgatcgccaaacgcgaagcggatattcaggcgttcaaacccgttccttattacggcctccgcgcggcggctgatcagatgacgctgacatggcaggataaaaaaacaaaacagacaagaacgttcgatcagacggtgaccggccgtttggcaaaagacctgcaaggaaagccggcagtcatttcagaattgaaaaaaacggcgaaaaaaagcttcgctcccggtctttacgacttgacggaattgcagcgggacgctcataagcgcttcggtttctccgcaaaagagacgctgtccgtgcttcaaaagctgtatgaacagcataagcttgtcacttacccgcggacggattccagattcctttccgcagacatcgtgccgactttaaaagaccgtttaaacggcatggaagttaagccgtacgcccagtacgtcaatcaaatactgaagcggggcgtcaaagcgcataaaggattcgtcaatgatgcgaaagtatcggatcaccatgccatcattccgacagaggagccgctgatcctttcaagcctcagcgacaaagaacgaaagctttacgatctgattgccaaacgttttctcgccgtgttaatgccggcgttcgaatacgaagaaacaaaggtcacagccgatatcggcggcgaaacatttaccgcaaaagggaaaacggttcaatcgcctggctggaaagccgtgtatgatatgtacgaggatgacgacgatcatgaggaagacaaagaccagacgctcccggatcttcagcaggggcagcgcctcactgtctcatcattgaaagaaacgagcggtcagacgaaaccgccggcgcgctttaatgaaggcacgctgttatccgcgatggagaacccaagcgcctttatgcagggagaagagaagaaccttgtgaaaacattgggtgaaaccggcggactcggaacagtcgccacccgcgctgatatcattgaaaaactgttcaacagtttcttgatcgagaaaaaagaaaaagatattttcattacgtcaaaagggaagcagctcttacagctcgtcccggaagatttgaaatcgccggccttaaccgctgaatgggagcaaaagctctccgccatcgcagcgggcaaactgaaatccgccgtgttcattaaagacatgaaaacatatgcgggcaaaacggtgaaggagatcaaaaacagcagccagactttcagacatgacaacatttcaggcaccgcctgccctgattgcggcaaaatgatgcttaaagtcaacggcaaacgcggcacgatgctcgtatgtcaggatcgtgagtgcggcagccggaaaacgctggcaagaaaaacaaacgcccgctgtccgaactgtcataagaaaatggagcttcgcggccagggcgaaggccaaaccttcgcatgtgtatgcggccaccgggagaaactgtccgtctttgaaaagcggaaggcgaaagataaatccggacgcgcatccaagcgggacattaactcttatatgaaaagccaaaacaaagaggagccgatgaacaacgcgctggcagaacagctgaaaaaactcggcctggataaatagatcagagaaaggcagcatttgtaaagaaatgctgccttttgttgtgttttttactgtaatgggaatacgatccatgtgaagagggaaaaggtgagaggcggcgcttccatttaaaattttccaatgtgaaaaaatgctagtattcttttatcgtttcctttatagtaaaaatactttgtgaaaaaataagatatgggtctaaaaaaggatttgtaaaataggaggatggactgtgaagcaattcgtttttcgtctgatgatccttttgatttcaatcgttctgacggcggggtgcgcggaggccggacctgaaaaacagacggcggccgaaccgtccggaccgcttcagcccgcagagcattttatttatcataaattgatgaacgggcgggggatgatccggacgaacatatccggtgagccggaatatttatctgagtctctcggactatggatggcatttttgctgaacaggaaagatgaacggcagtttcaagcgcaatatcagcttctcaccgattcgtttctgacgaaaaacgggctcgtgtcgtggaagattgacgggaataaagcgagcggcaccaatgccttaattgacgatttcagaatcatgaactgtctgaatgaggccggaaccctgtggggaaacagtgaatacgggaaaacagcggtgcagatcgggaaggcgctggaaaaatacaatacaaatgacgggtattttacggattattatgatgccgcttcaaatgccgcatcaaagaccgtgaccttgtcctatgttgaccccggcgccttacagatgctcagagaaaaagggattatcgatgagaaaacggaaaaccggaaccttgatgttctcaatcgagctcccctgaaaaatggttttctgccgaaatcattcaataccgaaacaaaggaatacaaatatgacagcgaagtgaatgtcatcgaccagctgtacgccgccgtgaatctgaagcggggcgatggcaaggctgccgcgctgtcaaaatggatgatagaggaatttaagtcgcgcggacagctgtacggacgatacagcgcagacacgaaggagccggcggttcagtacgaatcaccgtccgtttacgccctggccgttctttttttagcagaacaaaaagctgatccggctgtcatcaagccgctttatgaaagaatgacttcatttgaaacactggacacgctgaaacccgattacggcggctatatgagcgggagcgatacacattctttcgataacctgctgccgcttctggctgaaaggaaattgtttaatgaaaatatcattcaatgaatcacaaaaactgtgcagctacacagcagttatgctggtgctgctgtctttttttatttactatgcgtctcagcaatccgcagggcttctgataacctgcatcacattgcttgttgcgggagccggtatatggttcggggcaatctacgcgctcgtcatgaccttactcgtcttatttgttctcggcagcctgctcctgtggtttcagaccgggagctttatggcgtctgccgatgccgaaagtctgcaggtgctggtcatttgggggattgcgctgctgctcttttcttacatagcgggaaggattcacgagttggcgaaggggcttgaacgctcagtgaaacagctgcgtgaagagattacgagctttgtcgccgtcgacagggtgaccggctttgacaaccatctgcggatgaagctggagctttccgaggaaatcaagcgggcggaacgctacggcaattccttcgtctttttgctgctgcacatgcattatttcaaggaattcaaatccctatacggagaaaaagagaccgatcggctgctggcgtttatcagccgccaaatccggtcaagcgttcgggaaacagacaaaaaattcaggccgtccgccgaacggttcggcatcgtgctgacccatacgcctgaagaaaacatgccggccgttctggcgaagctgaaaaaggaattggatacgtaccggctgcaaaacggtaaatacgtctccatcaccttccgtgtatgttacttggcgtaccgaaaggatttacaaacggccgagcaatttttaaatgaactggaaaacgagatgatgatgaatgaactctaaatggatacgtctcttactctcggcgcttttcatgatttcggcggtttatgttccccgtccggcggaagcaaaagacaaaaaggacggcattctcattatttatacaagcacggacggcaaagaaaccgctgaggtcaaaatgcttgatctgaccgcgggccatttctcatccgccgtcaccgtgaaaagcgacggagacatcacagccgcggacttcaaaaagaatcggcgcgtcatctattacggcgtcacgaaaaaaaagctcagcacatcatttgtgtcactgatcagcagcatgccgcagcagcttatcagcatcggctataacgccggacagttccgccaatttgcggggttgtccctgacagaaaaagaaacggtataccgcatttacggcaaaaaagaaaaaacagacatgccgcttgaaaagggggtgtccgtgctcggcgtatcgggagtaaaaggaaagtccctttatacataccggtccggtgacggcagcacccgcccttttatgtggaaaacggcgcgctctgactattatttcggtgtgacgagcctgttaaatgattcgtttctgacggcgaaagcgatgcgcagcgcattcggagaatcagagggcggcaccctcctttatttgcggcttgaagacatcagtccgatgtcagatgaaagattgctttacgaagcgggcgcttacctgcataaaagacacattccgtttattctggcggtcattccggtctatctcaatccggaaaacggagaaaaagtatacctggcggacaagccaaaaatggtcagcgtcctgaaaaaacttcagcaaatgggcggtagcatcattattcacggctacacgcacgcataccgatacagcgaaacgggagaaggctttgaattttgggatgccaaagcggatcagccgattacgtcagaaaatgcggatgatactccggtcaagcttgaaaaggaacaggattttccgaatgaaaaagcgtaccgggcgtatgtgaagcctttccgtgaaaaagaaaacatctacacgagaacgaagctggagcaggcgattgacgatctgacagagctcggcctttacccgctgtcattcgaagcgccgcactacacgatgtctgaagaaggctacaaaatcgcatcttcttatttctccagcattttcggacaagtgcagctcagcggcgcgacgtggaaaacctcgggcgcccctccgttcgtctcaaagccggctatgctggacgggatgacgctgtaccctgaaacaatcggttatgccgataactcaaaggaaaatccgctcggagatatggagaatcatatttctcagatgattgatttcggcggcggaacggcgggcggtttctaccatccgtatctcggcatgaaataccttcccgagctcgtcaatcagatggagcggattcccggcggcgagtggctcgatctgaagaaaacgaagcaaacggtaacgtcggacagcgtcaggatcaaaacggacggagacggaaccattcatgtggaaaacaagattcatccggtaacggcctttttcaatcatcaccagcagacgcctcttgaaaaagcgctttggattctctccggcgtggtgttattgtttatcatcatgttcgcctgctacgtcctttatttgcgcgccacattaaaaaaacgaatctttaaggagagaagaagccttgagtaacattctgttttttatctcattaagtttaatatgggtgatgcttctctatcacatgtttctgatgcagggcggattcaggcattatatgaccttcgaacggaacattccgaaatggcgcgcaaagatgggggagctcccgaaggtcagcgtgctcatccccgcgcataacgaggaggtcgtcatcaggcagacgctgaaggcgatggtgaacctgtattatccgaaagacaggcttgagatcattgtcgttaatgataattcctccgaccggacgggagacatcgtcaatgaattttcccgtcagtatgacttcattaaaatggtcatcacaaagcccccgaacgccggaaaaggaaaatcttcggcgctgaactcagggttcgcggaatcgaacggagacgtgatctgcgtgtatgatgcggacaatacgccggaaaaaatggcggtgtactacctggttctcggtctgatgaatgatgagaaagcgggagcggttgtcgggaaattccgtgttatcaatgcggcgaaaacgatcctgacgaagtttatcaatattgaaaccatctgttttcagtggatggcgcagggcggcagatggaaatggttcaaaatcgccaccatcccgggaacgaacttcgcgatcaggcggagcattatcgaacagctcggcggctgggatgataaggcgctggcggaggataccgagctgaccatccgcgtgtataatctcggctatcatatccgctttttcccggcggctgtgacatgggagcaggagcctgagacatggaaggtctggtggcgtcagcggacaagatgggcgcgcggcaaccagtacgtcgttcttaagtttttatcccaatttttcaagctgaaacgcaagcggatcatcttcgatctgttttatttcttttttacgtattttttgtttttcttcggtgtgatcatgtcaaacacgatttttatcatcaatcttttttacgacctgcatctgacagtcgggtttttggcgatgattttgtggatactggcctttttcctgtttatgactgaggtcatgattactttaagcattgaaaaaacagaaatgaacaaacaaaacttctttatcgtatttctgatgtactttacatactctcaggcttggatcgtgctcgtcatctggtcattattcacagagatcaagcaccgattgttcaagcaggaagtcaagtggtacaaaacggagcgatacaatcaaaataaaagcgggtgacctttttgaaaaaagcgatattgataactggccttttgctattgatgtataacgggcaggcggccgcggcccgggagctgaaaacggacggttccgctctcggaacaagcgccggcgcaaaagagcagcaggcgctgactggcgatctgatgacactgtacggggcgaaagacagctcagagctgacctatcagattcctgcgggagcttcgaatgccgatcagtcgcttctgattgattacgaggcgtcaaacttattaattgccccgtcttctttaaccatcgccattgatgatgaacccgtcaaatccataaagcttgacggcagctccaagcggaaaacggtgaagctcaatctcagcaaaagccaatccgcccaaggctatcacaatgtatcattacgattttacggcgtattaaaagagggcgtctgcgtcaggcaggatacgtcaggcaactggataaaaatttatccggacagccgccttgtgctttcagaagcaagcaagtcaaagggagcggatctcggccatttcccgtatccgtttgcccaatcaggcaatacgggtgaagaaaccgatattatccttcctgacaaaccgacctcggcggaagctgaagccgcagtcaaaacagaaggatttctgaaaacggcagacagcaggctgaaggtatcctatgtaaaagaatccgatgccggcaaaatcagcaatccgtcaattgtcatcggcgctgatcagcattggaacgggaaaataaaagagcttttcgaacgggggaacttcaaagcggaagacaacaaactccttctcgccgaacgggttctgacatcaggggacaaacggcagcccgtcctgtttgtcacggcgcactcagacaaaacgctggcggataaaatccgcgtcatcacagacagcgcttattcaagccagctgggcggagatactttgacaatcggccgccttcagcccgctgcggaaaagacaggcaataaactgacattagaggacttcggcgcgggaaatgtaacggtcggatcaaacaaaacggcgtcagagcacttcttttaccctgcggcggccgctgttgataaagacggtaaggtcaagctttcacttacattaaagacgtcggaatcgatccggacgaaggcggattcagctaatgacgccgagagagcggagctgaacgtcatgatcaacggacagccgaatgcggtgcgccttgatgatctcggcaatcaagataaagatggcttttaccacgtctcaatcccgattgatccgaagcttttgcgaagcagcaggtacattgatctgcaatttgtcacatcaggtttgaaacataacaacccgtgtattgaccgtgacgaaaataaatgggtctatattgataaaagcagcatgctgacgtatccggtaagtgatgcggcgcagaaagcggatttcgggcaatggccgctcccgtttgcgggcggcgtgaaagagaaaacagtgatcgtcatcccggatgacgtaaacatacagacactgaaagaactttctctggtggcggattcattcggaaacggctttaccgtaaagacggcatcagacatgaaggaagcggatgccaaaggccggaatgttgtgtttatcggaggcctgccgcaaattccgcttttgaaatcaaacgcctctaagcttctcgtgccgtcagaccgcagcggcgcgtacgatgtttcttcgtttcagatgctgaatgagacaacgaaacaagtcgcgtttacccaggaatcaccttgggactccggccgaagcatcgctgtttttgctccgttatcaggcagcggcgcgtctgtcacaaaagagctgatcagctttttagacagcacaagcgatgccgcaaccgtcgtcaacgaaacggccggcaagcagctgttttcaaaccatcagcaaatcaaatccgacgacagcagtccggcgcctgatacgaaaagccgttccgcagcactgaacgtcacgtatatcgctgttttcgcggcgcttataattattgcggccggtctgatctggctgacggcaagaaggaaaaaagaaaagcggataatgaaaaaagtgaagagtaatgaaggaaaaagaggccgttaacaggcctctttttttgtatttttatttccatttttggcggtgatttttttatttttgaaacagcataaaagcccctttacaactgaacgggacgggagtatgatctcttttataatctatatcgcttaatctgtaatcagagcgggggaaccaatttgcggcgcgtcatgccgcttggggtgaatcctttttcaggtagggccaactctcatcagcccgaatccgacagctaacctcgtaagcgttcatgagaggagatgaatgaaacctgtgcacgattatggcgcaggggcatccgtttgcctctgtgtctttttgctgtgccgaaatatggcatgcaatcgttattcagagacatcatagcagtaagggtttgtaaatcaaacggaaaatgaaaaaaaggggaagacaaaaaatgtaccattcaatcaaaagatttttgattgggaaaccgctgaaatcacaggcggccggagagcagaaactcacgaaactcaaggcgctcgccatgctttcttcagacgcgctgtcatcagttgcttacggaacggaacagattctgatcattttggctgcggtaagcgcggccgcgttttggtattccattccgatcgcagcgggtgttctcattttgctgcttgctttgattctgtcctacagacagattatttacgcttatccgcaaggcggaggcgcttatatggtttctaaagaaaatcttggtgagaagcccggcctgattgcgggcggctcattgcttgttgattatattctgacggtggcggtaagcatttctgccggaactgacgcgattacatcggcatttccggccctgcacccgtatcatttgctcattgctgttttgcttgtgattctgattatgattttaaatttgagagggctgtcagaatcggcgtccattttggcgtatcccgtctatctgtttgtggcggcgcttgtccttttgatcgtcgtcggtctgtttaagctcatgacgggccaggttcatccggccgagcatacaccgatcggcacgcccgtagcgggcatcacgctgtttttgctgctgaaggccttttcatccggctgctcggcactgaccggtgtggaagccatttcaaacgcgatcccggcctttaaaaatcctccggcgaaaaacgcggcccgcactttggccatgatggggattctgctggcgatcttatttacggggattacggtgctggcgtacggctacggcacgggtccgaagcctaacgagaccgttatttcacaaatcgccgcggaaaccttcggacgccatacggtgtactatttcattcaaggcgtgacatccctgattcttgtgcttgcggcaaatacgggcttttccgcttttccgcagctggcgtttaatttagcgcgcgatcagtatatgccgagaatgtttacggtacgaggcgaccgattaggattttcaaacggaatcatctttctcggtatcgcgtccatcctgctcattcttttattcggcggccgcacggaacatttaattccgctttatgccgtcggcgtgttcattccgtttacgctgtcgcagacgggaatgtgcatcaagtggatcaggcagaagccgaagggctgggcggtaaaaatgctgatcaactcatgcggcgccgccatttcatttatggtgctgtgtattttattcgcgacgaagttcaatcttgtctggccggtgctgttattcatgcctgctgtcgtcatgctgtttttcgtcattaaaaatcactacaccgcggtcggcgaacagctgcgggtcgttgatcagcagcctgaggaaatcaagggaaccgtcgtcatcgtgcctgtcgccggtgtcaccaccgtcgtccaaaaatcgattcagtatgcgaaatcattatcggatcaggtcattgcggttcatgtttcctttgacagagaacacgaaaaaaaggtggaaaagcgctgggaagagcttcataacggcgtccgcctcgtcaccctgcattcctcataccgcagtctggttcacccgtttgataagtttttggaaacggtcgaacaaaaagcgaaaaaagaacagttctccgtgatggtgctgtttccgcaatttattacgaaaaaacgctggcagaccatccttcacaaccaatcagccttcttgctccgcgtccggctgttttggaagaaggacatcatcgtcgccaccctgccgtatcattttaaaaagtaacggaaagaccgcaggctgaaatgccgcggtcttttttgtaaaggaggacgacatggcacaaggcgcttttgtcatcatacaaaatgatgggcgggacatattgctcgtaaaacgaaaagacgttccactatgggatttgcccggggcgggattgaagaaggtgaaacatctgaagccgcagccgtcagagaggcctttgaagaaacagggtataacgtgaccatcctgcaaaaatccggtgagtatgaaaggccggcatttgaagatacacagcacgttttcatcggagccattaccggaggaacaccgctgatgaacggatcggaaaccgccgatttacgctggttttcccaaaaccggctgccgctgttcatggtgccgaacagaaaacggcaaataaaagacggactcaatggggcggcaaatcgtaaggcagtccttaaagaccgaaatctgttatccatccttgatctgctgagaaaaaagctgagagtatagcccgtgtttcaacccgtatgaaaaaggggatgaatacaggtaaaaggaggatgcagtatgccaagtaaaacagcaggacacgtaatgacggagctgcttgaacaatggggagtcggtcatatatacggcattcccggagacagcattaatgaatttatcgaagaactgagacatgaacgaaataacctgacattcatccaaacccggcacgaagaagtcgcagccctggctgccgcggctgaggcaaaactgaccgggcagatcggtgtctgcctttcaatcgcaggaccgggggccgttcatctgctgaacggtttatacgacgccaaagcggacggcgttccggtgctggcgattgcgggacaggtggcttccgatgaaatcggccgtgacagctttcaggaaatcaaattagagcagatgtttgaggacgtggcggtattcaaccagcaggtacatacggcagaagcgctgcccgatcttctgaatcaggcgatccgcacggcttacagcaaaaaaggcgttgccgttttaaccgtttctgatgatttattcgcgcaaaaaatcaaacgggagccggtttacacatcgccgatatacctcaaagccgatatagagccgaaaaaagaacatctcgtcacatgcgcgcaatatattaacaacgcaaaaaaaccggtcattcttgccggccaagggttaaaatcggcaaaagaggagctgctcgcattcgccgataaagcggccgctccgattgtgattactcttccggcaaaaggcgtcgtgcctgacagccatccccactttctcgggaatctcgggcaaatcggcacaaagcccgcctacgaagccatggaggaatgcgatctgctgatcatgctcggcacatcgttcccgtacagggattatctcccggatgatacgcccgccattcagcttgattcggatccggcgaaaatcggcaagcgctatcccgtcaatgcgggaatcgtcagtgatgcggctctggggctgaaagagctgacggaatacattgaatataaagaagacagaagatttttggacgcctgcaccgagcacatgaagcattggtggaaggaaatcgaaaaggatgaaaccgaagcgactcatccgctcaagccgcagcaggtcattgcccggcttcaggatgcggccgcagaggacgccgtcctgtcagtggatgtcggaacggttacagtgtggatggcccgccattttaaaatgaagaagcaggactttatcgtctcaagctggctcgccacaatgggatgcgggcttccgggagcgattgccgcaagccttgccgaacctgatcggcagtccatcgccatttgcggagacggcggattttcaatggtgatgcaggatctgccgacggctgttaaatataaactgccgattacggttgtcatattaaacaacgaaaatttaggcatgattgaatatgaacagcgggtcaaaggcaacattgactacgtcacccagctgcaaaatatggattacgccgcctttgcagaaagctgcggggcaaaaggcatcaaagtgacgaaacacgaggaattggctcccgcttttcatgaagcgctcaactcaaatgagccggtcgtcatcgacgccgtcatcggcgacgagccgccgcttccgggaaaaatcacttacggccaagcgaagggcttcagcaaatacatgctgaaaaacttctttgaaaaccaaaaaatcgaaatgccgtcactcaagaaaagcttaaaacggctgttttaagaagccggtggttataaaaaaattaacaggcagcatgcctgttaatttttttaggctttcttattgatgattatttctttactgacccccttccatggtaaggaagtggtcagcagtttgacccgcttggaagcttagaggacgggaaccgtaaccgaaagtatatcgtattaaaatctgcggaaacggtaaagaaaatcgtaaaatctgcagctagcaagcgatggctgataaaaaagcttttggagggccaggacagttcataacaaacgtggttcgctcattagcatcgcacagcccttatcagcaaaaacaggaacaaagactggcgtggcgacgtacaccgtcaagaagggagatgtcctccctgtaattgcacagaaaactgccgtaaacatggccaccatccagagattgaacagtatcaagggcccgaattttatcaaagtcggccaagtattaaagctgacggactcggccagctctccaacaaaaggcaaaaaatcatcttacacgctgccatcgggcgtttttaaagtgacaagccccttaactaagggaacggccgtgaaacagatccagacagctttggcggctctctattattatccggacaaaggggcaaagaacaacggaatagatggctattacggaccgaagacagcaaatgcagtcaaacggttccagtccatgtatggactgcctgctgacggcatttacgggccgaaaacgaaagcaaggcttggagaaatgttaaaaagggaataaaaaagcaggctctaaattgcctgcttttctttttattagcctaatttctcttttgagatcttatccaaattagtaaaaagtatatccaggcccgaaaataagaaagttatgaagaatgaaagaagaatttctccaccttgaaatatagatatgttttcaatgaaattactggaaacatatttaattgagaagtaaacagcagcccatgcaaaaatgaattcaagtatataggctaaccaagcaggtaatttaaaaatatgagtaattccttttacaattgccataaggattagcatataaattaaagctaaaatacttacgacaacagaaaatatgtataagtctgaaagtgaaccatagatgatatactctccgaaaaaatgatttacagttatagctacaaaataaatacctaggctaggtacagttatagcgaagaacagggagaatccaataagccctatgaatgctatatgagctaagtggttgggtggtgtatccacaatctccttttttaatagaatcataaaaataagagatgaaataacaagacagcatagtatggtgagcaatacggtaataaagatagccatgttaacctccaatgaaaaagtgctattagagtgaatctaacagcactttaaattttaaatatgttaaatcaaagcaacaatgaatttagctaaagtggtagctacatctgtaggagctccgatagctttaaaagcttttgtaaattgttttacaccccaattttcacctttatccataatgtcggcaaccttcttagagttttttctaatccatgccgcagctttaggggagaatggctttaaggcttttgataaaagccatccacctgaacggcaggcagctctgaaagccttataggaccacgaaactacaccttgggtttggtagtcaccattgagagccgctttggttggaatagtgccaggcattccagttggaatagtacctggtgcagttttcgttaccggtacaggagttgtggttctgttttcagctgctaaagcacctgaagtacccaagaatgatgtaagtagagttgcgcttaaaactacagggattactttcttcttcatatatattttcctcctaataatttatgaataacaataaaatgtttcatcgctaacgttgtccaatgagcgaggcttttagccttgtcagaaagtccagactttttaagtgaaagataaagattctctccacgtcaatacaactcaaggcaacatattcgtttaatagcttctttaaaaccagtttaagctaaaaggaaaacggcttatcaattattataaaaaattggtttggtaattccagtggcattagtagtggtatctcggttttcttcagctcaggatgtggggacaaaagaagcagttacaagggctaaagatgtggcgaatagaataccgttagctacgtgtttaatgaaaaatcctcctttaggaatgtaatctgccagcgaaatgaaagactatgtatttaggatagtcctatattattctctttgaatatttttccacctccttcagaaaccattctatcaataggtattttttgggtaaatagtatttttatacagtatttttatgttgaggtataatttccctgtgtcttaaaacaagttaatcaggtgagtatgacgcaaaagtaaattgcggttttttttcgttttcactttatgttcaaatagttataatattacaaaaatagcaattagagggagaggtatatatggatcaagttttaccgtcgtcccaagttggtgtcaagatcaatgaatggtacaaaatgattcgccagttcagtgtgcctgatgctgagattttaaaggctgaggtcgaacaggaaatagaggagatggaagaggatcaggatttgcttgttttttattcattgatgtgctttcgtcaccaattgatgttagattccttggagccggaagacagatatcgagatcgccccacagtcgacgaactacttgaaaaaatagaaaagccgcaaaaaagacttacaggcctcttgaagtattactcattattttttcgtggaatgtatgaatttgatcataaagagtatgttgatgcgataagctattatcgcaaagcagagagagagttgaatgctgtatcagatgaaatggagcaagctgaatttcattacaaaatagctgatgcctattatcaaattgatcagcactttgtttccctcaatcatttaaaaaaagccaagcaattgtttgaaaaaaatcaattatacaaagtgaaagtgattggctgtaatatgatggtcggtgctaacatgtacgatatgtacaggctgacggaggcagaatcatattatcgggaagcattaagtaacgcccgtggcttggatgaggaaaaagtgaaaagaattatcggagtgatctttcataactcaggcttagtttatttaagagggaaaaatttgattgctgctgaagagaatttcaaaaaggcaatagacgtgaaagaacatattgatacagtgtatggagtgagatcattatatatgatggcgaatgtcctgtaccaatgtgataaagccaaggaagcacgtttcttttatgaaacggctttaaatcgtgctcggacttctaatgaagaggaatatttggctaaattaaaaatcattaattcattgtacgaagaatataatgaaacagaagtgaaacaaagcttaggttacttggaagagaaacgcctttggtctgatttcgcagagctaaccgaaaaattaggtgactttcattttgagaagagaaactatgcagagggaagaaactttttaaagaaaaccatacatgcccaaacacaaatacttaaggttacggaggctatataatgaagaaacttataatcagctccgctttaatcggtattctttttactggattattaagtgtgacaaatgtttatactgctgaaatgagtgactctggaactttttatatcgctgaaaaagctataaatatttaagtgttctccaatttttgacctccaccttttaagactgggggatttctttttcttatccagtaatcaacatacgctgcctcataaggttcttaaccgttacttgtattgcgttcacctttccgttttgctgtgaagtgttttcttgaacgatgcatgcatgagaaagacgccgtccatttttaagcctatcttcaatcattcaaggacaaacaaaagagctatcgagaagatctcgacagctcctttgtttgttgagcggcttgcttgcatatagtcgtcctaaacgaaaacgatgattgtgaaaatcggcagctggcgagcgatggctgatcaaaaaactcgtgatggatcagcgcggtttcatctgaagaacagccagagagcggtcacaacagcgatcataaagtaatctccatcattcagtttagttccatttttgacaaacacatgtgccgtccggttcgtctttgtccctttcggagttttaagcgcaatgttcttccctatattgtaataaacaactttaaacaaataatatgccagcgaacagaataaaaagagcaacatgaacttgccaataaacaatatcatgtttcattactcctttttgccgttttttcgtttgaatatatgacggaaaagtcaggatgttatataaaaggagaagtattttaccgaggctggtgttaaacattaatgaacggttcgccgcaacatccccagatccggaacaatttcaaaacgaaagagaagcccgaggattattaaaaacagaccctaatttgtccgcttttttttgaacatttgatccaagatgaacataaagagagtgaataagaaggacaccgtaatcatatctatcagaaatatattaggagtatcttttattaatagcagccataccacctgcaaaactaaagaaatagaaaaataagatatatatgtcatgatcctcatatttgttacccccttagcctaatttctcttttgtgatcttatccaaattagtaaaaaggatatccaatcccgaaaataagaaagtgatgaacaatgaaagaagaatttctccaccttgaaatatagatatgttctcaatgatatgattggaaacgtattggattgagaagtaaacagcagcccatgcaaaaatgaattcaaggatataggctgaccaagcaggtaatgtaaaaacatgagtcattccttttacaattgccgtaaggattagcatataaactaaagctaagatactgacgacgacagaaaatatgtataagtctgaaagtgaaccatagatgatatactctccgaaaaaatgatgtattgttacagctgcaaaacaaataatcaggctggggacagtcacagcgaagaacagggagaatccaataagtatgatgaatgctgcatgagctaagcggtttggcggtgtatccacgatctctttttttaatagaatcataaaaataagagatgaaatcacaaggcagcataagaaagtgagcaaaacagtaaaaaagacagtcatgtgacatctccaatgaaaaagtgctattagagtgaatctaacagcactttgcattactttatacgtattttcctgacgatcatttatgaatgattttaaaatgctttcattgctaaagttgtcaaatgagcgaggtttttagcctggctgtcagaaagtccggactttttaagtgaaagataaagattcttttccacgtcagtccagcttaaggcgacatactcgttcagcattttctttaaaaccggttcgatgtgttcattgaaaacggattcgagttcatttcttattttctttcctgctaatttttcaacaagattgaataattttgttttatttttcagcacttctctgattacatctttgactggttttgacacagatgcatcgctttgtgctttaagtccgtaggaaaattgcgtatcagtctgataaaaaaatgattttgtcgttccagtggcattggcagtattatgatgattttctttagctaaggatgcggggacaaaagcagtagttacaagggctaaagatgcggcaaacagaatgcctttagctgcgtgtctaatgggaaatcctcctttagaaatgtagtgtagagagaaatgaaagactatgtatttaggcgggacctgtatgatccgctttgaacatttttccctctcagataccattctatcaataggtattttttgggtaaataggattttaatacgatatttttctcgcaattcaaaatttttttttggcaggatttattttagctgcagtttcgtgaaatgaacatgggctggagcctgcatgtataggctgattgaggcggaatcacattatcggagcggtttttataatgcaggcttaggtaaaaaaaataaacaggcggcatgcctgtttattttcgtttgcgtgagagagcgaagaaaaacgggaaggcggaaccggccaaaaacgtaccgaataaaaacatgcctccgatgaacacatgatagttcaccccgccgatccaaagccccgtgattaaggaaacgatacttaatgcgatcatcacaaagccgggaatcagacgtttcttacccgttgtccgataagcaaaaagagaacagaagataccgatgacaatcggcacaatccacagataaaaaaggataaatactgacataagcaaaactccgatttttcttctatcataccaaaaacgcccggaaaaagatacgaacggcatccggcgtcaaaagaaaaaccggccgctacggccggtttttttctaacggaatgaatcgtagatcacaaacagattaagcgcgatcaccaaaaccgcaatcagccaggcgagagccgtcacccattttcggttcgtcagggcgcccatcaggcgtttgttgcttgtaaacataatcagcggcacgagcgcaaaggagatgccgaatgaaagaacgacctggctccatacgagcgcttctgtggcgttgacccccgagataatgatgatcatcggcggaatgatggtaatgaaacgccgcaaataaagcgggatacggtaacggatgaagccctgcatgataatatcgcctgacaatgtgccgacagaagagcttgaaagccctgcggccagcagcccgatcccgaagagaatggctgaagccggtccgatatagtggccgaattgctgataagccacgtctaaatcttctacatacagcccgttcttgaagaaaagcgcggcggcgacgatgagcatgcttgcgttaatcgccccggcgatcaccatcgcgatgagaatgtcaatcgtctcgaatctaaaaatctttttccgctcattatccgtttttccgacgacacggcgctgtgtcagtgcggaatgtaagtaaatggcatgcggcatcacggttgcgccgagtatcccggttgccaagagcacactgtccattccgtcaattttcgggataaacagcccttcgagaacagagccggcgtcaggtttggcaaagaaggtctgcagagcgaaggcgatcaccacgacaaacagaagtccggcgatgcccgcttccagcgcccggtaaccccggcgctgcagctctaaaatcgcgaatgatccgatcgccgcgataatggccgcttcaaccatcggtatgccgaacagcaggttgagcccgagcgccgccccgataaattctgccaggtcagttgccataatcaccagttcaccctgtatccacagcccggcggatacccatttcggataccggtctctggcgatttccggaaggtttttacccgtggcaatgccgagcttcgcggaaagaacttggattaaaaaagccatcaagtttgaaaagaggatgacccacagcagcatatacccaaatttcgaaccagctgagatattcgtagcgaagtttcccggatcaatgtaggcaatcgccgcgataaaggctgggcctaagaaaggcagaagccgcttgaatcccttgcttttgccgtcaagtgcatcctgcacggcttttgcttgcagtgattgtgctgagatgtctttgctcattatgtctcacctaaattccgatagatttttagctaaataacaaaaagtttcctagatgcaaattattttatctacatcataaatccgcttttatgagatgtcaagttctttatgttcaataaaccggtacattgatgccctgttttatctatgatatgtatcccgccgaagaaaggtccgaaaatgaaaacggcatcgttccgggaaagaagcgatgccgttcgcaaagcatgtttccgcgtccgatcatgcgcggatgcgttgagcgttcttttaaaaaggtgaaaagagaacacttgctcatatcacttcacaactttctgtccggtgcaactgatcctgagaaaaagacgcagtatttcctccgtttcccgggtaaatagaataataatgtttctttccattggaagataaaacctttctgtaccattcaaatgacctccggaaaaactccggccgctctgaataaacgtttgaatcaacgatatatcagtgattccagtccaataaacggctgttatctatcaaaaaaagaatcggcatggtcacttgcgaagaaaagaagttggagcattagacttatttcagtcttccgggcaaaaaagtataataacgtcaggaaagctttccggccatatgataaaagagggggaattttcttggtacgtcgtttgtcgatcatttctttagccatgatttttgctgtttctttattcgcttttggcggctctgcatcagcagcagctttcaaacctaaagctgaaccggacgtttccattttagccagcgggggcacagtcggtatttacggtgctaatatgcgctcatgctctaaggtcagctgttcaacgatcacaacattctcaagcggtaaaaaaattacaggttcttgggtcaccggagaatatgttcaaggccactacaccaattccaataaatggctgaaagtcacgtatgcaggagcgacaggctacgtttcagtcaccacactatcttattattacggtttataagcagaaaaacctcgttctcttgagagcggggtttttctatattccgattcaatttccgcgtttcgtttcatcatcgtgtttcatcagctgatcgatttcttctttagaagcgttttttttccactctttcgcctgacttgtcgcaatgggaatagcccgtccttcttcataaccctcatctaccatcgcattcgcgatttcgatcgcttttttcttcacaggttcctcgagattcttcaatgattgcggataatccttcatagaccaaggcatgtctatcactcctttatgaaaagtgtttcccgcctgaagaaaaagaaaaccgcctcatcaaaaagaatgacagctatttttacgagagaccagcaatttccgaataaaatataaaggataaagaagcaagtacagattgaatgcccaccacatgagatcaaaatcaccgataaatacccaaaaggcaatcgcttgcaggcctgaacaaaaggtcagcacaagtgatattaatgcgaaatggcgccataacgaatgtttccgtttataaagaaacaagctgtacagcccggtcaatgaaatgaaaatatctaggggaaagaatgaccagttccaggccattatcatggcgttatcataatctttaaacgccatgttttttggaatctactcaaaaaaagtaacaatccaataaatgataaatccaatatctgtaatgaggaagagaacctttaaccctttcatcacctgtttctgtccgtatgaacgctgatgccgtttgatgacgtttcactttcggaaataaagtttaaggaaacgacaccgatgatgatcagaagaacagagacagcttttataacagagaactgttcatgaaagaaaaaaattccgatcgcggaaatcagtacgatccccattcccgaccagaccgcatacgcgatggagacacttatatatttcaaagtcaaagtaagaaaacaaaggctgccgatataaaacaataacaataaaatacttggaacaagttttgtaaatccatttgataatttcatgctgatcgtacccaatacttcaaaaatgatcgctaaacttaaataaatccattgcatacagcattctccttcaatcgtattattcaaaattataaaatatatagaatttgaagaaaattaatcaatggaatgttttccggataaaaagtccggccgggtgtaaaaagaaaacgccataaaggtatactatgtagaaagaaatcagaaaggacgtgcaggacgggtgacagaagagcggacagacctggaaagacaactgagagacattcaaaaatgggaaaaggcgcagcagagggcgatgttctggcaaacattcacccgcttgccgtttcagcttttggacaagctgacaccgcaatttattcagaggaaaatcggactcattctcgatgaaacgggaacgtttattcagtcaggcggacagtaccttacatcagaaaagcgcatcatgaaaaagtttcaaaaacggctgccgcacggtacatgtcaaacgcttcacgacatccgcaatgcgccgcttgccgtcatggacgaaatcgcagaagccatagcgcgtacaagcgtaaaggccgcgacggtgcagggagccgcaacgggagtcggcggcgtgtttacgcttgcggcagacattccggcgatgctcggcctgtccttaaagacgctgcaagatatcgcggttgcttacggctttgatccgaaagacaaaaaagaacgcgtgtttatcgtcaaattgcttcagcttgcatccagtgacgtcatcggaaaaaaagcgatcctgcaagatttacggcaatatgatcaaaacgaccaaacctatcagcgcgtcgcctcgcaaatccaaggctggcgggaagtcgtttacagctaccgcgatacgttcgccgcgaaaaaactgctgcaaatggttccggccgcaggcatcatcttcggcgcgtccgccaaccgttcagctttagaaagcatcgcggaaacaggcatcatgctttataaaaaacgccggattctaaaacgcatgaacgatacagaatgataaaaaaccacccgaaaacacattcaatgtgttttctttgtttatcagttctgaaatcgggaaaccaacaaccaacaccaattaaaggaggaattcaaaaatggcacaagataataacaaaatgagcagagaagaagcaggtaaaaaaggcggagaagctacaagcaataaccatgacaaagaattctatcaggaaattggtcaaaaaggcggagaagccacaagcaaaaatcacgacaaagaattctatcaggaaatcggtgaaaaaggcggagaagccacaagcaaaaatcacgacaaagaattctatcaggaaatcggtgaaaaaggcggagaagccacaagcaataaccatgacaaggaattctatcaggaaatcggccaaaaaggcggagaagctacaagtaaaaatcatgacaaagagttttataaagaaatcggccaaaaaggcggaaacagacgaagcagctaataaaagcataaaaggcagacaacctgcagatcaaaagcgatccggcacatcagccggatcgcttttgattttgggaaaatcttgatctgagccgcaaaaccgatacaataaaatgaaaaaggggtttttcactcgtgtctgacatgctgaatttgctcgctatcgccataaagtcaaagaaaaacacgacaatttttcaatcgcggagatcaatgaccactgtgtgcgcctcgcagtgtttacgggagaatatgactggcaccatcaccctgactcagatgaatggttcatcgttctggaaggtgagctgctgatcgattttaaggacaaagaaaccgcagtgctcaaagcaaatgacagcctgctcatcccgaaaggcacgattcaccgcacccgctcttacgtcagaaccgtgaatctctgtgtcgagcatacgcatgcgaaaacagtcatcacagaggaacggtcatgctgatcaaaaagattgtatgtgaaacagacgctgcaaacgctgaagcatttgcgcaagcacagtcaaggtggggagcattatcatgtgtaaatggcttcgtcagacaggcaggcggctggcggaaaaacgcagacggcctgttcatcgcagagatcatcagcgtttgggaggacagacaggcctatgatgattttatggagaacgaacatgaccgcatatacgaagaaaacgagcagaaggctgcgattctttcaatagaagtgatgctgtacgagggggatgaacctgtcattcacgagctgttacatcaccccgacatccggtacgaaccggactggacagttgtgcgcacataaaaaaagcccctttagaggcttttttattttcgtccgggaagcgtgttgtggacatacggcgggacggggtccagcttagctatttcgccgtgcgctttcggttccttttcgtattcaaatggttctccgtccggcgctgtttccttcagccaattttgttcagcgctttctgctccatctgagaaatgaataagcttatgggagaatgactgtttttccagcgccttcgggaatgtggaaggaacgatcggaccttcctgttcttctaattctttaatggccgcaagccattggttttgatgcatggtatcgcgggccaataaaaagctgagcatatctttcacgcctttatcatcggtcatttcatacaggcgtgcgacttgaagccttccttgtgattcggcgttcagattggcgcggaagtctgccagaaggtttccgcttgcgacgatatagcctgcgctccacggaacgcccgtgctgctctccggcattgcgccgagtcctgagacaatggcatgatgcgggttcatcccgcctaaaatggacccgatgaccggatcatcagccgctttttcctgctctgccagcggggcgtcttctaacagtctcgcaatcatcgtcgcgatcatttcgacatggccgatttcttccgtcgcggtatccatcagaagatccttatatttttcattgcctcgtgtattccatccttggaacaaatattgcatggcgacggatatttccccgtattgtccccctaaaatttcctgcatcttttttgcgaacagcgggtcaggacgatccggtttagccggatgctgcagttttttcgtatgtgtaaacatgtctccatctccttttttgctctgtccctatttacttccccggcgggaaaagggatgaaacggagatgggcgtattggtcctgctaaggctcgcggcgcaaggataacaaatcctgcacaagcccgcggccgatcacctgttcatattgtccgtaaatcgggtcgaggcgtttcatccatgtgttcttttccgctttgctcagcacatgaatatgaatggatgaattcttctttatctcttcaagctggtctttattcattttctcagcggaggcttcgttccattccgtcgtttctctcatcgcctccgttaagatggttctcgttttttctgtctgtgaattccagaaatgctcgtcggtcatcacggcataaccgaggtacccgtgattgctgattgtcaaataatcttgaacattataaaattttttagaatagatatttgaaatcgtattttcctctccgtctacgagattgctttccaagagctgaaacgtggaattaaaggaatcctgccgcgggtgcgcgctgagcaggcggtactggtcttcgatcacgctgctcggcatgatcctgagcgcctgtcctttcaaatcgtccggagagaagatcggccctttatttgacgtgagctgcttaaacccgttcgtccagtacgccagtcctttcaaatgatgcttttctaaagaagcgaacaggcgcgtgccgattttgccgttgaggccttcttgcacggctttatagtttgtaaacgcgtacggcagatccaaaacaccccattcgggagacagtgatccgagctttgaggtggagggagcgatgaattgcacgtccccgttttggagggcgtttatttcttcattatctgaatagaggctcccgtttggaaatacctctactttaatggtaccgccggacttttgatagaccaggtcggcaaatttattcgccgcccgccctttaggtgtgttttcagccacgacatgactgaatttgaaaaccatttgatctttcaggccttcctgttcgtcatcataatacggttcttctgttgagaaacgatcatgaaagccgatgaataaagcggttccgataccgagtaccatcaggctgagacaagtcagcaagcttttcatcgaaaaccccctccgccattttctataacaagcataatcgggcgggccgttttcgtaaagagacggaaaggaagaggccaatgacgaaaaaaaagcttaccatccgctggaaaatcaccatactttcttatatcgtcgtgctttttacctttttgatcgtcggcatcgtgctggtcggcaatatccagcatacagaggagcgcgagctgaaaaaacggctgatgaataccgcgcggacggtatctgagatgaccgatgtcaaacgcgccctggagcagaaaaaacaaagggaagacgtgcgccatgcggtcgaagaaataaggatcatcaatgaagcggactacatcgtcgtcatggatatggatcatatccgctattcacatcccgtcagcacaatgatcggaaagcgttcaaggggtgaggacgaagccgcggcgttcgccgagcacatttatttttccgaagcaaagggagagatcggcaccgccgtccgcgctttttatcccatcaaagaccgggatttgaatcagatcggcgtcgtccttgccggtaaaacgctgcccggattcggtgaaattcttcttcagctgaaacatgaaatactgtttatcgttctgctggcgctcgggttcggactggccggctcctttttgctggcccgccacatcaaaaaacaaatgttttggctcgagccccatgagatcgtgagaatgtatgaggaacggaccgctacgtttcactcgatgaatgagggcgtcattgcgatcgataatcagcatcacatcaccatttttaatgaaaaagcgaagcagatattcaatgtcagacaagagaccgacggcaggctgatctgggacgtgttaaaagattcgcggctccctgaaatcgtcgagcggaaccgagccgtatataatgaagaaatccaagtcagcggaaaggtgatcatgagcagcagaattccgattgtcatgaaaaagaaggtcatcggagccgtcgccatttttcaggacaggacggaagcggcgaaaatggcggaagaactgacaggtgtgaaaaattttgtcgatgcgctcagagtccaaaatcatgaacatatgaacaagcttcacaccatcgcggggctgattcagctcggaaaatcagaaaaagcgctccggcttgcttttaaggaatcatcagaacaagaaagcgtcactgattttcttcatcaggccattcagaatgacgccgcggcggggctgctgttaagcaaaatcaaaagaggaaaagagcttggcatttctgtgaaaattgatgaaaacagcagtttctcggcatttccggagcatgtcgaccagcatgacatcgtcgtcctgctcggcaatttaattgaaaatgcgttcggcgcattcgaaacagcggacacggaggacaaacatattgacatcagtatcgagcaaaatgatgaagtgcttgctatattaatagaagacaacggaagcgggatttccgatcagcatatcccgcgcctttatgacaaagggtttaccgtcaataaaacgggaggaacgggatacggcttgtacctcgtcaaacaaatcgtcgacaaagggatgggcgtgattgaagtcgacacacggcagggacagggaacggcattttctatattatttccgatgaagggggaggaatcattcgatggacatcaaggtgctgcttattgaagatgatccgatggtgcaggaggtgaataaagaatttatcaccggtgtttcagggttcagcgtcatcgccacggccgctgacggagacgagggaatcaggcttataaaagatctgcggcccgggctcgtggtattagacgtatacatgccgaaaaaagacggaattaaaacgctccaggaaatcagaaaacaaaagctcgaagtggacgtcatcatcgtctcggccgcaaaagacaaagaaacaatccagcttatgctgcaaaacggtgcggccgactatattttgaagccgtttaagctggagcggatgagacaggcgctcgaaaactataaacaatataaacggaaaattgaagagcatgacacgatgtcgcaagagcagcttgacatgctgctgaaaattccgcaaaatccgtcccgggatctgccgaaggggttaaaccattttacgatgaatgaaattttgacctatatgaaacagcagacggagccgctttcagctgaagaagccgccaaagcgctcggaatcgcaagggtgacggcgcggcgttatcttgattttcttgagaaggacggccagattaagctcgacattcaatacgggggagtgggacggccggttaaccgctacaaattcgtccgctagccgagaccaaaaagaccaaaatgtccgttatgatcataagcttcccctcttcgtatgaaaacgctatcatctttgtatagacgcatcgagaggcaaggggagtagggatgaaaattttcaaaaatcttacggtgcaggtcatcacggcggtgatcatcggcgtcattgtcggactcgtttggcctgaggccgggaagcagatgaagccgctcggcgatacatttatcaatgcggtaaaaatgattatcgcaccgatcatattcctgacgatcgtgcttggcatcgccaagatgggagacatgaaaaaagtcggcaaagtcgggggaaaagcatttatttattttgaagtcgtgaccaccatcgcccttattatcgggcttctggtcgtcaatatcatgaaacccggtgagggccttgattacagcaagcttgaaaaaggggatgtctctcagtacacccaaaacgggggacaggggattgactggattgaatttatcactcacatcgttccgtcaaatatggttgacgctttcgcaaaaggcgacattcttcaggtcttattcttttctgttttattcggtgtcggcctggcggcgctcggtgaaagaggcaaaagcattattgatttctttgataaactgtcgcacgtttttttcaaaatcatcggctacatcatgcgcgcggcgccgatcggcgcattcggggccatggcctatacgatcgggcacttcggccttgattccatcaagccgctggcgagtctgatgctgtctgtatacgttacgatgttcctgtttgtatttgtcgctttgaatatcatttgcaaactattcggtttcagcttgtggaactatctccgttttattaaagatgaactgctcatcgttctcggcacaagctcttctgagtccgtccttccgcggatgatggataaaatggaacgttacggctgttccaaatcggttgtcggccttgtcattccgacgggatattcttttaacctggacggcacctcgatctatctgtccatggcgacggtttttctggcgcaggtgttcggcgttgatcttaccatcggccagcaggttacgatcattctcgtgctgatgctgacatcaaaaggcgcggcgggtgtaaccggaagcggatttatcgtgctcgcctccactttatcggcgcttcaggttattccgctggagggactggcgctgctcctcggcgttgaccgctttatgagtgaaggaagggcgatcgtcaacctgatcggaaacggaatcgccaccatcatcgtagccaagagcgaaaatgagtttgacgaagcgaaaagcacacaggccgtaaaagaaataaaaacggcggtataaaaggaaaggaacggcatgcatccggcatgccgttctttttttcggccgccatgagtaaaaaagataaatttgtttaaatttattaggaggtggacaaagaccttagcgtcattttgttatataatttacaattagagagtgaaagatgaaatctaagggctttttgtcctagcaggagtgtataaatggcggctatttttaaattttttcagcatccgggtgtcagacgtttttccgtttttcttgttttgactggggtgttagttgtattccgaagtatgattaatttgattttgcttacgtttatttttacttttctgatggatcggctggagactgtcatccggcacgtgttgaaccattttttccggatcagccagagggtggtcatcaccattttatatattgcgctggctgtcggggcgactgtcggaggctttgtcttttacccgattgttgccaagcagattgaacagctgattaagcagatcaagcacatcgcgtatcatcccgatgtcattccgttttatgatgagatatcgagcgtgttcggcgatatcaatatcggttcctatgtaaaagaaggttttaatgtactgtatacatacttggccgatatcagcactttcggtttgcaggtcgtgatgtcactgattctcagcatgtttttcctgttcgagaaaaagcggctcacggagtttatgaaaaaatttcagcacagcaagctgtctgttttttactacgaacttgcttatttcggcagcaaatttgcgagaacattcggcaaagtgcttgaagcccaatttattatcgcgctggtgaactgtatcctcaccttgatcgcattggcgattctgcattttccgcagctgttcggcctgtccatcatggtctttttcctcgggctcattcccgtggcgggtgtggtgatttcgctcattccgctcagcatcatcgcgtatacgacgggcggcgctgcgtacgtcatctacatcgtgctggtcattttcgtcattcatgcgattgagacgtacttccttaatccgaaactgatgtcagcaaaaacggaactgccgatcttttttacctttacggttctgattttctcagaacatttcttcggcatttggggcttgattatcggaattccgatttttgtgttcctgcttgatattctggatgtcgtcaataatgaggagaaggaaaaaaacggaccggtcccggataagacataacgacggctccggctcttcacgaatatatgactaatgttataatgcagacagtgcctatgtacgggcactgtttattttttgtgaaaaaggaggaaggctgtatgactgagccgattttacatattgaaggccttgacaaaacaataggcaaaaagcacattttaaaaaacatcagcatggatgtcaggcagggcgagatcatcggtttgctcggtccgaacgggtcgggaaaaaccacacttatccgaatcatcgtcggccttttaaagaaaaacagcggcacgattacaattaacggctttcagcacgatgctgatttcgaaaaagcgcttgaatccgtcggagcgatcgtggaaaatcctgaattctacccgtacctgacggggtgggaaaatctgaagcactttgccaacatgcacaaaaacatcacagaagacaggcttcaggaagtcatcgagcgggtcgggctcacaaatgccgttcatgacaaagttaaaacgtattcccttggcatgcgtcagcgtctcgggattgcacaggccattcttcaccgtccgaatctgctcattttagatgaaccgacaaacgggcttgatcccggcggaatgaaggatttccgcgatcacttaaaggaactcgcggagcttgaagggacgagcatcctttttgcgacgcatttattgcgtgaagtggaggacctttgcgaccgtgtcatcatcattcaaaaaggtgagatcaaaacagaggttgttctgcgcggcgctgcggaaaaagaagaaaaagccatcctcgacattcagccggctgacgaagccttcgaatggctgtcccagcagcaattcgttccggagaaaaacggcgggagcattaccgtcaccgtagcgaagaaggacatcccggcattaaaccgtgcgctcgtcggacaagactttctcgtgtattccatcatgccgtatgcggaatcgctggaggatgaattcatgaaagtgacgacggcgcttcaagaggaggggaagacgaatgtttaaattgacagcgaatgagcatatgaaactctttaaccgaaaagtctcattagtggcgctgattctgatggccgttctccaatttattatggcgcttgtcattaaacggcttgtcatcagttccggaacggatgagaatttcatcggctatatggcgtacgcccccgggctgaatattctgcttgaggcattaacgatcgtgatcgcggcaacgatcatttccgctgaatttgataagaaaacgatcaaatttttgttaatccgcccggtaaagcgggagcggatttttgtatctaaactcattaccgtatttttggtcagcttgtacctgtatgcggcgtactatattctgtctctgctgttcggcatggctttcttcggagtgtcggtgacatctgaatcagggacgcttcttgtgaacaccctgaaagtaatcggcacgaactgggtcgaggcgtttgcgatggcatgctttggcttgttgtgttcttctgtattccgaaacagcgcaacggccgtcattttgtcatttatcgtgctgtacggcgcaaaatcacttgtgacgattatgtcgctcttccaaaacaaatggggtagttttctgctgttcgcaaatactgacctgacgcaatatatgagcggggcgaagccgctgtttgcgggaatgacgccgttattttccgcaggcattatcattatccatatcgtattcttcttagccgtcgcttggtggagcttttgcaaacgcgatattcgggtataaagtaaaggaatgacatttttgtgaaaaagatcacgataaatcaataatttatgctattttgatttataataaaggtaatgacggaggtgctcacttgagaaattttattaccgcattaccgattgtgttattgcttggtttttcctttgtgtcattcatgtttcaattcgaacatcttgtttatttcaggcttgcgctgggtttgttttctacagtggggctgtttctcttatataaaatgaagacgggattccgttatttcatcatctacctgtatgcaagctggatcgtgcttgcggcggttaccgcgtttgaagagccgattttttcaagctttttctttggcgggcttgtgatgacgatgggttatctcacatatatgctgatttatctcgggctcaagcaggaccgcggcccggaagcagtctgaacgcgctattctatggaatagcgcgtttttttgtacagcctcacagttgcgaaacgagacttgaatctctataatacttattaactttatcggaattataatggggggattccagtgtctttatggatacagaatgaacggcagcgggaatggatggaaaaaatcggcctgcttgcagacgaatttcaaaaaacagccgcgcttgatgatgaggcgggccgttttcccgcggagaaaattcaaagactgcgcgacgcgggatatacggcgttaacggtacctgaggcattcggcggtgcaggcatttccgtttatgagatggtgctgtttcaggaacggctggcgcggggagacgcggccgtcgctctcggaatcggctggcatttatccgtcatgggtgagctcggagaaggaaacagctgggatgaaggtgtcttttcatttatcacaaaagaggtgaaaaagggagccgtcctgaacagggcagcgacggaacggcagaccggcagtccgacgaggggaggaagacccggcacttccgctgtcaaaaaagacggaaaatgggtgctgaacggccgaaaaacctttacaaccctttcactgactttggattatatgcttgtgacggcatggattgaagaaaaacaaacgaccggtgtttttctcattcataaagatcaggcaggcgtttcagtcgaagaaacatgggatatgattgccatgaaggcgaccggaagccatgatctccttttagatcatgtcacggtcagtgacgagcggcttgtggagcttatcagcgggccgagagcggcgaaagtgaatggctggctgcttcacattcccgctgcttatctgggcatcgctcaagcggcaagggactatgccgtccggtttgcatctgaatattcgccgaacagcctgaacggaccgattaaagacgtgccggccgttcagcagcgtgtcggggaaatggagcttgaattgttaaaagcgagacagtttctcttcacggcggcgcaaatgtatgatgatccgaaacgccgccctttcatcaaaagcgagctcggcgcggcaaaacatattgtgacaaatgccgtcctttctgttgttgacaaagcaatgagaatcaccggcgcaaaaagcctggagcgaaataatccgcttcagcggtattatcgggatgcccgggccggccttcacaatccgccgatggacgatgcggtcatcggcaaattagcggcggaagcctttgagcaataaaaaaaagagcctgaaaaaggctctttttatgtatggctgttgtgccggagcagtttttgatgcttgcggtcaattctgtcatagatcacattcatcagcttttgattattcataatggccgccttgttttcttttatcagctgttcgtatgtttttattttacgtttcgccatgagcccgcaccttccttacatatttgtattcgctttctaattctccgagcgataattcatataaatgccgttccgactttttgtatattccgttattgatcagcaaatggatcagatgtttttttcgtccttcaactgatgatctgagctgaggagaagacctcatgattaccctcctaatcaattgatattgagaatcattatcagttaatgaaattatacaatggacatattcatatgtaaaggaaaaataccgccaatttttcgacaaatagtttcccggggaataatgctgtcgaatattgcatttggtcagatcaaagctgctatttttccgcttttccatccatactatgaatgagaatggaggagtccttacatgaatgatcaaacggcaaacttaaaacggggcgaaaaaggcgcgattcttaatatcgccgcgtaccttatccttgccgccgtcaaactggtgatcggtcttatttatcattccgaagcgctcagtgcggacgggttaaataatgctacggatattgtcgcatcactggctgtgctgatcgggctccggatttcccagcgccccgcggacagtgatcatgcctacggacattatcgggctgaaacaatttcttcattaattgcgtcttttattatgatggcggtcggtattgaagtgctgatcggaggagcaaaggcgattgtcagcggaacggaggccgagccgagcttcattgcggcatggacggcgctaggaagcgcgattgtcatgtacggcatgtatgtatataacagccgtcttgcggatcgggttaaaagttctgcgcttcatgcggcggcgaaagacagccgttctgacgcctatgtcagtattggggcgttgataggcgtcttaacggcccggcttcatctgccgtggattgatccggtcattgcttttctgatcggaattatcatctgtaagacggcatgggacatcttcaaagatgcttcccactcattaacggacgggtttgatctgaaagatttggagccgtataaacacacagtgaaagaaataaaagaggtcagcaggctgaaggatgtgaaagcaaggtatttggggagcacggttcatgtggaaatggtcattacggtagatccgggactgtctgtgaaagaaggccatgaagtagccgatgaagtcgaatatgcaataaaacatgaacatgatgtgactcatgtccatgttcatgtagagcctgaagtcataaacaaagatcgtgaaacgaattaaatatgctgtgataaaaactctgtgacttcttcgggcgttttcgcgtttgcgctgtgaagatgcgctttcttttcgccgtttttaaagatcagaaggctcggtatgcccattacctgatatttgtcggcaagctcagggagctcgtctctgttcagctcataccaatcattttgattatattcttccaaaatatcgccgatgaacatattcatgcgcgtgcagtcagggcaccaatcagcgaaaaatttcacgatgatttccttgtcggattgaataagttcattaaattgttctgttgtactgatttttttcatatgacacatctccttttccatgccattttaatataaaataaaaaggaattacatacaaatgctttcatattcagaatgcccaaaaataattagatcattttctgaggaaagtgataagatagtaaagatgaattgttgtggggggaatatccattgaaaacaagtctaggattggtgtacggcggaaagtcagccgaacacaatgtatcgctgcagacagcattagctgtaacaaaagcgcttaatactgagaagtttgatatacatccgatttacatcactgaaaaaggagaatggcaaagaggcccgctgctgactgagccggtttccaacgtgaaaatgcttcagctggaacaaaacggtgaaagtttcgctctatcagcattgaaccgggaaatgtttcctgaagcgtcgcctgacgaaaaggcgcagatcgatgtcgtatttccgcttctgcacggaccgaacggtgaagacggcaccattcagggactgctggaattgctgaacgttccttatgtcggcaacggagtgcttgcatcatcagccggcatggataaagtcatcatgaagcatttgttcgctcaagcggggcttccgcaggcgaagtacgccgctttcttaaaaaaggactggaaacagacgccggacagctgcttacagcaggttgaagaggagctgggatatccgtgcttcgtcaaaccggcgaacctcgggtcaagcgtcggaatcagcaaatgccgaaatcgcgaagagcttgaaaaagccttcgaactggcttttgagtatgaccggaaaattgtggtggaagaaggaatcgccggcagagaaatcgaaatcggcgtactcggaaatgacgaaccgaaatgttccgccgtcggtgaaatcacgccgaaaaccgacttttacgattacaaagcgaaatatgaagacggcgacacggatttaatgattcccgcgcaagtgacggatgaacaatatgcggaaatcagcgagatggcgattaaagccttcaaagcgattgacggatcaggccttgtccgcgccgatttcttcctgaccaatgacggtcaagtgctcattaacgaagtgaacacaatgccgggctttacgccattcagcatgttcccgctgctttggaaagaagcaggcgtagattacagtgatctgatcgaacagctggttgagctggcaaaagaacgccatgccgaaaaacagctgattaaacatacattttaatgaagacggacactgcctgaaggggcagtgtcttttcccgtaacagacaacattttcagaaagcgaggtgccacctttgataaagcgaactgtaaaacgaatcgccgacatggtcaaaggcacactgacaaatcctgtatttgaacaaacaatgattgagggcgccgcaaccgatacgcggactttggaaaaaaatcagctgttcattcctttaaaaggcgagcattttaacggccatacctttgtgccgcaagcattcgaaaaaggcgtttccgcggtgttgtgggaccgctctgaaccgaatccgccggaagagcgtgccgtcatccttgtcgatgacacgctggaggcgctgcagacattggcgaaagcttatttgaaagaactcggcacacgggtcatcggggtgaccgggagcaacggaaaaacgacaacgaaagacatgcttcacgccgttctcagcactcagtaccgtgttcacaaaaccgccggcaatttcaacaaccatatcggcctgccgctgaccgtgcttgccatgcctgaagatacagaaatcgccgttttagaaatgggaatgagcgcgagaggcgaaattgattttctgagccgtcttgctgaaccggaagctgccgtcattaccaatatcggcgaatcccacatgcaggatttaggctcaagagaaggaattgcggaggcgaaacttgaaattataaacggacttcgggaagacggcgttctgttttatttcggggatgagccgttgctccgcgaaaaggcgtacacttgccggacaacgacatacggcgcaggcgctgtcaatgatctccgcctgaaagaaataaaacaggcggaagaaggcacgtacttcaatatcgacgggatcgaacgttctttctttattccggttctcggcagacataatgtgatgaatgccatggccgcatacgccgccggcatctatttcggcattacgccggaaaatgccgctctgggactgagccgcctgaaggtgacggggatgagattggaactggttaaaacggaaaacggcatctcgatcgtaaacgacgcgtataatgcgagcccgacgtcaatgaaagcggcggtcgaattaatcgaaacgatgaaaggctatcggaagaaaatgctcgtgctcggtgatatgcttgaactcggtgatgaagaaaaagcattccacgaagaatgcggagctgcgatcaatccggcggaaattgaccatgtatttacttacggcacactcggcgcattcatcgcagacggagcgcgccggcattttgaagaagggcgcgtcagccattatctcgacaaaaaagaactgcttcacgccatacaggatatggccgcttccggcgatctccttctgtttaaagcatcgagaggtatgaagctcgaagaaatcgttaaagatttattagagaagaactgaaaaaatactgatcagcattataaaaatatacaaaaatgaagaaactaattcagggtgaaataattctgtccgtatgaaaaagaaaggccgccggctgggaaatcccgtccggcgcggggtccggcctcgtttgcgggaagaatccggtcaggccgcttccggccgcctgaccatctcgccttattgaaaaacacatagtgtaatggtaagattaaacgtaaagtaattcgggctttgtatacgtatgatcctgtcctttggatgaaagggcagtttttagtggtaaatcacgacattactgaaacagcaatcagaaggagtttgaataatttgactataacgtttcaagatttccaattaagttctgatctcatgaaatcaatcaatcgtatgggatttgaagaagcaacaccgattcaggcacaaacgattccgctcggacttttaaataaagatgtcatcggacaagcgcaaacaggtacaggtaaaacagctgcgttcggtataccccttgttgaaaaaatgaaccccgagtctcctaatattcaagcaatcgtaatcgcgccaacccgtgaattagccattcaagtatctgaagagttatataaaatcggacaagataagcgtgcgaaagtgctgcctatttacggcggtcaggatatcggacgtcagatccgcgcattgaagaaaaacccgcatatcattgtaggtacgccggggcgtcttcttgaccatatcaaccgccgcacgatccgtttaaacaacgtgaacacggttgtcatggacgaggctgatgaaatgctgaacatgggattcattgatgatattgaatccattctctcaaacgtgccgagcgaccaccaaacgctcttattctcagcaacaatgcctgcgccgatcaaacggatcgcagagcgtttcatgactgagccggaacacgtaaaagtaaaagcgaaagaaatgactgtgtccaacattcagcagttctacttggaagtgcaggagcgcaaaaaattcgatacgctgactcgtcttcttgacattcagtctccggaacttgcgattgtattcggccgtacaaaacgccgtgttgacgaattgacggaagcgctgaaccttcgcggatatgcggctgaaggaattcacggcgacttaacgcaggcgaagcgtatggtagcgctccgcaagtttaaagaaggtgcgatcgaagtgcttgtagcgactgacgttgctgcccgcggacttgatatctcaggtgttacccacgtatacaactttgacgtgcctcaagatcctgaaagttacgttcaccgtatcggaagaacgggacgcgcaggaaaaacgggtatggcgatgacgtttatcacaccgcgtgagaaaaacatgcttcgcgcgatcgaacaaacgacaaaacgcaaaatggaccgcatgaaagagccgacgcttgacgaagcattagaaggtcagcagcaggtgacggttgaccgtctgcgcacggcgatcagcgaaaacaacctgaacttctacatgacggcagctgcggaattgttagaagatcatgatgcagtgacagttgtggctgcagccattaaaatggcgacaaaagagccggacagcacgcctgtacgcctcactgatgaagcgccgatggtcagcaaacgctataaaaaccagcgtacttctaagcgcagagacggccaaggcggcggctaccgcggcggcaaagggaaaaacaacaaccgttcttcctacgataaaaaacgctcaagcgaccgccgttcttcaggtgacagacgccagaaaaaatcatactaaaacacaggaagcggaccctttttcggggtccgctttttttcgatatgccggaaagtgaatcttttttgcaaatcagccgtatttgtatgtatgataaaaaatgggaggtaggtatgttgagagcacagccaaaaaatcgaatcagtccaagcggcttaaaagtctggcgtcttcaggaaatcatcctgtccgccttctgtcttctggccgttatagcagcagctgttttaagccatttcttccattggccgtattggatcaccggagtcctcggcatcatttgggtcatcggttcagtgatatccgtctatgccataccgaaaatcaggcacaggatctggcgctatgaggtccatgaaaatgaaattgatattcaatccggcatttttatagtcaaacgggtcattgtgccgatggtgagggtgcagcacgtagatacttcacaaggcccgctcctcagaaggtaccgcctggcctcagtcaaaatctctacggcggcaaccgttcattccattccggcgcttgatatggaggaagctgaccggctgagggattccatttcccgtctggcaagggtgacggaagatgatgtctgaaccgaaacgtctgcacccggcggccgtgattttgaacttattccatattattatcgaaaccattaaaaacattattctgccattttttctcgtctatattgttaattccaaccacttcatccgcttttacggaggcattgcgctcgctgtcctgcttatctggctgattacggcaagtgtgatcgagtggagaaaatttacataccggattgaggacggagaattcagaattgaagaaggcttgttttttacgaaaaagagatacatctccattgaccggattcaatcaatgaatacgagtgccggcatcgttcagcagctttttaagcttgttaagcttcaaatcgaaacggccggcgacgggaaaaacgccgaggccgtcttatccgccattactgtggaagaggcggaacggatcagagcggctgtttttcagcaaaaagcggagcaagaagaacgaggggagaccgcagcggagcaggagccgatgcgcggggaagatgtgcaatccgtttaccgcctgtctgtgggtgagctgcttatggccgcctcaacatccggggggatcggtgtcatcatctcagcggtattcgccctcttttctcagcttgatgaagtacttccgatggactggttctacgacaggttttcttttctcaagcatgcgagcatcggcatatacgccgtgatcatttttataggattgttcatcgcctggctgttaagcatcgccggtatgatgatcaagcatgccaactttaagatagaaaaaaaggaacacgaattggtcattacgagaggaattattgaaaaacatcaagtgaccatcccgctccgtaaaatccaagccattaaaattaaagaaaatgtgatcaggcagttattcggatacgcgacggttgcgattgtcagcgccggcagtgcggggaatgagaaagaaggagctcagacgattctgtttccgatcatccgcaaatcaaagctcggtgtgatgctgaacggtttcacaccggattacgtactggaagaaaataggaatcatttgccgaaaagggcgctgcgccggtatttattccgctccgttatcttctcggttttcgtgatcattccgctttgtattctgtttaaaccgtgggggtatgcatcgctccttgtgcttcccgtcgaactggtgctgggctacgcctcatttaagagcgcgtcatggtgcttaaacggaggccggctgcagctcaccacacggctgatcgggaagacgaccacgattatgctgagaagaagaatgcagatgtttgaagtcagccgctcctttctgcaaaaaagaaggcggctcgcatctgtggctaccgcagtgaaatcagctcaccacatggagcatgtcatgctgaaggatgtcagcgaggaagatgccgaacgcatcgggcgctggtattcatatgaaaaagcggacggttaataccgccgctttttttgctgcacgcataaaaaggaaagcaaaaatccgcctgccagtccgaacaaatgcgccataatgttaatattagaattgataaacgtcgacagtaccgcgatgataagcagggtcataatcattttcgactggtcccggccgatcagctccttgcggaaaacagtcagaaacacatacacgccgaaaagtccgaaaatcgcgccggatgcgccgacatgcacataatcaagcggttcggcaagatatgtgccgatattgccgataatgcccgatgcgatgtacacaatcaaaaaacggacttttccgagcatctgctccagcgggggcgcgaataaaaagagagacatggagttaaacaaaaggtgagtgaaattcgcatgtaaaaacatcggtgtcaccagccgccaccattctcccgaggaaacgccgtaattatagccggtcactgcatctgaccacatcatgacggaatgaagcggcatactgaaaaacagccacaagaacgcctgcagcgccaagatacagctgacggccggataacgtctgataaaagtctggaaattttccgtacgtataaacatcgcaagcccctttgcatctgatttgttacatatatagtaacacgtttatgacataaaccgttttttagtacggacttttaggaggaattcacatgattttcggaatcggaatcgacatcgttgaactgcacagaattgaaaacatgctcagccggcaggcgaggtttccgcaaagaatattgacggaggctgaatacgcccgttttacattgctgtcggacaaaaggaaaattgaatttctcgcgggaagatttgcggcaaaagaagccttttcgaaagcatacggaacgggtatcggcaaagagctcagctttcaggatatcgaaaccggaaacgacacggcgggcaagccggtgctgacctgcgccaagctggacggcgcggcggttcacgtctccattacccatacaaaagaatacgccgcggcacaggtcgtgattgaaaggttgtcacgctagtctgcatattagccgaaaccccttcatatatttgatagtgcattaagggagacaagttgtttgaggcttttatggtacgcgtccgtccgttcagggcgtaccgttaaagtcaaacaagcgatttcttccctttacatcaattgagaagaaggggttgaaaaaaggtgagaaaaagctttgttttgcttttaacgggactgcttgccgtccttattctttcggcctgcggccaaaaatcacaggaagatatcgtgaacggtttagataagaaggcgaaagaatacacctcgtacaaagcgaaagccaaaatgaccattcagacggggagtgatccgcaagtatacaatgtggaaatctggcataaaaaaccttccctgtaccgggtctatctggaaaatccgaaaaaagaccaaaaccaagtcattttacggaacgccaacggagtctttgtccttacgccgtctttaaataagagcttcaggttccaaagcgactggccgaataacagcagccaagtatatttgtttgagtcacttgtaaaggacgtgcagcatgacaaagacgccgtctattccgccaaagataaaaagtacacgtttgaaacaaaaacaaactatcagcacaacaaaatgctgccgactcaggaaatcactttcaacaaaaaggacatgagcccttcgctcgtcaaagtcatggatacagaccggaaagtgatggtaaaagtcgaattcaaaagctttgaattcaacaagccgtttgataaagactcttttgacgagaagaaaaatatgacgctttcccagatggacgtcgccacaagcgccaagccgtctgattcatttgcggtcaaaacaccgcttcaagtgccggccggcgtcaaaaagcttgaagagaaagatatttcaacggcggacggcaaacggatcgtcatgacttacggcggagaaaaatccttcacccttattcaagaaaaagcccatatcgcaaaagccgcctctgccgtcacgctgaaaggcgaaccggttaatctcggcttcacggtggccgcattatctgatacgtctttaacgtggacatatgacggagtggattatcttctgtcatcacaggatctgacaaaggatgaaatggtggccgccgccaaaagcatgcagggacagtcgtcaaaataatgtcaaaaaagaggccgccgctgtcggtctcttttttgattccatttcactttgcagaataattttagtatgataataacaatatgaattgaaaataatgctaggaagtgtatcgaatgaacacagcatccttttacagagaaacgtgggcggaaatcaacctgtccgcgattaaagaaaatgtcacgcatatgaaaaaacacatcgggcaaaacgtccatctcatggcggttgtaaaggcgaacgcttacggccacggagatttggaagttgggaaagccgcgcttgaagcgggtgcctcttgtcttgccgtagccatactggatgaagcgatttcattgagaaaacggggcattacagcgccgattcttgtgcttggcgccgtgccgcccgaatatgtacaagcagctgccgaatatgacgtaacactcacgggatattctgttgaatggcttcaggaagctgcgcgccacctcggaggtgccacattgccgtttcatctgaaagtcgataccggcatgaacagactcggagtcaaaacggaggaagaaatccaaagcgtgttaaaaatcctcagccaaaatcccggtttagtctgtaaaggcgttttcacccactttgctaccgcggatgagaaaaacagagattatttcctcttccagtttgaccgctttaaaacattgatcgctccgctccctttaaaagaattgatggtgcactgcgcgaacagcgccgccggacttcgccttaaaaaaggcttctttaacgcggttcgtttcggcatcagtatgtacgggcttcgtccttctgctgacatccaaagcgaaattccgtttcaattaaagccggcttttgcgctgcactctgtgttatcccatgtgaaaaagatccgcaaaggggaaagcgtcagctacggcgcaacatatacggcagagaaggatcaatggatcggaacggttcccatcggctatgcagacgggtggctccgcaagctgagcggcacgtctgtgctgatcggcggcaaacggatgaacatcgcgggaagaatctgcatggatcaattgatggtcgaattagatcaatcttatccgccgggcaccaaagtcaccctgatcggcagccagaaggaagaaacgatcacgatggatgaaatcgcagggcggcttgagacgattaattacgaggtcccttgtaccattagttcccgcgttccccgtatgtttttggaaaatgagagtataatggaagtaagaaatcctttactgcaagataatacaaacaagtagccgtcatccggaaaaagagaatttataaaacagctttgcttgacgtttgaataatggtatcattatgtctggatggatgaattggtcgtatccgtaagtttggtggaggtgtatgttttttgtctgaatccagcgcaagaaccgaaatgaaaatcagcttgcccgaaaacttagtagctgaattggatggtgtagcgatgcgggagaaacgaagcagaaacgaactgatatcacaagcagtgagagcgtatgtcagcgaacggacaactcgccataaccgtgatttgatgagacgcgggtatatggaaatggcgaaaatcaacttgaatatctcttctgaggctcactatgctgagtgcgaagcagaaacgaccgttgagcgcttagtcagcggaggataatcattttgattgtaaagcgcggcgatgtttattttgctgatttatctcctgttgttggctcagagcaaggcggcgtacgcccggttttagtgatccagaatgatatcggaaatcgctttagcccgactgctattgttgcagccataacagcccaaatacagaaagcgaaattaccaacccacgtcgaaattgatgcaaaacgctacggttttgaaagagattccgttattttgctggagcaaattcggacgattgacaagcaaagattaacggataaaataactcatctggatgatgaaatgatggataaggttgatgaagccctgcaaatcagtttggcactcattgatttttagtcatattttggttgctcatatagagcaactttttttgttttcgaaaaacataagcgctataataaagaaataatcaaacaaaatttgttgttttgtgtcgggaggtcagtgaaacccatgtcgaatcagaaagtgtatcagttcattattgatcagcatgatgaactgcttgatacttggacagccaaactaaaagaagtaggcaatcaggaagactatcagcttacgaatcacatatgtgaaaatatttgtaaagattatatagacattcttttattatcgacaaaaaatgacgaggctgccgaagagcagatcagtgaactcgcactgcgcgccgttcagctcggcctgtcgctgaaacttctttcagccaccctgtcagagttttggaaactgctttacgaaacgatggtcgaccttaatatggccgatcaggacagagcagatttgattttggaaatagacagctttttcaatccgatcaacacggaaatcttaaatcagtattctatctcctgggaaaaaacggttactttgcaaaaaatcgcgcttcaggaattgtcggctccgctgatcccggtatttgagcatgtaacggtcatgccgcttgtcgggacgattgatacggagcgtgcaaagcatattatggaaaatctgttaaacggcgtcgtaaagcaccgttcacaggttgtattaattgatatcacgggcgtgccggtcgttgatacgatggtggcgcaccatattattcaggcatcagaagcggtgcggcttgtcggcgcgaaatgtctgctcgtcggaatccgtccggaaatcgcgcagacgatcgttaatctgggaattgatttgtcgcaggttattacgaagaatacccttcaaaaaggaattcaaacagcgcttgaaatgacaaatcgaaaaatcgtttcattgggggaataacattgtgagacatccaaaaatcccgatcctgaaactgtataactgcttattggtatccatccaatgggagcttgacgaccagacagctttgcattttcaagaagatctgctgaacaaaatctatgaaaccggcgcaaacggggtcgtcattgacctgacatccgttgacatgattgattcatttatcgcgaaagtgctcggcgatgtcatcaccatgtctaaattgatgggcgcaaaggtcgtattgacgggaattcagccggctgtggcggtcacattgattgaactcggaatctcacttgaggaaattgaaacggcgctcgatttagagcaagggcttgagacattgaagcgggaattgggggaatagcgatgaacgaccaatcctgtgtgaaaatcatgacagaatgggatatcgtagccgccagacagcttggccgcaacgttgcgaaggaattaggcttcggcacggtggaccaggccagaatcacgacggctatctcagaattggccagaaacatttacttatatgcaggcaagggccaggtcagcatagaacaagtaaacgacagagggaaaaaaggccttaaaattatagcagaagacaaaggacccggaatccccgacatccgtaaagtgatggaagacggcttttcaacgtcaggcggactgggagcgggacttccgggcgtgaaaaggctgatggacgaattcagcctgcaatctgttgcagaggaaggaacagagattcaagccgtaaaatggcttcggtaggaggttagaacgtggatttcagggaggttatagagcagcggtatcatcagctgcttagccgatatatagccgaattaacagaaacatctttatatcaagcccaaaaattcagccgaaaaacgattgaacatcaggttcctccggaggagatcatcagcatccaccgaaaagtggtaaaggaactgtatccggatctgccggaagatgtttttcattcgctggattttttaatagaagtcatgattggctacgggatggcttatcaggaacaccaaagtctgagagatatccagcaggagcttcgttcagaaattgaaattgccgcaaatgttcagcagacgctgctgggcacaaaaattcctgaagaagaagaactggatatcggggcgatcagcgtccccgccaagcaaatgagcggggactattatcactttgtcaaagacaaggaatcgattaacatcgcgatagccgatgtcatcggaaaaggaatacccgccgcattgtgcatgtcgatgatcaagtatgccatggactctcttccggagatcggcattcacccctcccaagtgctgaaaaatcttaaccgcgttgtagaacagaacgtggactcaagcatgtttatcaccatgttttacgcaaactacaatacgaaaaatcaccaatttacatatgcttctgcggggcatgaaccgggcttctactactctgaaaaagaaaaaaagttttatgatctggaggcaaaaggattggtgctgggaatttcccaggattttgattacagccaatatgaacagcacatggacgaaggagacatgatcgttcttttttctgacggcgtcaccgaatgccgtaccgaaaacggtttcttagaacgcagcgacattcagcgcatgctggaagaacatatggactgctccgcgcaggatatggtcaaaaatatttacgacagcctgctgagacttcaggactttcagcttcatgatgattttacgttaattgttttgaaaagaaaggtttaaaaaaacggcagcacgggtaaaaagccattagcacgagtaaggataactttcagaggtgatacgatgaatttaacggtagatatgaaggagaatctttcagatatacaaatcaatatcgctggagaaatcgatgtatactcagctccggtggttcgtgaaaagctgatgcccctggcaaacgaggggaaggacatgagaatctgcttaaaagatgtaaactatatggacagtacgggtttaggtgtttttgtaggcgtgtttaaaacggtgagcaaggaaggcggctctctgaagcttgagaatctttccgaccggctcgtccgtctgtttgaaattacggggcttaaggacatcatcgacatttcggcaaagtcagaaggtggcgtgcaatgagtacatcagttgattatatagagatgaaaattccggccgaaccggaatatgtaggaatcgtcaggcttacattatcaggagtcgccagcagaatgggctatacctatgatgacattgaagatttaaaaatcgctgtcagcgaagcttgtacaaacgctgtccagcatgcatacaaagatgaaaataagggagaagtatccgtgcggttcggtgtgtttgaggatcggctggaggtcattgtcgccgatcagggagacagctttgattttgatcagaagcagcaggatctcgggccgtacacaccttcgcacacagtcgatcaattgtcagaaggagggctcggtctgtatttaatggaaacgctcatggatgaagtcaaagttcaaagcaactctggcgtaaccgtggcgatgacaaagtatttaaatggggagcgagttgatcatggcacaaccatcaaaaactacgaaactaactaaagatgaagttgatcggctcatacgcgactttcaaacacatgataataaagaagcccaggaaacactcgtcgaggtgtataccaatctcgtcgaaatgctggcaaagaaatattcaaaaggaaaaagctttcacgaagatctccgccaagtcgggatgatcggacttctcggagccattaaacggtatgatcccgaggtcggcaaatcctttgaagcatttgcgattccgaccatcatcggcgagatcaaacgcttcctcagagataaaacatggagcgtacacgtcccgagacggattaaagaactcgggccgcgcattaaaatggcggtggatcagctgacgacagagacgcagcggtcgccgaaagtcgaagaaatcgcagcctttctcgatgtgtcagaagaggaagtgcttgaaacgatggagatgggaaaaagctatcaggcgctttctgtcgatcacagcatcgaagcggatgcggacggaagcaccgtcacaattttagatatcgtcgggtcgcaggaggaaggatacgaacgcgtcaaccagcagatgatgatcaaaagcgtgcttcatgtgctgtccgaccgcgaaaaacagattatcgatctaacatttgtgcaaaataaaagccaaaaagaaacaggggacattctcggaatatctcaaatgcacgtctcgcgcctgcagcggaaagcggtgaaaaaactgagagaggccttgattggagatccctccatggagctaatgtaatgattcaggttgaagaaaatgaacatgttcaaactcttgtataccaattaaataaagaaggcaagtccatatgcggcgacagcttttttatgaaggcgaatgaagaagaattagtttgcgcggtagcggacggtctcggcagcggatctcttgccaatgaatcctcgtcagccattaaagacatcgtggaaacgtatgcggatgaggatgtggaaagcatcattgagcgctgcaatcaagcgatgaaaaacaaaagaggggcgactgcctccatcttaaaaatcaatttcatcaaaagggaattgacatactgctcgatcggcaacgtccgtttcttcctgcactccccatcaggcgaagtttttcatccgctgccgatttcgggttacctctcaggcaaaccgcaaagatacaaaacgtatacgtcatcatacgaaaaaggggcgacattcatcatctacacggatgggcttgaggttccgcatatccgcacctgcttaaagcagggacactcaatagaagaaatatcaaaatcacttcatccgtacacaacatccagacgtgatgatttgacctatattctcgggcagcttttatcgtaaggctgctttttttatgttccgccgttttttgatacactagagaaagaaagaagagatggaggcttttgtgatatggaaacgttagcccttttgaaaaaacaaattgctgaagaaacagcgttatcccaaaaacatgtcgaaagtgtcatccgcctgctggaagacggcaataccgtcccgtttattgcgcggtaccgaaaagagcagaccggctcaatggacgaggtgcagattcaggcaatctccgagcggtggcaatacatacaaaacctgacgcagcggaaagaagaagtcatcagattgatctccgagcaggacaagctgacagacgggctgaagcaaaaaatcgagcaagcggtcaagcttcaggaagtcgaggatttataccgccccttcaaacaaaaacggaaaacaaaagccaccgtcgccaaaagcaaaggccttgaaccgcttgcggactatattctttctctcccgaaagaaaaccgccttcacgacgtcgctgatcaatatatcagtgcagaaaaagaagtcgcttcaagagaggaagccattgaaggcgcgaagcacatcatagccgaacaaatctcggatgatcctcatttcagaaagtggatccgccaggaaacgtataaaaaaggaattctcacttccgcggcaggcaagtcagccgcagatgacgagaaaaacgtctatgagatgtactacgagtacgaagagccgatccaaaaggtcgttcctcacagagtgcttgcgatgaaccgcggtgaaaaagaaggcattttaaagattgcgatcgaaccgcccgccgatcagataaaagcttatttagaaaagcaaatcatcaaacaccgtgaaacacctgtgaaagaaacgctgaaagaagccattgaggacagttataaacgcctgatccagccggctattgaacgcgatatccgcaaagaactgtcagaaaaagcagacgcgcaggcgatccatattttcgctgaaaacctgcgtaagctcctgctgcagccgccgatgaagggaaaagtcgtgctcggcgtcgatccggccttccgcacggggtgcaaactggcagtcgttgatgagacgggaaaagtgctgaaaatcgatgtcatttacccgcacgctcccgtcaaaaagacagcggaagcccgaaaaaaaatcaaagaattgctggatcggtacgaagtcgaggttgtggcgatcggaaacggcacggcatcacgggagacagagcaattcgtcgttgatgtgctgaaagaaacagagcgggacatttattatgtcatcgtcaatgaggccggagcaagcgtgtattccgcgtcagaaatcgcccgtgaggaatttccggattttcaggtcgaagagcgcagcgccgtctccatcgcgcggaggttgcaggatccgctggccgagcttgtgaaaattgatcctaaatccgtcggtgtcgggcaataccagcatgatgtcagccaaaagcatttaaacgaatctctccgttttgtcgtagagaccgtcgtcaaccaagtcggggtgaatgtcaatacagcatcagccgcgctgcttcaatatgtagccgggttatccaaaaccgttgccggcaatatcgtcaaaaaaagggaagagctcggaaaatttacaaaccgcaaagagctgaaagatatcccgcgtctcggcgcaaaaacatatgaacagtgcatcggctttttgagagtgcccggaggacgggagccgctcgaccgcaccgggatacacccggaaagctataaagagacaaaggcgctgctcaaaaaactgcagctcactgcggatcagatcggaagcgcggacgtaaaagagaaaatcagcgcactgccgctgtctgaaacggctgaggagctcggtataggggagattacgcttgcggatatttgcgggcagctgacaaggccggagcgagatccccgtgacgaagtgccgaagcctttgctgaaaaaagacgttctgcagcttgaggatttaaaggaaggaatggaattgcagggcaccgtccggaacgttgtggacttcggcgctttcgtcgatatcggcgtcaagcaggacgggcttgtgcacatctcaaaactgagcaatcaattcgtcaaacatcctctcgacgtcgtatcggtcggagacatcgtcaccgtatgggtcgaaggggtggacgtgcaaaaaggcagagtgtcgctgtctatggtaaaataaaagcactgcttacgagcagtgtttttttctgtagaaataccagcactggttcagcagtttgatttggtaattgtccttttctaaaaacgctttttgcatttgtttcatcagccaattcggcatggctcattcctcctcagcttttagttagaggtcggttttaacacattgtatgcgaacggtgaattgtcccgttcaatgtttttaaagcggggtgcacatatggataacgaacaacttcaaaagctgacggaagacatctctgcacaggatttcggaaagccgttccgtcaccgggcctttttcaatgaccggctgaaaacgacaggcggccggtacatgctgtcttcccataacatcgaattaaaccgaaaatatctgctcgaacacggacggagcgagctggtaggcatcatcaagcacgagctgtgccattatcatcttcatcttgagggaaaagggtacaagcacagagacaaggatttcagagacctgcttcagaaagtcggagcgccaagattctgcacgccgctgcaaaccaaaaagacacaaaagaaaacatatatgtatagatgcgaggcctgcggccaacagtatataaagaagcgggcaatgaacccggaaagatatgcctgcggaaagtgcagaggaaaaatcaaaagaattttttaaaaaggcttgactcatttcaatgatctgtgttaaattataaaagtcgttgagagacaacgatgctttctcaaaaaaaataaatgttgcttattgacacaatatgtcgcatcatttataataaagaaagtctgatcattccacagtagctcagtggtagagctatcggctgttaaccgatcggtcgcaggttcgaatcctgcctgtggagccattatggagaagtactcaagtggctgaagaggcgcccctgctaagggtgtaggtcgcgtaagcggcgcgagggttcaaatccctccttctccgccagataagttctcaaccagacggcccgttggtcaagcggttaagacaccgccctttcacggcggtaacacgggttcgaatcccgtacgggtcaccatttaccttcgttgggctatagccaagcggtaaggcaacggactttgactccgtcatgcgttggttcgaatccagctagcccagccattttatttaaaaattttgaatcacttttagagcgagccattagctcagttggtagagcatctgacttttaatcagagggtcgaaggttcgagtccttcatggctcaccacttgtcacgcgggtgtggcggaattggcagacgcgctagacttaggatctagtgtcttacgacgtgggggttcgagtcccttcacccgcactttcttttcaaagtgctgatcatcatcactagcttatatgcttagtggaaagacagcttcatagcacgcggtcgtggcggaatggcagacgcgctaggttgagggcctagtgggtgaataacccgtggaggttcaagtcctctcggccgcatcccaataataccaagggtttaaccgcctttggtattttttgtgcttatttttaaatgatctactatccacaaactgcccacttacctggagtaagtcatctacagttgacgtcgcacaaatattttcatcattataggtagttactaatgcctcaaactccaatttgcaaaaggcagagaaagtattgctaagcatggaggaaaacaaagaggccttgttatattatcagctattagaatttagacacgagataatagggtaggggcataaaggtactgaaaaggcttaatcttttttaaaaggttaagtctttttttggctataaatgtaatcggtgcccaattatttgccctgaattcacgaaaaaggataaaataggtgtaaataaagttgatattttaaaattaattcaattcattatcgtaaaagcaataataactaatcggcgaagaaaggataatcagtcaaatgaaaacattagttatcgttatacaccctaatttggaaacgtctgttgtcaacaaaacctggatgaatcgtttaaagcaagagaatgacattacggttcatgacctgtacggtgaatatcctaattttatcattgatgtagaaaaagagcagcagctcctgttagatcatgagcgcatcgtttttcagttcccaatgtattggtacagcagtcccgcgttactcaaacaatgggaagatgatgtgttaacacatggttgggcttatggaactggaggtactaaattgcatggcaaagaactactcttagctatctccttaggcgcacaggaatctgattatcaagcaggcggagaatataatatcacgatcagcgagcttatcagaccgtttcaaatcactgctaactatataggaatgcgttttcttcctgcctttgcacaatatggtacacttcacctttcaaaagaagatgttaagaacagtgcggagaaattggttgactatcttaaagctgagcattgatccggtattcgcgagggaagctgaaataaactaattacagcagggcgatgagtagatatttcttgttgaaatgtagatttccttggtctctaataggtgcccagtttgtgctcggaattcatgaaaaatgatgaaaataagtataaataaaataaacagatgctttgaataaaagcttttgaaactcatgataggtttttactaggttgagggcccagcgggtgaataacccgtgaaggttcaagtcctctcgccgcatcccaatgataccaagggtaatagagagatccttggtatttttttgcgcttatttttaaatgatctactgcccacaaactgcccacttacctaaagttcaaagtgatcaaaatactcaaagtatctggacaatactttgcttggttcttatttgtcgatagtcgcagtaacgaaagcactaaacaacacattaaacagattcttttgatatgacggacacatatgacagtttgcgattgtcgaaattcaatgtataacccttgttcaacttaccaagttcagttaaaagtttgttaaaattgtgataaatgtatgaaaggattaaatgttcatgtcgaaacattaggattacagggaaggggaacaactacatgtcgatttaccataaagtaattggagatggatatccgatcgttatgttgcatggttggacacttgaccatcaggtgatgttaaatgcaatggaaccgttattcgagaaacgaagcggttggaagagaatatacatagacttaccaggtatgggacattctaagccacaaccatctattcagaactctgatgatgttttagaagcgatattgcgtcttttggacgagattattcctgatcaacagtttattgtttgcggtaattcatatggagggtacattgccagaggtatcgttcgttcacgtaaggaaacagttcgtggattactgctgatggcaccattaactatacccgaattcgatgaaagggtagtaccgcagaagactgttctaaaaagagacagcgacttgatatcacatttgtcttcagaggaggcgaatgaattttgctctatggggattgtgcaaggtaaaactgaatgggagaggtttcgggatgaaattttacttccatctaaacaaacaaattatgaattcgtaaacaacattcgtcaaaatggatatgggtttaccttcgatatttcatctaaacttgattatcccacgctaattatcacagggcgtcaggacaatgtagtcggataccatgatgcgtggcggctactcgaagattacccaagggcaacttttgcagtacttgatatggctggtcacaacctgcaaatcgaacaaaccgatgtatttaattcattggttcacaactggttaaacagacttgagtcggaaaattttcggttggtataactttccataagtataagtttactgttgcaattaccaattagttaaacaataattaagataagcaatattggggtttcctgaaattttagtaattattagtctttattgtcattggggatcatttaatcattgaacaaaaataaatccattaccttaaaaaatgttactttatttccagctggataaaaaaattttgtcaggtgtcatgcaataaattcaattgtcggtgattgactgtttaaataaaaccattatttcataccctgtgctacttatttctgttgtagtctaaggtaaagaaagttgaaaaggtatacgaaattcgtcatacaaattaaagttttgaatgaaagagcaggattactcctgctctttttctttctaattgggctagattaaacgcagacggttattccttgggaaaaacaaaaaaatttcttctatccattgactagcttggctttagcctggtttctatcaccccgttgggcttgtcaggttttaaaaaggtatgctacgtttatagtgttttgtttcacctgattgtggggtaataaagatagaatcagtaaataattcttaggaacgacctcaatcttataataaacatattggaagacgtaatggaagatctaaaataaaggtttaggctactttgaagaaataaaagttttttttcgattgtgatcatattcacaatagagctgtatgaaggggaatcatttctccaaatcgtctgcagaaaataccaaccacaacccaaggatatctcactaaccgcttaggctggtattatctgttggctgtttctctttttgttgcttcttgtattatttttagcccaatcggcaaaaataagttaaggaaaccagcgaaaacacttaatttcatccttctttcctggtttacaatgttatttggcgctgatatggatattagtctagtcttttaaggtacagttgaaccaatcagccactatgccgttagctctccatcaggtgaaacagaaacccccggacttttagagaagcattacgctatacattctgggactgcatgctcggaccgtttacgcgcttgtataatgtggatttgataattaaggagtcgatattattaaatgaagtttaacaagaaaaaaattaacgttgtagacattcaaaaagcgaagaaaagcgtgtttgctacagggataggaaacgcgatggaatggtttgattttgctttatattcttatttggcagttattattagtaaaaactttttcagtccagttcaaaacgatgaattaaagttaatatttacttttgctacatttgcaattgccttcttacttagaccggtaggcggaattatttttggtaaaatgggtgataaatttggtcggaaaatagtattaacaattactattttaatgatggctttatctactttaataattggtgtgcttcctacctatgatcagattggggtatgggcccctatattattactctttgcccgtattctgcaaggcttttctgtgggtggagagtacgctggggcaatggtatatatcgcagaatcttctccagataataaacgtataaggttaggcagcggtttagaaatcggcacattatctggttatatagtagcttctgttttagttacagtacttttctggactttatctgatgttcaaatgaatagttggggatggagaattcctttcttcttaagtattccaataggattatttggtttatatttgagaagtcatctagatgaatcaccaatctttgaaagtgacatctctgaaaaccaagaacaacaaccaggtttattagaagtcattaaaacatataaaaaagatatctttttatgtatcgtatttgtggcatttttcaatataaccaattacctattattagggtatatgccttcttatttagatgagaaccttggtataagtgataatataagtacaccggttacagcaattgtattgattattatggtaccgttcgctttaacttttggtaaactgggagataaattaggaaataaaaaagttataacaattggattagtattaggaattgtattttcaattatctcttttcaatttcttaatatggggaatataacattcttatttataggacttttaatgttaggtattgtattatctgtatacgaaggtactatgccaggatctttacctacgttgttccatactgacattagatatcgtacattatcctggacattcaacttatcagtttctatttttggcggaacaacacctttagttgcttcttggttaacccatgtgacaagaaacaatttggcgccgggtttctatttattggcagtcagtttaattggcttaatagttgtgttaaccttatttaaagatacttcaggtaaatctttaaaaggttcttacccaacagttgcttctaaagctgagtttcaagaagctgttgaaaatccaaaagattcactgtggtggaaaatggaacaaacagaaaaggaatgaaaaaaacatccatttaattgaccgactactcgaaatacagactcagaataagctgggattatccgagcagcaatgactgcagctcttttatattctggagggcttactgctttgcaaatgcagcgttgctattctcgatcgtcattattttattggttgtgtcctaataataaaacattgacgcaagaacgaagagaaattaaaaggtccgggcaatacagcaaaataagaagcaagaagctttgttatgccagttcttctcccgaaggagagctggctttttattttctgtatggggtccaaagcagaaaacgagaacttgtacgctaactaatcaacaaaggttttttggatatgaagagggtgaactggtgaaaaaacggagtttgttgtggagttagcttttcaattagggacatctcaacaacaaaataataaccagcccgattaaaaagctcatcaaaagttccattattccaatatacgatccactcaattatttgagtggatctgtttgttttttatttatttgcagcagtctctatgtgacgaaacaataaatggattaaaaccctttacgcagccaggttgcggcgagatcaattgctccgcgcgcagcttcagttttagctaaggcgttgagcatcacgaaatcgtgaatgatagcttggaaacgtacggcagtgaccgaaacaccagcttcacgaagtttattggcatatgcttctccctcgtcacgaagtacatcagcttcagctgtgataatcaatgcagatggaagcccttgaagctgctcagcagttgcacgcagaggtgatgctgtaatttcagcacgctcgttcgaattggttgtgtactgatcccaaaaccacatcatcgcgtccttgcgtaaaaagtatcctgcagcaaactggtgataggattccgtatcgaaagaagcgtctgttaccggatagaaaagtaattgttgccggatattcaagtcacctcgtgctttggccattagcgtgacagcagcagccatattgcctccaacactatcacctgcaattgttagactctcgggaatcatgccgttctcacggccattttcagatgcccacttcactactgcatagatttcttcaatggctgtcggatattttgcttctggagataaggtgtaatttggaaagacaatagcagcttgtgctccgactgctagctcacggatgagccgatcatgtgtatgctcattaccaaatacccagccggccccatgaatgtacacgatgacaggaaggtgcgcaggcgcattctgcgggcgcattattcttactgatacctgtccgctcggtcctcctgaaatcataacatcttcaatatcaactggcagtttatcaattggggcagattgaacctcatctacagcttctcgtcctttctcaggtccaaggtcgaatagatagggtgggttcgcggttgcttctgcaaattcttgagctgctttttctaattgtactttctttaacatcaatctcactccttatttgaaggctggtcacctatatgttttaatcaaatttttttattctattacctattgatcttggcatctttcgtcttacattgctgttgtaatgatttgtacatcaatatttccgcgagtagctttagaatatggacatacttgatgagctgcatgtgttaattcttccgcttgctcttgagataccccttgaatttccacctccagaacaactccgattttataaccattatcactttcatcttttaataaacttactttaccggtaacagctgattcgatttttaatcgttgtctctgggctgctaaatgaagagcactgtcataacaagctgaatagcctgccgcaaataattgttctggatttgtagccgcggatacttgatttggttttggcatagctaaatccaaatcaataataagatcattagatgttacatgaccttctcttccgccttttgttgtagcttctgctgtaaaatatactgtcatcatcaaacactcctataaattaaatttaacacaattgaattttaatcaatctaatcagcgttgtcaattaaattttttgaaattaaattgctctcaatttaaattcgcaattaaaattctctaaatgaatgattagactaaaataaagaacagttttccgcagtttaaagttagtgtacataataaccatattgagaaggtggctcaataaatctatgagtcggtctaaacaatatagtggaagtatctatatcggtcataataagaatgcacctcaaacacattttggttataaataaagtttccatgtatataagttatggttaattaaattgtcagtcattcaatttcccttaatgtaattcttatgctattatgtgtagtaatgaatataaatattgtgaggaatttaacatgaagaatgataaattactgttaagtaatcatctatgttttgcgatttatgcagcttcccgtgaaatgataaagttataccatcctctcttaaaagaattaggaattacgtatccacagtacttggttcttcttgttttatgggagaaggaaaaaatatctgttaaaggtttaggcgaagaattatatctggactccggaacattaactccagttttaaaacgacttgaggagcgaggtcttattataagagagcgttcaaaagaggatgaacgaagtgtaattattacgttaacaactgaagggaatgagtttaaagaaaaagtcacaatgatacctaatgcagtatttgataaaaccggttgtaatgaagaagaaattaaaagttataacaaggaaattcgtaatttacttcacatgctgacaactgagcaatagttttatgaatatagatggcgggccaagcgggtgaataacctgcggaggttcaagtcctctcggccgatccctatgataccaagggttttgacacccttggtattttttgtttataaaaattcatctgttactgtccacttacttatagtaggtcgtatgatttgtcagtcaccttcatccttctgctgactgcgtgcggcggtagtaaatatgataatgcaattaatgaagtgatgaagcaggagaagaaagtcagaaaagaaatgcgagcagattcagatgagtacaaaagagataacgccataatttctgtatatgatgacggcaagtatattcagcgttttatcagccagaagaaagttctcgtaggctgactgcttattcttattatgagaagcttggagattcttatgaggaaatggcacatatgccgggtgatggtgatggcgaccgccttggtctttataagaaaacacctgattataaagaggttaaaggcaaggaaacaaaaacaatgtgcttgttcattcctgataggggaacaattgttttaccgttaagttgttgtgtgagagccagtatgttaaaatgctacgtagatttaataataaagtttagattcaaggagatttatttatgaagttggatgaatttaccatcgggcaggtttttcaaactaaatcttttgaattaacaaaagagaatataatgaattttgcagaagtgtatgatccacagtacatgcatttaaatgaagaaaaagcaaaaatgggcaggtttaatggaattattgcttctggaatacaaacgttatctattacttttaagctttggattgaagaagggtgtcatgaagacgatattattgctgggacaggaatgaataatataaaattcctagcacccgtttaccctaatgataaactgaacactattgttaaggttattgataaaaaaccaaataaaagccagacggggatacttactgtattgttatctacctataatcagaaagaggaaaaagtgtttgaaggtgagttatcagtattaattaaacgctaaatgacctttgcggcatatcatcgtcacctttcattttttataggtgtctggatgaaatgagcaatcatcttaattaattgagtggattttgagtctgctctttttttatttgttcaacctatgtcgagaaacaaaggactcacaataacgaaaaaatcatctcgtaaatacgaatttaaaaattgctaccttgaggttttttgcatattcctctgtatcattgcaccggatgaatatctataatgagcgttctatccttcgatgttatgtttcctttttactttttggttttgtcagttcaaagctgtactttaccatgtcatggatttgatgctctgggagtccctcatctaaggtaagcgtattccaatgctccttgttcatatggtatccgggcttgatttcttcaaaaagaccacgcagaaaatcagccctttcaggttcgcatttaaggttgacacataagtgttcgtcgcgagtgaagataagtgcaaatattttcttattccctttgtgccgaattgcagtccaaccatctccaaaagggtggtcttcataagagtttggaaaggttaggcagtaatcttttatttcatcataattcattatcaattcactccatacctcattatttttatatacagaacatattcgttcaaactaagatttgcggtttcttttataccaatccgagatttcctcaagtctttgtttgaacttagcttctgaaccttgagttgttggatagtaatactcacgccctattaaagaatctggcatcgtgtgcattgtcgttaattttttctctttatcatgagcatttttatatcccttaccgtaatctaaatctaaaatcaatatcaattcggggctggattcaatatgatccagtccctttttgttttattgatttttcttatccccagtctgataaaagattttctgtgaatcatttaacaattatcggccgttttttctttttcgataatatcctttaccacatcctcaattgttatatgtccaagagctttttccaaggcagattgggcgatttcaaatattggaccaattgtactttgtatgttccggcctacaggacattgaggattgggattttcatgtatactaaacaattctttatcttgaacaacattaactgctctataaacatcaagtaaggtgatttcagttaaatccttcgctaattcagctcctgcaatacctggccgtacatttactaaacctgcttttttcagcatccccataatttttcttattaaggcgggatttgtatttacacttccagctaaaaattcagaagtgctaattccgtcttcatttatttcaataagagccaatatatgaattcctacagcaaaacggctgctaatagacatgatttcttcaccatcctaattactttacactctttatagtacacttgtaactgaatgtattacaagtttatttcactctaatatgctcaattaacaaggtgataaaagtattgacaaacaaataaggtgtaactaaaattattacatgtaatcaatttggttacatttaaaattttgaatgattaggaggactttaaattgaaaattggaatcattggtgcaaccggaaaagctggaagtcttatcttgaaagaagcggtaagcaggggccatgaggtaactgcaattgtaagagatgctgcaaaacttaaagaggaaaaggtttcaatcattgaaaaaaatataattgatcttacatcggatgatctaaaaaagttagatgtaatagttaatgccttcggagctccattaggagaagaacaggcacatgtagatgctggccgggcattaattagggcattaaaaggaataggtacaagagcagtaattgtaggcggagcagggagtctttatgtagacgaaaataaaactgtcagtgtaatggatacacctgatttcccggagatttttattccaacagctaaagggcaaggtcgtaacttgcaagagctaaaggaaacttctgatataaactggacatttatcagtccttcagcggtatttgacccagacgggaaaagaactgggttttatcagtcaggaaaagatcatcttcttgtgaactcgaaaggcgaaagttatatcagctatgcagactatgcaattgcagtattggatgaaatagaaaatccaaaacatataaatgaacgctttacagttgtgggagaagctgaataagttactgagtagaaacaaagggcgccattagcgtcatcgctaatggtatcttcctcctaagaatgtacggagacattgaaaactttgcaatcagagtagctgattatttttatgaaaaaggggatttatcacgttccaatgaatattatcgagctgatgacagagtaggcgcttagtgagttggatcaaaaaataaatagctctgactaaaacctttgcgggttagttagagcttttgtaaacccactcgttttcgtgagtgggctttttaaaaatacacctctcaacatgatatttattatttagtacggtaaggggtccgtcaaaacttctaatttccaaatgaaggttctcgcaaaaaaacctgccgcacgtttaacaaataaaaccctgaatgaaacatgatattaatttgcagttatttccgtttcgtgctatgataaaggagaattatttttgttcgtgtaaaggatagtatgaatatcgacttttcgtcttgatgatactttgggcaaggatagtaatacaatgtgtaatacactaggaggcaacaaaaatggaacaaggtacagttaaatggtttaatgcagaaaaaggttttggatttatcgaacgtgaaaatggagacgatgtattcgtacacttttctgcaatccaaagtgacggattcaaatctttagacgaaggtcaaaaagtaacgtttgacgttgagcaaggtgctcgtggagctcaagctgctaacgttcaaaaaactgcttaatcttcaatcgtttatacaaacaggctctttatatagggcctgtttttttatgttctctgtatcatactgaataaaaaaccctactcaccgttcgagtagggacagatgctacaaggtaagaaaaaggtttaaaacctcaaaggattgtttacagtataacataccggattgacgatatgtggaatatataaatgatttgtttttatgttctcaaggtaacggtatgttattctttgttacaattcgcatatcttttttatgaaataagataaacaactgctattcactgtcgcaagagatgtaagaaattctgaaagataaaggggagagtggttgttttttcttccggaaataatcacttagacctaaaacaatgaaagccctgcctctcttccatcgttacggctccttgtccgtgccagggtgaatcaggattacaaaaatcaagtgactatttcatcgagaattcaagtgttcgttgaagaaaaaaatataacagattagattgaggagtaataaaagcggttaatgtttaaaaagtaagttgaagaagttgaacgtctgatcgtaatactctgaaaaacttatctgtcattaaccttaacagaaactttttatttgtttttcagtgattcctttaatgacttccagttcactaatcaaaaattcatatgcattatccaacatttttttcgcttgaattaagtgctttctctttcttcatacgcattaaatcacgtacaacttcagcgccttcttgtgattaaacaggggatactaatattaactctttaaaatcattctcatgccgtcttgaaaattgacagtatacctgtaagggtataatattgattcacaaacattatctagttaataatgtagtgtgataaagcgcagtatgaaatgatagtggataacatgcaaatatataaatttcaaagaaggagttcaacgcatggaatatgatcaaaagattaaaaatcgcttacgccggatagaaggacagataaaaggtgtattgaccatgatggaacaaggaaaagattgcagagaggttgtgacccaattagctgcttcacgtaatgcgatcgatcgagcaatgggtttgattgtgagcacaaaccttgaacattgtgttcgtgaaagtttagaaaagggagaagacacacaacacttagtaaaagaagcggtcgacttattggtaaagagccgataaaaaaattcatcaacctatcatctttaaggttgacgaatttttatattcattataatatacccctaccggtatttaatatgttgaattgaataataggagatctttcgaaaaaatttttaatttcaatatacccccaggggtaatagtgattggtcaggagaataaacatgacaaaacaaacaaaacgcacaacaattgttttatttagcggggaatatgataaagcaatggcagcctatattattgcaaatggtgctgctgcctacgatcatgaagtgacgatcttccatactttttggggattaaacgctttacgtaaagaagagctgattccagtgaaaaaaggatttcttgaaaaaatgtttggaaagatgatgcctcgcggtgccgataagatgggtttatctaaaatgaactttgcaggtatgggccctaaaatgattaaaaatgtgatgaaaaagcataatgcacttacgttgcctcagttgattgagatggctcaagaacaaggtgtaaagctcgtagcttgtacgatgacaatggatcttcttggtttacaggaaaaagaactattagatgatatcgactatgctggtgtagctgcttatttggcagacgctgaggaaggcaatgtcaacttatttatctaatgtgatccattgcaattgaataagtgaaggggggatataacactatgaatagcggagtaatgttcaatactttggatcgtatttcgacgttttttcccattgcatggtgttaaacaaataacaactgctgatttaaaatcggaggcggaaaacaaagacaaacagtttatagatgtgcgaacttcttatgagttccgtacaaggcatattaaaggattcaaaaatattcctttgtctatcttgcctcgtcaaactcatcaactttcgaaagacaaagacgtctttgtgatctgtcaaagcggaatgagaagtgtaaaggcaagtaaaatattgaagaaacaagggtttaaaaacatcacaaatataaaaggcggtatgaatacatggtattaacatccagggaataactttttgcatatttatatacccccgccctatataagaaaaggaggaaaaaaaccgtgaaagcaaatattgtattagacgctaaaggtttgtcatgcccaatgcctatcgtaaaaacaaagaagaaaataaaagaattaaaagctggtgacctattagaaattcaagcaacagataaaggatcggcggcagatctgcaagcatgggcaaaaagctcaggccatgaatatctaggtactgaaacagagggagaagtccttcgtcactttcttcgaaaaggaggagagcattcatcagaaaatgcatcttcaattcctgagatttcattagaagctttcacacagaaagtggatcgtgatgagtctcttcacattttagatgtacgagagatagaggagtatgaagaagctcatatccccggagcggtgcatatccctcttggcgaagtggaaaagcgctttaacgaattaaacaaaaatgatgaaatttatattatttgccattcaggaagaagaagtgaaatggcagctcacaccatgaaaaaacaaggttttaaaaaggttattaatgttattcccggtatgcgggactggacaggtaaaacagaaaaaggaggtatgtaaacatgaccgtgcaagcacttaccgcaaaagaagtcacacaaaaaatctttcacaaagaacctttatttattttggatgtacgtaatgaaaatgactttagcgattggaagattgaaggacatgattttaaccatttaaatgtaccgtatttcgatcttttagatggcgtagaagatatcttggagaaaattccttctgataaagatgtgctggtcgtttgtgcaaaagaaggttcatctgtcatggtatccgaaatgctttctgaagcaggtcattctgtatcctatcttaagggcggaatgaaagcatggagcgaacatttagagccggtaaaagtcggggatttaaaagatggcggtgagatgtatcagtttgttcgaatcggtaaaggctgcctatcatacatggtcatttccaatggtgaagcggcgattattgatgcgacgcgtatggtagatttctttatggattttgcgaaggagaagagtgcgacgattactcacgtatttgatacacatcttcacgcggaccatatttcaggcggcagagtcattgctgaaaaaacaaaagcagcctactggttaccgcctaaagatgctgaagaagcggtattcgattatcagccgttggaagaaggaaacgacatgaccatcggaaatacaaagattaaaattcaaccgatttattctccggggcacacgattggttccacttctttcattgtcgatgatcagtatcttctttcaggtgatatcttgtttattgattcaattggcagaccagacttagccggtatggcagaagattgggcaggagatttaagaacaacgctttatagccgttacaaagcgttgtcacaggatttaattgtattaccggcacactttatgatcattgacgagctaaataaggatggaagtgttggtaaaaaactaagtacattatttagcgagaaccatggtttgaacattgcggatgaaacagaattcagacacttagtaacagatcatttgcctccgcagccaaatgcataccaagagattcgagaaacaaacatggggaaaatcagcccagatgaagaaaaacagcgtgaaatggagattggtccaaaccgctgtgcaatacggtaactcaagtttctattaaaaagaggagagatgaacatgaaatcagataaagtattagacgcaaaaggtctggcatgcccaatgccaatcgtcagaacaaagaaagcgatgaatgaactggaatcaggtcaaatattagaagtgcatgcaacagataagggagctaaaaatgatcttgcagcttggtctaaatcaggcgggcatgatcttttagagcaaactgatgaaggcgatgtattaaaattctggattaaaaaaagctaatgaatgtgaaagggtatcgaatacaaagatgccctttttctttgaaaggaggaaccaaaatggatattgcttttatcacaactcttttcattatagggtttattggtgcctttatttccggaatgatgggtattggcggatcagttattaattatccaatgctattatacattccttctttagtgggagtgatgtcattaactgcccatgaagtttcagggataggggctattcaagttttctttgcgacacttgggggtgtttgggcttatcgtaaaagtggttttttaaataaagcattaattatgtacatgggaagcagcatccttttagggagtgtattggggagttacttttctcattatatatctgaaaaaggaattaactttatatacggaattctggctatactagcagttattttaatgtttatacctaaaaaaggacaagaacatagcgaagacgaagaagtgatatctaataaatggttggcttcgtccctagcgtttctcattggcggcgtatcaggtattttaggagctggcggcgcctttatcctggttcccattatgttatcgattttaaatatccctgttagaatcacagtcgcttcatctcttgcgattacatttctttcatctattggcgcaacagttggaaaagtaatcacgggccaggttctttttacaccggctctggttcttatgattgccagtttgattgcttctcctattggcgcatctgttgggcaaaaagcaaatacaaaattcctgcaatggattttagcgctattaataagtgcgacagctattaaaatttggttaaagctcctttgatatgagtcagcgggtaaaatgaaagattaaaagattcatcacccgttggtttcttattaattctttttgataatggtgacttgggcaagtcttgactatagtaccgtgaaaaacatttgacttagttgcgtccagtatttttttgcatttaggacagcgttttggaacactataaacctgtacgttttaaaacgaagatggtgattttaacaaacatggcacccaagacatgtcatgtaactttctggtgatgaaaaaaacgactccatttttactccacaatatgaattaatctttgtaaaataacatgatcaatataaacacacactaatatataaaggttttgtaatagaaaacacagtttcactttattgatggcccagcgggtgaataacccattgaggttcaagtcctctcagccgcatcacaatgataccaagggttctgaggtttttggtattttttgtttgcggctgcgccgttacttaaagcaagtcgtctggtttgccagctatcttttttaaagccctttttcaattaatgaaatgataaaataggagaagaaagccagaaaagaaatgagagcagattcagatgagaaacacaagaataactcatcgtgatcgtattcgtacacatttttacagaggaggacaattatgattggaatactggcaggaatggggccaaaatctactgggccatttgtagataaagtcgtagacgagtgccaaaaaatatatggagcaatacatgacacggattttccacatatgatgatttattcctgtccgacacctttctacatgaataaacctctcaatcatacggacatggaaaatgcaattattaagggtgctgtaaagcttgaaaaaacgggtgttgattttattgccatcccatgtaataccgcacatctctattttaatcaaataaaaaaatcgatttcagtccctttactgaacatgattgatgaaaccataaaaaaaatacctaaaggctcaaaaaaagcagctcttttagccaccgttcctacggttcaatccggaatatttcaagaagcgttaaacagagaaggttatgattttttacatcaagatagttggcaaatctatgtcgatcaaataatagaaaaaattaaacaaggtcaaatcgatgaggctggtacattatatgatgaattacaccatgacttagcagaaaaggctgatacggttatcattgcatgtacggatttaaatatggtcacggaccaaaaaagaagcggacttactattgttgattcatcagcctgtctcgctcaagccattgtaaataagtatgtatcattaacaaaataagtcatctgatttatcagcaaattcagggcgctttttttcctttaaagcgcccggcttcggcagatgcatgatcctcaattacttctttgaatgtaacttccccgtgttattgttcttttaacattgaatactttcgatacgttttatagaaactgcagccaaatagaacagccataagggcgggaagcgacctcaacagggcaaatggagtttcaaataaaaatgctttccaaaacattgcgctttccatactccacagaccttcagttaaatataaacccgaatccttgtaaatcaaataagaataaaacaagcacagtaaaccaaaacaagatgaaaaccccattagtcttttataataattactctttgattggcgatccgaaaagatttcattttgatcatcattttctttttgccaataccgagttccgctaagccatgggctgtttatataaacccagccgaagtcttcatagatttctttgtactctttaaattttttctttgataaacaatcttgataatccagtctcatcacatattttttgtcggttttttcgaaagtgtatattcctaatccgctgatatttgtacagcgatagcctttttgtagttgctcgttcagccattgctcctctttttcaatatcaaaaaacatcttaaatttcttcattcgattcacttccttcgtgcagggataaaatatgcagtaacctgttttgttccatcttcaaaatggcgcttccttccgcagttatcatataaacctttctccggcctgattctccaacaggctcaatccagccatgcttattcaaattttcaatcgcgccgtataatgtgccggctgctaaaataacagttccgttactcatcttttctatcttctgcatggcggcatagccatgaagcggctcacgcagagctaataaaatataatgcatggtttcagacagcggtaataatttatgtttcatatcctcatcctctattcagttcgactatatagttaaacttaatacagtacaactgaatagtcaatggccttttcaaaatttgtaaaaggaacttgaaaatcaaatctaaaagtcgctttctttacgtaatgggaagcgacttctggggcagttctattcaataaatggcccgattgaacgcattaaaaataccaagggtttgagtcccttggtattttttgttcattgtatgatgatgtaaacttcttgcttatttagcgctgtcgttccagtttttctctataaatgtattcgcaggctgtaagttggttttgtttgcaatttcaatgacagcgggaaccacggaagggtctgttttggagaagttaggaatccgcggatctaaccggaaaaagcgatctcccagcagattcgcgctgaccatggattcatagtagccatttccgccggagatcatctgaagaaatggcagtaaaggttcattaggcgacctgtccaaaaggactccccaatttggaggaaggttcttcagattttcgggacgtatgttatccgcacttaccattccccatcccctcgtatctcttcttaaccgagtcggggcttcacctgtaccgatggatagcgccgcaatttgatccaatggcacgttggctttaccaaccgcaaacgcgatactggccgtactggggttcgttgccactacatatccgtccacgtagttttgataggcgcgctgtgtcgcgggagcaccgctgctccgcagtatgacatcactcactttctcatttaaatagggagagccgggaaagttgtgaaataatacgggcgtccaacgatccagtgccggggagtataatttgaatgaagggacaacaattcgttttcttacatctttaagacgaaggcctggcgggaaaaagtttcgtaccgctttaataaaaccggaatagggtaattgctgattaaaaacaggtccgcccggccgggaagtgctgaatgcgggcaggatttcatcctcaaaatactgaagtgtttccttcggagatcttccgcttgctaatgccagggcagtaaatgaaccgattgaatttcccgcaaatacatgggttcggcttattaatgccggattttcttcagccagtctgttcaatagttgtaaacttaaagcacctaaggtaccgcccccgtcaaaggtcatgatccgatattttgccaaagctgatttctcctttctgatgaaaactatcattcagtatatgttcagccagagtctattgtatggatgaatgaatatctccttatcttaaaaatagtttgattatcaatccggcgagtcgggaaaggatatgttttttatttgaagaggttttttccgggaagaaggagaattattatttaaaaataaaagggggaaaatacttgaatacaattgaccttattgttttacattttgaagaggtaagacggcgaagcatcaagttatggacagctgtacctgaggaaaaaatggactggcgcccggactccgaagccatgtcgtgcaaggaaatgataagacatgtattagaagcggaatttctttatcatcaaattttaatgaaaaatatgagtgagttttcagaggaaactattaatccttatgaatcaaaaacgtttaccacagtaagcgaagaattagaatttgcaaaaccgtatcgggccgcgtttttgacattcatcaaatcgttaaacgaaacagatttaacaaatataaagattgacaggtctgatgttggatatattcgcgaactgggagacatgttattaagaatcgcttaccatgagtctgtacataccggtcagcttttagactacctcagaactgctgaggttgacaggcctttaatttgggactagttaaatgattgagttttacacgggaaggggaaagaatggaatataaaccgattaatttccaagagaaattatctgcattccaagatcaatggtctccaaaagtaatcgctgaaatgaatgattatcaattttaaacttgttaaagtacaaggggattttgtttggcataagcatgacgaaacagatgaagtctttattgttattaagggtaatttaatcattgaatttcgtgatggaaaagtaaaattaaatgaaggtgaaatgtttgtcattccgaaaaatgttgaacataaaccttatgcagaatcagagtgtaacattttgcttgcagaacctaaaggtgttgtcaataccgggcaggaaataactgatcaaacagctgaaaatgatgtctgggtctagcctgtaacaaaaaaacgatcaaaactccgaaagatcgaatgacgattagagaaaatgatcaggaaaaccacttaagaataatttaaggttaaatattgaaaaaatttgttaatattataatatattgtttggaaatgtaatcttttataaggagttttctaattgcgttggagtaaatggttcaatattttttgcatagcagcattgggatcaatatatggctataaattgtttactaatcaagaagtcagtacggctcgtgtaatcatagctgctgctattatcttgtggaacattgtcggactttttagcaaagaaccagtaaaacaaacacagcaagcaaactaaaagctaaaaaatactttccaatcgttcaataaaaagttggtacagaaggatgctgcagcgtgcagcatcctttttatcatttttacaaaaaaaccaagggtttaaccccttggttttttcgtagtctccctttttacgctgcttaagataatcgtcaaaatcattcaagtttcatgcaggcatccagattctgttgcaatgataaatgaaaattgccctaaaaatgtgccggttcatcaaaataccagtccaagctgcagatctttctttacatagtatgtagagattaaaaaatgagagaaggagtggcgtaatgtattataacgatggtgacgatcaacagtacttccagaagaaaaagccatacaacgaggcctgtgaccttggccatgattttgatatggcggacgacgatgcaagagcggaagcggcaagagaagcagaagcgagagccagagcggaagaagccatagcaagagcggaagaagcaagagccagagcggcagaagcagcaaaagcagcagctgaagcaaaggtagaagcggcaaaattagcagccaaagcaaaagcgaaatgtaaaaaacgtcataagaaagagaaaaaacatgattgcaaacgtaagcacaagaagaaaaaataagagcttttcatcatgtaaaagataagattcaatgtgtattgattttatccgtacaggggtgcaaaaacgataaagaaaaagattcttgtcgggggatcaaacagaaagattgctcagcagaaccacgcatggcagggcaaacataatgttctatggacttccatagtttggtcgggatatcacgccaataaatgtaagtgcctatcatggcaggagagacaagagtttcggcaggttgccgcacttgtcttttttttgttttttctcatcttcgcgtatatgtatctatttttaagtttgcagaacatctgtctaagaatttgtccaattcctacatatactggtatgggaatcaaatgcttattgggagtgaaatagatgggatcagcacagttaacgggacgtgtcatcttcaaaggggaccccggctatacagaggcggttaagaattggaacccttatgttgatgtctgtccgcttgtctttgtttttgcgcaaaattcatacgatgtaagtaatgctattaaatgggctcgtgagaagaatgtgcctttgcgtgtcagaagcggccgccatgctctggataaaaatctttccacggtaagtgatgggattgttattgatgtgagtgacatgaataacgttttcttagatgaaaaaaacgcggtggcaaccgttcaaaccggcattcacgtcggcccgcttgtaaaaggtttagctcgggaaggttttatggccccgttcggagacagtccaaccgtcggaatcggaggaatcacgatgggaggcggatttggagtgctttcacgatcgatcggcctgataagtgataaccttctcgcactgaaaatggtagatgccaaaggcaggatcattcaagcaaatcattcccgcaatgaagatttactgtgggcttccagaggcggcggaggaggcaatttcggatataacacccaatatacgttcaaagttcaccgtgcccctaaaaccgcaaccgtctttaatattatttggccgtgggaacagttagaaacggtattcaaagcatggcaaaaatgggcaccgtttacagacgaacgattaggatgctaccttgagatttacagcaaagtaaatggtttgtgccatgcggaaggattgttcctcgggtcaaaaccggagctgattcaattattaaaacctttattaaatgccggaacgccggcacaaacagtaatcaaaacactatactatccggattgtatagatttcttagatcctgatgaaccgattcccggcaggtctgatcagagtgttaaattctcctcggcgtgggcgctcaatctttggccggaagaacctattgcagtaatgagacaatttttagaaaaagcgactgggacagaaaccaatttcttttttatcaattggggcggtgcgataagcagagttccaagcagtgaaacagccttctattggcgccgtccgttattttatacggaatggacggccagttggaaaaataaatcacaagaagcttcgaatcttgcatcagttgaaagagtgcgtcagctgatgaaaccatatgtaacaggttcttatgtgaatgttccggatcaaaatatcgagaacttcggaaaagcatattacggctcaaactttgcaaggcttcaaagaataaaggcgaaatacgatcccgaaaatgtattccgttttccgcaaagcatcccgccatcgtataaatagtttgatcgttgtgggaaacaaaataaaaaacacaccagaacattcaggtgtgtttttattgttgctataaaagttggttattcacttatattcccagtgcggattccaaacaatttcccacaagtgcccgtcggaatcttggaagtgaccggcgtatccgccccaaaaagtatcatgagcgggagcagttatcgtaacgtttgattcatgtgcgatgtctttgcggtcccagagggcaagtttcagtcccgtttgcaagtcgtccaaatctgtaccggctgttccttctgtattctgtaggcagacccaagccatcccgatagaagtgcagcgatttttctaaattatctgcgcctaaagtaattactgtaatccgcggcttcatagcaatgcaacctcccaagctaagctaatgataagaaacattttcattgaaaatattttgacatttcagtaaagaacctatatattcatatatgagcacataatcatataaggttatttttgtgtccgtgttagaatgcttcatagcagaaaagaaataataaatacagtgtattagataaggaggagatttttatgggtcacaatcacaatcacgctggcggatccaataagaaggttttattgatctcttttatcatgattacaggttatatgataatagaagcgataggcggatttttaaccaatagtttagcgcttttgtcagatgcaggccatatgctgagtgattcaatctcattaatggttgctctgattgcttttaaattggccgaaaaaaaggcaagtcatcataagacattcggctacaaacgatttgaaattcttgcagctgtgatcaacggtgttgcattaatactgatttccctttatatcatttatgaagcaatcaaacgtttctctcatccgccggagatagcaacaaccggcatgctgacgataagtatcatcgggttagctgtgaatatattggtcgcttggattatgctgaacggcggagatacaaagaataacctgaacattagaggagcttacttacatgtgataagtgacatgctcggatctgtaggtgccatactggctgcgatccttatcatcttcttcgggtggagctgggcagatccagtggccagtgtcattgtggctattcttgtgctgagaagcggttaccatgtgacgaaagactccattcacgtattaatggaaggaactccggaaaatatcgatgtcactgacatcattcatacaattgaagagacagaaggaattcaaagcattcatgatttgcacatatggtctatcacaagcggattgaatgctctttcctgccacgctgttgttaacgatcagctgaccatttctgaaagtgaaagtattttacgcaaaattgaacatgaacttggagatcaaggcattacacatgtaaccattcaaatggaaacggcagcgcataatcacgacaatacgattctttgtcaggcccaaactgagaatccgcgtgaccatcatcatcattaaaggaggagatagggactaactttgtctgctgacaattaagataaaaccggagggggattcatatgtacgacacgatagtaatcggagccggtcaggcaggaatctcagtaggatattatctaaggaagtcgaaacaaaagtttatcattttagataaaagtcatgaagtgggggaaagctggaaaaaccggtatgactcattggtcttatttacttctcgaatgtacagctctttgccgggaatgcagcttgaaggagacaagcatggactcccttcaaaaaatgaaattgctgcttatctgaaaaaatatgttgaaagatttgaaatcccgatccaattacggacagaagtaataagtgtccaaaaattaaacaactatttcttaattaaaacaaaccgggaagaatatcaaacgaagaatctggtggtggccgcaggtccttttcatacccctaacattccatcaatatcaaaggatgtagccggtcatattcgtcaattacattcttcacaatataaacattcaaaacaactggcgcctgggaatgtactggtagtcggcggcgggaatagcggggctcagatagctgttgagttatccaaagaaagagttacatatttggcttgcagtaaaaaaccggtttatttccctttatggattggaaaaagaagcatcttttggtggtttgataaattaggagttttacatgcaagtcatacatcaatattaggcaagttcattcaaaagaaaggcgacctcatatttgggtatgaattaaaacatgcaataagacagaagaagatcatcttaaaacaaagagtcatagccggaaagcaaaatgaagtcatttttaaagattcatcttcattagaagtaaacaatgttatttgggcaactggttttaagaatccgctttggtggatgaaaatagaaggtgttttggataaggaaggccgaattatacatcaccggggtgtttcagctgcggagggattgtactttattggtttgccttggcagcataggcgaggttcagcgctgcttcaaggtgtaggaaatgatgctgaatacattgtaaaacaaatgaacggcggatagactgaggagagcagtaacttacgtgtttactgctcttttttgtgttgaatacgtccatcagtgcaactattttagtccgcgcatattcagtttgaactaaatggattcacatggagcgcgtgcttcactcctcgttcagactctctaatttaattctttcaagtaaaagtcgaaatagctcaaataacaagaagttaaaaaactgcaaaccccgccgtatacgtatccgcccactatagagttcattaattacttgggaccatagaagaattgtcaatgccacttccgatagttgtaaccagccaaaaaaagaaaatggggagggtgtgcttaatttgcacaatcttttatgtagaagtggcccaaggagccatcctgcattttgcattcgaatgaacctgtcgtaaaaaattgagagcagacttaaatatctgctcaactcgctgttatttctcaatgttgaatcggtctttgatcttttcaggcagtttctcggccttaatagcttcagattctccggtataaccctcatagctcctcggaacgcgtacaatgtcaccttcttgataaggcttttcaacaaagaaagaaaccatctttttcttacctttctcgttatacccttctaaattgtaaacgtagttgctattatttttgtttttttccgcttttccgtgaatttgtacgtaataatcgctttccagcacggcgccttgatcagcgcagcctcctaatatgaaaaccgataggcagcctaatataataatgaaaatgctcatgtttttcattcttcatcactccttttatatttcttattctaatgaacactgcatatcgaataaatgcgaataccttacacttaccttacttttttgtaagaattcctgatataaaagataatgattcagttgcagaataacaaataatgggtaaatgcaatctcgtttggaaggagactgatatgatcattaaaatgactccattttttaatatgaaagaattcaataaaccaaacaaccatttgctgtttcaaggagaattgcacctgcatttgaaagcaatgtgtggaatataccgaggaacgatttgctgaaccttatgttaagaaaaatgaagatgatgatgtcagttacgttgaagaagaggggaaagcggtctttttttattacaactgcgccggccggattaagatacgttgcaaatgtaatagcgatttttgtctgaccattttaattgattggcagtcagtgaaaatagacatttgtaatgaatttatcgttgctcctcctaataagcggctttaactgccaagtttctgtttctcttcataccatttgcgaagctgatgaatatgagcttgatgatatctattatggtctgccatatgccatattccccattgaatggttgatgatttggtcctttataatcaatctcctgctgtgacatgtctgacacaatggatattaagcggctgtcattttcattaacggcagaatacagcgttcccacaagatgatccatgtgcgtttcaccttttaaatctaaaatcattaaccccacctcattagcacaatttttatatcagtttgccttattactcatatttgtcaagccatccggggaatgggccgctgtaagacgaagctatgaagcaggctctctttgcctgctttttttgtgtgtcggctttacatctgacatgttgcgttatctgaaactgtacctttttaaatgtcagacagtgttatatgatactctgcagatattcaagaatatgtacttggaggacattctcatgcgaaattttaatgttgctatccctacgccttttcatgaagatgaaagtttatatttagaaggatttgatgctattgtcgaacatttgaaaaacagcggtatccattcgttactcatatgcggcacgactggtgaacagcattcactcagcatagatgagcgtcttcagatcattgagtatgttaatcagcgaaaatttgaagatgttgaactgatgttcggtgtttcagccgtaagaaccagtgatgccgtcaaactgatgaaacacatcgagaaaaccaatattgattctgtactgattggttttcctccttatataagaccgacacagcagcaagccgtttattacgttgacgaacttctcagtcatacctctaaagaggctgtgctttataataaccccggccggaccggttttaatctgagtgagaaagcgcttaaagacttaataagccggcatcccgggataagggggctgaaagaaggaggagacgttctgcgtcataaacaaacagagttccctgatcactttattttgtttgcggcaggagacgttgaatttccgaagatgctgagtaacgggtgtaacggcctgtcaagcatggccggaaatgtctatcctgaagaaatcagagaaagcttcagcagcttatcagaaaataaaccgattaatctggatcgaataaacgatctgattgctgaagtgacaaatcatcatactgtcatgaatataaaaaatcactataagaagattgggattcaagcaggcagctgccggtcacccattatataagaaatgttccgtcgcggataagtgaaacatgtgatcagcgcgctttctgtacttggattaggcttaataagcaagttttataatactgtcattagcgggggcgtaagcatttgtttaactttacataagggaacccttatgatatggtgattattgttaatattgacaagaaagaggtgaaagcgatgataacgatttatggaattttgtatggtgaaaatgcaaaaattggaaacatcttggcggataaagggagcagtctgtccttttttaagccaaatcatcatacaaaaacagttatcggtgctttttctctatgtcaaataaacgataatccaatgacataatgtccttgtttatttgtgcatgatgttatttaagcgtaacaccgataattgtgtcggtgtttttttgtgcctgattttaaaaaaaggttagatgatcactcccttctatttactcaaacaaaccagagttttatggaaggatgagaaaacatgcaacaaaaaaacaagtatataagaattcaagagttcctgaaacaaaataagtttcctgattttagaatgaatcaaatcaaaaatgctgtgttcaaagggagaataaatcattttaatgaaataacggttcttcctaaatccttgagaaaattgttaatgaatgagtttggagagtcaattttaaatattgctgctttaaaagtgcagcattctgagcaagtaacaaaagtcttatttgaaatttcaggagacgaaaaaatagaaacggtcaatatgaaatataaagctggctgggagtcattttgtatatcctcgcagtgcggctgtcattttggctgtgcattttgtgcaacaggagatattggtttaaaacgcagcttaacatcagatgaaatgactgaccaaattttgtactttcacttaaaaggacattcaattgatagtatttcttttatgggaatgggagaagcattagcgaatgtacaagtttttgatgctttacatgtgcttacaaatccggagttgtttgctttaagccctcgtcggttatctatttcgaccataggtattattccgggcattaaaaaaatcactcaggattatccgcaggtcaacctgacgttttcattacattctccttttaatgaacagcgaagcaagttaatgccgataaatgaacgcttcccgttattggaggtaatggacacattagatgagcatatacgtgtgacctcaagaaaagtttatattgcttatattatgctgccgggagttaatgattctattgatcatgcgaatgaagtagtacgtcttttaagaagcagatataagagagggaacttgttccatgtaaacatcattagatataacccgactgttagttcacctatgagatttgaagaagtaaatgagaaacaagttgtaaacttctataaaaaattaaagtcagcaggaattaacgtgaccgtcagaagtcaatttggcattgatatagatgctgcttgcggacaattatatggaaattatcaaaaaaataagaaccgataaatcaggtgcagaactcggtttgacttcatattatttcatttgataacataaaatggttattgtgattgaaaaaaagatacccgtttttataaaaaaggagtcataacgttgctgaaaaggttttttcttgtttttcttacgctgatgatgtctatatttgctgtattcgcggcggctgaagagtctcccggcaatcgtgtcatttcttttgacgagcctatgattttattgatctcactcggaatcattttatgtttgttcattccgccattcgtcatgtccttttttagcagcttggttgtgagaatcatatccggagtctatcaatgttttatcgttctcacgtttgcgggcctcattccgattggatttctgattcccaatggctttttgacaattcttgctgccgttctggggactttggtcagttcagcgagtgttgcggtcaccttattcgttggcaggacagagaacacaaataagctttcgtaagcggttttgacaacaataacacgtcctgaaaacaccaagtgtcacagacccttggtgttttttaattccggcagaaaagaaggtataatgggcggggaagaggtgtcagccaatgaaaataaccagagagacattagaaaaacagcaaatttggatatatggtgtgactcttgtgatcggaggaatagcggggatcgccgggaaagattcaggacttcgctggggatggacgatatcactgtttatcgctgttctcatgtatgccatgtttgcccaaatcccattcttgaagctgagggaagccatgtcaaacctcaagtttatggcggccttactgatcggtaatttcttagctgtacctgtcgttgtatgggtgttaaccgccatttttcctcaatctcctcctatattatcaggggtttgtttggtattgcttacaccttgtattgattacgtcatcgtctttactcagctcggcaaaggaaatgagagattaatactggcttccacgccggttttgttcgccgttcagatggtattgcttccgttatacctgtggctgtttatcgggaaagaagtgataggagctgttcatgcgggaccgtttctggaagcattcttattgttaatagcggtgccgctgctggcggcggtgatgactcaattatgggctgataagaaaccggcgggagaaaaggtgttggaatggacggcgtggctgcctgttccttttatggctctggttttattggcggtcgtcgccacacaaatcggcaaagtcatcaatgatgctgacatcattatacgtgtgattccgatctatctgctattcctgctcattatgccgtttgtctcccgttttatcgcatatgcgttccgtctggatacaggtgaaggaagagcattgatcttcagcacgggcacaaggaattctctcgcagtccttccgttagcgctggctttgccggatgcttgggcctcattagccgctgctgttatcgtcacacagacgattgttgagctgatcggtgaattggtttatatcaaagcggtgcccggatggctgctgaaataaaaaataatctgggctgaaaaaaacataccaatagatattggtatgttttttatgagaattataaagttgcaatatcaataacgaaacggtagcggacatcgctttggagaacccgttcgtacgcttcgtcgacttgatcggccggtatcacttcaattttaggagcaatgccgtgctcggcggcgaaatcaagcatctcctgagtctgcggaataccgccgacgagtgaacccgcaatgctgcggcggcccgtgattaaggagaacacactgtatgagtccggcttagcgggcgctcccacatttaccaatgtaccgtcaatgcgaagcagggataagtaggcatctacgtcaaggttcgcggatactgtatttaaaataagatcaaatcgtccggccagctcagtaaatgtatccggatcgcttgtcgcaaagtaatgatcggctccaaattcaagcgcttcgtcttttttgttcattgagcggctgaggacggtgacctctgcgcctaaagcgtgcgcgaattgaacggctaaatgtccgagcccgcccattccgacaatcgccacttttttgccgggaccggcattccagtgtttcagcggagaataggtggtaatgcccgcgcacaatagcggactggcagcatccaaatccagctgatcgggaatacggacaacgaatctgtcagtgacaactattttctggctgtagcctccgtacgtagggtttccgtcgtagtccaggttattataggtctgaacaacgccttttgtgcaatattgttcgtctccgttcaggcagtattcacattccccgcaggagtctacaaaacagccgacacccacacggtcgccggcggcaaatgtggtgacttcttcacccacggcttccacaactccggcaatttcgtgcccgggaaccatcggaaagattccgccgccccattcatcgaatgcgctgtggatgtctgagtgacaaatcccgctgtacttaatatcaatcaggatatcgtgcggccgtaatgctcttctctcaatcgtcgtccgctcaaatttagctttggcatgcggagcgcttaatacacgagtcggatgattattgcacatggttatcttcctttccaagataaagtgatgaatcctctgttcggttttactttaaatgttaaagcggactttaagtcaaggggtttggtttatttttttatgaaatgatattctataatggcacgcttatgaaaggtatgaaggatgggtggtaagaatatgaagattgcgcaggctgcaaagcaggttgagttatcagccgcgacgcttaggtattatgaaagtataggactgattcctccggtaaaacgcgatgaaagcggcatccgcgattatgacgaagatgatgtgaattggattcaatttataaaatgcatgagaagtgccgggctgtcgattgaggcgctgattgaatataccgctttatttattgaaggagccgatcatacgatcgaaccccgaaaaaacatccttataaatgaaaggaaaaggctgacggagaaacagagggaaattgatgaaaccataaaacgattaaacaggaagattgaggattacgaagatatcctggaaaatgaagcgaaacttaaaaacagattgaaagctgaatgtatttctgaatgaagagaaggtgtcccgggcgccgggccgcatgaaatgtaccaagggaaacgagccttggttttttttattttctaaagagaggaaacaaaacagctttttctatcttatcaatcattacttatccttttttcagcttgacttttttactgcagacttttaaagtgtgaaatgttgcttagactgtgattagcgactttaatgctgaaaagaggtggtttacccagatgaacaatcataagaatccttgggcgttattgcctttagtcttattcgtagggctttttgtcggctctggtctggtgaccggagatttttataaattgccgatcttgattgccgcgatcattgcgtcagcttttgcgctgttatttaaccggaagaaatcgctcaatcaaaaaatagaatggttcgcttccggtgcgggacatcctgatattatcattatggttatgatttttatattggcaggtgcctttgcttcagcggctgaggcgatgggagcggtgcattcaactgtcaatcttgctttgagcattattccgcagcagtttttgctgccggggctgtttatcattgcttgtttcatttctatatcgatgggaacatcaatgggcacgattgcggcggttgcgccgatcagcgccggtttgagcggagagcttggcatctccagcgcgataccgattgcggctgtggtcggcggagctatgttcggagataatctttcttttatttcagatacgaccattgcggcagtccggacgcaaaaaacacaaatgagggataaattcaaaacgaactttctgattgttttgcccgctgccattgtgactgttattatcttattttttattccggcaggccacgccctccatacggatgctgcatcttacagctggattaaggtgcttccttatgtcgccgtgttagtttttgcgttaatcggtattaatgtgatggctgtcatattcggcggattggttttgacgggaatcatcggattggcgggcgggagcctgacgtttgattcttattttaaagcgattacggatggagttgccggaatgagcgaccttatcatcctgtccatgctgatcggcggaatggtcggtgtgatgaaacaaaacggcgggatcgactttttactggagttcatcacgaaacgaatccgttccaaaaaaggcgccgaagccggcattgccggattggtcagcgtgacgaatctggctgcggccaataatacgatctcgattatcgcagccgggccgattgcaaagaatattgctgataaattcaacatcgacaacagaaaatcggcaagtattctggatatcttttcgtgtatgatacaaggattgattccttacggcgcgcagctgttatcagccgggaaattcgggaatatttcacccgtcagcatcctgccatactctttctatcccgttttaatcggaatctgcggcatcgccgccattatatttggactgccgaaattcccaagaaatacgaaataaaagataaaaaaaggcgccgttcggcgccttttttctttcatgacagccaagcatttctcaaaagctgtacgccttgtgtgatctgatccgtatcgagatgggcgaaacctaactttatgatcggcggttcgggctttccggcaacgaaatagacagcggtagggtatactttcactccgtactgaaaggcgcgttcgattaatgtttcttctgtatagttcaggtgaactcttactaatatatacaatcccgactgctcgccgatgatcgtcacctgatcgccgaactgctgcttgatatgtgaagtcaagtgctgcatcttacgcttgtagacagtgcgcatgcgcttaatatggcgggtccattcaccggccttcatcaattcagccatggtcagctggttaagcgaagaagcggtgctttcgaaatgaataaaccgttttttataccggtgcaaaaggcgctgcggcaaaaccatatagcttatgcggatgcccggtagaaaggattttgagaaattccctaaataaatcacccggtctgattgaatggaagcaagagcgggaaacggctgctgtgtataacggaattcactgtcataatcatcttcaagaatataaccctctctatgattcacccaattgatcagtgtttggcgctgctgaatggacatgcttacgccgtaagggctgtgatgggatggggtcacatagattaatttttctttcattgcatgcaattgagaaaaatcagctccgttttcatagacaggcatcgtttccagagatagcccgtgaaattgaaatgccgctctggcaccgtcaaacccagggtcttcaacgataattccggaaaaatcctctttcagaatctggctgagatatatcagcatctgctgggtgctgctgccgatgataaccgaatccgcatctgttttcactccgcgtgattccaagagataagcggcaatttgttcacgcaggtttctctcgccgaacggttcaccgtacagaaagcttttctctgatgccaaaacttgattgtataattttctccatgttttcagaggaaaatgcttttgatcgacggctccggcgcgaaaatcaatcagggccggctgagttgattcggttttctcagcgtaaacaacatcatgttcttgttgaaataaagagggttctatttcattagcaaaatatcctttgcgtgtttctccgcgaatgtatccctccgctaaaagcagatcataggccatcagcgttgtattgcggcttacccgcagggaatccgccagctcgcgaatggaaggcagccgctcatctgcctgaatatttccttgctcaatcaatgttttaaattgctcgtaaatttgtttgtatttcggggtgccgcttctgaaagcgaaaatcaaatttttcatcagatgttctcctctgacatgtgtatttatttgaaactgtatctttttaaatgtcagttgatattttattatagcggaaagcgctttatcaatccatgttcagagaggagagttttgtatgtatattccggctccatttcagctgagtgaagctgaagcgtgcgatgtaatcaaagagtatggtttcgcagcattgttttcaacggcggggggcatgccgtatgcaacccacctgccattgatgatgagtaagaataacgaatgcttatacggtcattttgcattgccgaatccccaatggaaagagattgatggccaaaacgtattagccgtttttcaggggcctcattgttatatctcgcctaaatggtatgagacgaatcaggctgttcccacatggaattatgtggcggttcatgtttacggagaggcggagcttttggatgaggaagaaaccgtgcagtcgatgagtgatctcgtattgaaatacgaaagccccgacagcccgtacaaattagaggatgtcgatgcgaaattgctggcaggcatgaacaaaggggtaaaaggttttaaaatcaaaatcagcaaaatagagggacaggcaaagctgagtcaaaatcattcagccgcaagacaagggctggtcgtacaacagctcaaacagattcctcatacaaacgaacagctcatttccggcttgatggaagaaaacatcaaacgaatcaccgcaaaaaactgacaagcatgttaaaaacataccggcagcatgcggtatgtttttttctgattatgaagcttttctcaggatgaataacgactcgaacagcacataaatcaacggcgccattaaaatgaagaaagaatgaaaaatagcatacggtatgagtaagtaaacgataagtttcaatagaatggaagacgttttattcaatgtccagcggtttttcaagatatcagtcatacaggctgaaacaaggccgaccgtcaaatatccggctgctatgtaaagataaataaaaaggtaaaacgggtaagaagacaacgggggtgtgtcttcctgtgtcatttttaaacccacataaaagaccaataaaaagcaaacggacgaaacgagagctaacaaaaggtgtttatataaatacttcttcatgtgtttcacctgcctatggacaattatttctaaacatattatgacatggttttaccgctgctgaaagaatcggcagcgggcatgcgcccgtctatatgagcggggcgtaaagaatcaatatcatcttttcatgaatccggatgttttgttcggatggatgtaaagaagaatacaccccaaaaaaagctgtcagcttggtcctgacggcttatttttggtgaaaggcttatttctccgtggtgaaataaagcaatgctatgaccggaaaagcgattccaatccataatgtgatactccacccgcctgaggcgtatgcccatcctccgattgatgatcctatagcgccgcccagaaagaagattgccataaataatccgtttaatcggctgcggaattcaggtgccaacgaaaaaatggcacgctgactgagtacgagattggcagatacccccatatccaacaggatagctgcggccaccagaactgctattccgacgggagagctgctctgaatcatgagcgggagtaataaagaaacgatgacaacaccgagagcgattccggtggcaagccgggttaagccgcgatcagccagacggccgcctatcggtgcagccgctgcacccgcaatgcccgctaatgcgtacagcgcgattgccttttgagaaaaatgaaaagcaggaccggacaatagtaaaggtacagtcgtccagaataagctgaaagctccaaatacaaacgcatgataaatggcacggcggcgtaagaccggagtcgtgcgcagcagcttccacattgaaccgagtaagacggtgtagcttgtgtttgctgttggttttctggcaggaagcacttttgataagacgattgccaggacaacacttaacgcggcggataaagcaaatatggcattccacccccatatatcagcgaccagactggatatcggacgggaaagcataataccgagaagcaggccgctcatcacattgccgacaacccggccgcgtgcggcatctggtgcaaggtatgatgcgaacggaactagcacttgggccgcgatggatcccagtccgatgaaaaacgcagcggctaaaaacagtgttccatgcttcacacatgctgtcagagttagagcggctgcgcttagtaggagcgataccacgacaagttttctgttttcgataatatctcccaaagggacgagaaacagtaggccggcaacgtatccgatttgagtcagcgtgacaatcaatccggcactgcttggagaaagcccgattgccgcactaatgaatcctgccaagggctgtgcataataaagattagcgacaatgataccgcatgccgttgcgagaagaagggttaaaccagttgaaatcccctgatccgctgtttgtttattttctttagccatatgaatgaactcctttttaatgattttatgaggtttgataaatattttgctgattcatctcctttacgcagaggcttttggagtctgcatttcatcaagacttccctcaagttattttataaactaaacgttcagttttgtttataagtgaataatatactaaacgttcagttttgtaaatgggtttctgttttcttttttatacaggttaagtatactgaacgtatcgtttataattcgggaaggaatgattcatgtgcagagtaaacgaggacggccgcgtgatgaaggaacacataaggcgattctttctgctgcctatgacctattgttggaaaatggctttgacgcggtgacagtcgataaaattgcagagcgtgccaaagtgagtaaggcaacgatttataaatggtggtcaaacaaggctgccgttatcatggacagctttctttcgaccgctacggacagactgcctgtgcccgatacaggatcaacagtgcaagatatattgacccacgccgcgaatttagcaaggtttttgacgagccgggaaggaaccgttattaaggaattaatcggtgcgggacagctggatgcaaaattggcggaagaatatcgcacgcgatttttccagccccgccgcctccaagcgaaaggccttctggaaaagggaattcagaaaggtgaattaagagagaatcttgatattgacgtaagcatcgatctcatttacggaccgattttctatcgcctgttgatcacaggtgatgaggtgaatgattcctatgtgcatgatcttgtgatgagtgcgtttaagggagttcaagctacgtgaataaccgccgctcgaatcgggtgaaaagtatttgtgcctatggggcagaaaataatgaaaaggcagaacaaattgttctgccttcttcgctctatttgcgaaccgcccggcggccgccacgcacgtaatcaccgccgcaagccccaataacagcccgaagaaaggctggagaagctgcagagctgattcgcgggagtttcgttgcctgggcgctgtaaaggcagttctcagtttgacatactgaagctgagccagaggtgctgtctcagcaggaaaacatttataggacgggcaggcggagcgccgtatcaatattttgcaaattaaaccggacttgttcatctgtgttccacggatgataccagcctttttccatcatatagcgtgagatttgctcatgcatgtcgatggcttcttctaagtgacgggtgaggatcgctttcacttcaggcgttccggcttccgtcgccgccatcgcatagtttctgactccgctttttgccgaattcaataaatccatagcgacaatttggtctgtcagtgcatccatccccgtcaggtattcaataatcggattcattcgtcattcatctcctattcgtgctttgcatcagataaaatcgaggcaaattcctgcaattgccttgttgatgtatccgcatcctgctgcatgatttctttcagctgcggatcggatacgagcgctttcatggttttggatttcgtcaggcaaagtgacttaaaagaagccatctcctgaatttcgagtaattcatgtaaggcgctggccatttctgtagcctccgttctctaaggtttgagtacaactttaatacaatcatctgttttcgtgtcaaacatctcatagccgtgcttcgcttcactgagcggaatgacatggcttacaacatcacccggatcaattttgccggttgacaccagttcaaacatatacggcatataatggataaccggagcttgtcctgatcggatattgacgttccgctgcatgatatcgccaaggggaaatccgttgtatctgccgccgtacacacccgtaatctggatcgttccgccttttcgcaccgcttgggacgcgatgaccaatgcgctcatggcccgccttgaagttttaatccgctggcgaggaactcaagatctgtcatttttccgtccatgccgacggcgtcaatgacaacgtcggcgccgcctttggtgatttccttcaggtagctgcccgtattttcgtggtcttcgaagttcacgatttccactttattcgtccgtttcgcatgctggagacggtagttgacatagtctacggctatgacgcgtttcgcaccctttaaccagcagaatttttgagcgaaaaggcccacgggcccgcagccgagaacgatgaccgtatcgcctgcttttacgccggcattgtcaacgctccaaaaaccggttgtcatcgcatcggcaataacactcaatttctcatccggttcttcgcatgtttcggggactttaaaatgggtaaagttcgcaaaagggacgcgcaaatattcggcctggccgcccggatagccgccggtactccctgaatagccgaaataagcgcccatatcgccgttttcatttgattgatcacattggctttccaggtgatttttacaataagtgcattctccgcaggcgatattaaaaggaataatgacgcggtcgccttttttgactttcgtcacgccgggaccggtttcttccacaatgcccatcggttcatgcccgataatatagtcttcctgcaagttcggaatgagtccgtggattaaatgtaaatctgatccgcaaattgccgtacttgtgacttttataatcatgtcatcgtgtttttcaatcttcggatcaggcacgtctttgacgacgacgtttttcactccttgatacgttacggccttcatgctgtaatacctccagtgttagtgttcatcaggtgtgcggtcaaacatcccttttctgttcgtttcaacgggaaacagattcatgtttccgaccatgagggtatttttcgcagagagctggtccagtttatactgttcgctcagatcatgcgggtgaaaccactttttgctgaccatcaagtctgtaatttcctgatgcatcgcgattccttgcatgagctgtttgcgcagcaaagctcttacatctggcgaggcggtttctgttaaagcaacggcggtatttctgacgccttcttttgcgcgtatgagaaaatccattgcgaatgtcatatctgcgagttcagggacgtgtaatgaattgattggatctaaatggtcatggttcaatgatgcttaccttcctttcaattgatgatcgaagtcggccggttttgaggaacaggagcctgaaacgttgcccgttcataaaccgcctgcagatcagcaaggttttgcgaggcttgctgaacgtctttttccattaacgttttcagatcctgatcaaacacaagcccttgcatgagcttggatttcgctacacaaagcgtcttgaagttaatgatttcatgtaagtccagcgactcgtgagccgctaattcacgcttttccataatcgttttttaaacctcctcttctcaattacataattaatttcccctgagaaaagagctctagtcttacaaattttgtttataaaaaaagagagaagaaatttgacggtacattaaaaaagaggaagcacaatcgcttcctcttgttcacatggaatggctgtcggtgtcctgaacgtttttctgatgcgcgggcggttttgccgcgcgggagacagaccgctgaaacccgggaaaggtcataaaaaagatatgaacaaaagcagcccgcgaacaatcccgcaggctgttttttctttcacccgtcaagcaggacagaaggggaaggtgagaagcaggcgattatggtatgatgacaaatagaataaaacatcgtgaggccggtcggctaaaaggaagtggacagagattgtttggtacaaaacatcaagaagactatgtctcccgtgacagacgctcattgcatatgcttgcgcttcgggtgcccggtctggcgtttatttttatggtatatgccgcatcagtctctttgcagtacatttatgaaagctggacggttttattgctgctgttattcacgatattgatcgtcatttttgctgtgctgcactggcattcctatcgctgggtcaagaaaaaaacgtttctttatttcatcatacagggatttatcatatatacatcggctaacttgatgaccggcggctatatcgcggcggtcatcggtctctatgcctttttaatcgggcagattatcggaatggcggataagggcaaaacgccgctcatactctatcttttcattttaatgtccatagcagccctgcaccaggagcatccgcatcatctgcttcgtttcatcgttatcgccgctcccatcatgatcgtgattatcacatatgcggcaacatttttcgcgcaagttgatgaaaaaatcaaaacacagatgacgcttgaaaaattagagctcgctcaccggcaagtgaaacagctgacgcttcaaaacgaaaggcagcggatggcgagagacttgcacgatacacttgcacaagggctggtcagcttgcatatgcagcttgaagcggtgcatgttcatctttcaaagggtaacactgacagagcgaaagacatcatcagccagtcaatggacagagtgaagggcacattggctgatgcgcgctcggccattgacaaccttcgcagcaaatcagaagagatcgggttcttaaaagaaagcatcactgaacaaatcaaccattttacagaagcctccgggctgtcttgttttttagattacagcgtgcatcatgtgcttgacgttcatacggcggagaattgccattacatgatcggagaaggcctgactaacgccgccaagcatgcagaagcaaagaatgtctgggtgtccgttcaggaagaagagggacagatccgcataaccgtcaaagatgacgggaaaggctttgatgccggaacagaaatgagaaaaagcggacattacgggctgctggggatacaagaacgcgtcaatatgatgaacggcactttccgtataacaagcgccagatcagcgggaactcaaattgagatcatcataccaattcaaggagaagcggaacatgtataaagtgttaatagcagatgaccatcttgtcgtcagagaaggtctgaagcttttgatagaaacaaatgaccattacaccataacgggagaggcggaaaacgggaaaaccgccgtccgcctcgcagcggaactaaagcccgatgtcattctcatggatctgtacatgccggaaatgagcgggctggaagccattaaacagataaaagagcattctgatgtgccgattattattttgacgacctataatgaagatcatctgatgatagaaggcatcgaatcaggcgcgaacggttatctgctgaaggacacaagctcagaaaccttatttcatacgatggatgcggcggtcaggggagaagtgcttctgcagccggacatcttgcggcgtttccgggaaaagaaaatggaacgggcaaatgccaatgaaacacagctgacggacaaggaaatcatagttctgcaagccgttgcgaaaggacataaaagcaaagcgatcgccttcgatttaggaatctcagagcggacggtaaaagcgagattaacatcgatttataacaaattaggcgctgattcgcggacggaagccgtcaccattgctatgcaaaaaggcattctgaaactgaatatataatgaaaaactgcccaaacgtacatgcccctatgtacgttttttttatgtgaatgtgaactacaattaggcagaaagtaatgattggagaggagtattcgatgtctggttttttatataaattagggggatggtctgcccgcaaccgattcaaaatgatcagtgcgtggctcgtgatactgatcgcttcgattgtgatcgccatctcgttaaaacctgctttttctgaggatatgtcaattcccgacacaccttctgaaaaggcgatggatgtgattcaaaaagaattttcaaaggggcccgataaaggaagcatacgggttattttcggagctgaagacaggaagaaattgacgtcaaaaccggaaaaacaagcgattgaagagacattaaagaagatcaaaacagatcattcggtcgcttcgattgcaaatccttttgaaacaggaaccatttctaaagacgggtcagtggcatatgccgatattacgtacaaaaaagcggcggatgacattacggatgcgtctgtttcacatattaaacacagtctgtccgccgccggagacaagggcctgcagacggagctcagcggcgatgtgccgggggccggtgttgaagccggcggtgtatctgaaattgtcggcgttgtgctggctttcgtcgttctggccattacgtttggttcattagtcatagcggggctgccgattgtcacggccctgatcgggttaggtgtaagcgtcgcgctgacgttaattgggacacagatctttacgatagcctcggtcagtctctcattatcaggaatgatcggcctggccgtcgggattgattatgcgctgtttatctttacgaagcatcgtcagtttttgggcgaaggtgtacaaaaaaatgaatcgatcgctaaagctgcgggaacggctggcagcgccgtcgtttttgcgggactgaccgtgatcgtcgcgctttgcggattgaccgttgtcggcattccgttcatgtctgcgatgggattgactgcggcactcagtgtgctgatggctgtattggcatcagtaacgctggttcctgcggtgttgtcaatcgcaggaaaacggatgattccgaaatcaaacaagaagaaagaaaaggaaagcgccgacacgaatgcctggggacgcttcgttacaaagaagcctattctgttaagcattttcagcattattcttttagctgtcatcagtctgccggccatgcatttagaactggggctgcctgatgcgggaatgaaagcgaaagacagcccggaccgccgcgcctatgatctgttgtctaaaggattcggcgaaggctttaacggcaagctgacaattgttgccgatgcaaaaggagtcaaggggaataaaagtgaagcatttcaagacgccgtgaaagaaataaaggacttgcacaatgtggcgagcgtcacacctgccatgccgaatcaaaaaggggattatgccatcattacggcagtgcctgaaaccgggccgaatgataaggcaacgaaagagttagtgcaggatatacggaaacgatcagacaaaaacggcatccgcctgctcgtcaccgggtcaacagcggtgaatattgatatttcagaccggttaaacgatgcgattccgaaattcgccattcttattgtcgggtttgcgtttgtattgctgaccgttgttttccgctcgcttctcgtgccgcttgccgccgtcgtcggctttttgctgacgatgaccgctacactcgggttatcggtattcgttctgcaggatgggaatttcaccggcttgctcagcattccggaaaaaggtccgattctcgccttcctgcctattttagccatcggtattcttttcgggctggcgatggactatcaagtattccttgtcagcagaatgagagaagaatatgtcaaaacaaaaaatccggtacaagccatccatgccggattgaaacatagcggacctgtcgtaacagcggcgggactgatcatgattttcgtctttgcgggattcatcttcgcgggggactctacgatcaaatccatggggttggcaatgaccttcggtgttcttttcgatgcgttcattgtaagaatgaccatcattccgagtgtcatgaagctgatgggacatgcggcctggtacttgccgaagtggctggataaaatcattccgaacgtggatatcgaaggccataagctgacacaaggcaaaacaccggagaaaccggaagaataaaatgaaaaagcagatcgttatgatctgctttttttatgtgctgaccgcattcatgaacagagaaaaaagctttttcatgtcttcatgtttttttgtcagcatttcgggatgccattgcacgccgacgacaaataattcacccgttcgttcaatcgcttcaatggccccgtctttcgcataagccgcggctttaaatgaaggcgccgtctcttttatgatctggtgatggaatgaattcacccgcgctgaatcgccaaacaaggtatggagacgtgtccctttttcaaaagaaacatgatgggtttttaacggcggatctttttcttggtcatgcttaatgtcagcaaacgaagcgtgtgccaggtcttgatataaagttcccccgtaagtaacgtttaacatatgcatcccccggcagatggccagtatcggcttttctaaagcaaccgccgtgagaatcagctccttttcgtaggcgtcccgatcaggaaaggtctttcttaaagcctgtaaaggttcttcgccgtaaaacagcgggtctatatcctggccgccggacagaatgatgccgtcaacatgagagacctgttcctttaaaagcgccgtctcttgaatcaccggcaatataaacggcacaccgccggcctcagaaacagactgaatataatcattattgacatatgcccgattataacccgggaaagggccggattgatcagccataatgtttcccgtaattccgatgcgtttggccattctgcgttcacctgaacctttctttctgaaccttctcgtatgaatctgaacgtaggttgtacaaatcagtttgaaattattcttcataatacgtgaactttccaaaacaaaacccgtgacaatcacgggtttttacattcatttcaacttcttgatttcttccgtcagctctttgaacttttgatcaagctcacgatattgtttatcagccggagtcatgaagctgagttttccgaggacttcctgccgttcggtttcaaactttaatcgcagttcttcagcatcatccctgacggagggagattctttccattgttttcggacgctgccgtttgagatatcaagccggatgtccgtcgtcttttcgacaaagtaacgatcatgcgatacgatgatgagcgttccgtcgtatcgggccaaagtgtcttcaagctgctcgcgtgacggcagatcaaggtggtttgtcggctcatccagaatcagcacatctttctcccccagaataaacgccatcagcttgcatttgacccgctctcccatgctcatcttgccgatgggttccgtccattgcgctgcggtaaatcctaaatgcttcatgagggattgaacatttccccttgcttcgaacgtttctttgtaaaaaagctgttcggggttttatcaagcggaaggtcgaatacttcctgggttaaatagccgacgtttgcagacggagaaatccatatgccgccctgcgctttttcctgaccgaggatgaccttcaataatgttgttttcccgctgccgttcgggcctgtaatcgcgatcttttcaccgtgcatcacagtgaaattcacgtttttaaaaagcgttcggccttcatatgactttgtgacatcacttacttctaaaaaacgctttcccgcttttttgcggtgctcaatggaaaaacggacttcatactccgcttcaaccggttctgctttcgctttttcaagctctttttcaagacgcttctgctttgatttaatctgggcgtccgtgcgttttgcttttacgcggtgatattctttaaagccttctattttcgttgattgggcgtgggctttttttgaccaggcgctcagctcgttcatttgagcttcaatccgtctgatcatatgctgctgattctcatattcccgctgctgtgtcagccttctctgtttgcggacctccatatagcttgaataattccctttatgttcaatgagtttctttccttcgatggcccagatttttgtcgccgccgcatctataaaagcacgatcatgtgaaacgaaaataatggtgcctttgtaattcttgatctgattaagcagtatttctaaactgtgctgatcgaggtggttcgtcggctcatctaataacaaaaggccgcttgaggaggagaaacctttggcaagacgggctttcaatttttctccgccgcttaattgcgaaaaggcgcgtgcgggcacgttccacttttctaacaaggctgcctccgcaggctccggatggccggaatcataagcttccgtttcttgttccaccatatatatgttcacatcttgcatcatctggatctgtccttgtgacggcgcttttttattgcagatcaattgcagcaataaagatttgccggcgccgtttttaccgataacaccgatgatgtcgccttgctgaacactcgcgctgatctgttcaaaaaggggaacgctgttgatttcgtaactgatgccgcttatttttaacatttctttcatatgtcaatccctcgctttaaagggaggacaaaaaaatcctcccaattgatttggaaggattagccgtacctgtgcgtgatcaaataagctatttttacatagctttctcgtatcgtatagaaaatgggcagactaatcctattttttctgatttgaaatatttgatttcaaacggtcaaaataagattagttaatcattgtccacccatcatcccttcgtatttgttacgaacagtgtagcacacacttatctgtaaaagcaaagggtataagcctttttattccagatcggaggcttcccactcttcttctaaaacggcataataatattcatcccaccattcattatcatgggggatgcattttttaaacaagccttcccgcctcatcccgatcttttccatcacccggtgcgaagccatgttttccggctgacatgtcgcaatgatccggtgtaatttcatcttgttaaacccgaatgccagcacggcgcgcgccgcctctgaagcatatcctttgccctggtattccgggtgaaacacccagccgatttcatacgtatgatcgccaaaatactgaaaaaaaacaatgtggccaatgaccgttttctcatccttcaataaaacgggaaacttcccggcatgttcaccgctgttttcagtaacgaatttcctggcatcttcttcggtaaagacaccctctggtatatatttcatgacactcggattcgaggtgtacgcatagacatcctgccaatcttccggttcaaatgtccgaatgacgagcctttcagttttgatattcatttttttatgttcctccatcaaaaaaggtttcatttactacttcgattgaaagatgtaaaaaacctttgagcggggaagagccgaataaaaaaagcctgcagctatacactgcaggcggttatttttcatttgcggcggcgggcaggtttgtaaacccgaattgccctccgacagcttcttttacttcatgaataacgataaatgatttcggatcaattttttgaacatgttttttgattttcagcaattcgttctttttaatgacaacatagataatgcgcttgtctttgctgccgtaatacccgtatccgtaaaaaatcgtcgccgcgttgccgtactcggaggtgatggctttggcgatttcttcgtattggtcagacataatggtgagggcttttttattatggaaaccctcaatgacaatatcgacgattttggcgcacagataaacgaatataaacgtatacagcatatgattgattccgatcgctaaaacggatgcgaaaatgatgacacaatccatataaaacatgcttttggagatgttaaagccctttgtgtaattcaataaatacgccaaaagcgtggtcccgccggtagatccgtcagcgataaagatcaatgccagccccgctcccatcagcagagcgccgaatacaatcccgagcaccatgtcgtgcacgccgaacggaataaagctgacgatgctgagaaaaacagaagtcattcccgtaccgagtatcgtgtataaaatcgtttttttcgttaaaaatttataagccagcccgataaaaatcaaatttacaaccagagtcgtaatacttgcaggtatatggaaaagataatataaaacgagagcgattcccacggtgctgccgtcccctaaatgattcgggatgacgaaaaattccacggacgccgcgataagaaaggctccggccataatcatcagtatatccttgcaaatgttcttcatgtgcaaacctcctccgcagtcaaaaatatatataaaacaaaaacgcctcaaaaattatccagcagaactaaataatttttaagacgaatcattcacaatctcgtttgttcattcagtaaagaatgatcagcttcaatatcgaagattatatagacaccttcacatcttgtcaatgccgtgaaaattgattttctgcagtgtatatgaggtttaaaccaagttaaaacgaggaattatatcagaagagttttcatttccgctctatcaataagagaaatgtaatgagagacaacgaagaagggatgatgacattggaacgaatttttatcagtccggccaaatacgtgcagggaaaaaacgccattgaaacgatcggcggacatctggagggcgttggtgaaaaagccgtcgtcatcgcggacaaaaccgtatgggatatcgcgggccacaaggtgacggctgaattaaagaaaagcaatatctcttctgaagaggcggttttcaacggcgaagcctcccaggaagaaatgaaaagaattgccggcatcgcagaaaaagcaggggcgactattgtcatcggagtcggcggcggtaaaacgcttgatacggccaaagccgtatcagatgaaataaacggctacaccgttatcgtgccgacggccgcttcaacggatgctccgacaagcgggctgtctgtcgtgtattctgaacaaggcgcgttcgaaaactatcgtttttatcataagaatcctgacttggttctggtcgatacgaaaatcgtcgcggaagctccgccgcgctttttagcatcagggattgccgatgcgatggcgacgtggatagaggcgcgcagtgtcatcgccaatggcggtaaaacgatggcaggcggaattccgacaatcgccggagaggctatcgcggaaaaatgtgaagcggtattattcaaatacggccgtctcgcttatgagtctgtgaaagcgaaagccgttacgcccgcattggaagcggtggttgaagccaatacacttctgagcggactgggatttgaaagcggcggcttagctgcggcacatgccattcataacggatttaccgcgcttgaaggtgaaatccatcacttgacccatggtgaaaaagtggcattcggcacgctcgttcaattggcgctggaaaaacgttcgcttgaggaaattgagcggtatatcgcgttttatatcagcttggggctgcctgtcacacttgaagacatcaaaatgaaagacgcatctaaagaggacattatgaaagtggcagaagccgcgacgattgaagaagaaacgattcatgccgcttttgacgtgacggctgacgacgtggcggacgccattatagcggctgatcaatacgcaaaagcatttaaagaaaaacacgcgtaaaaccttttaccgcgtgacccggaaccaagggctgttacagcccttggttttttttatgccctttgaaaacttttaaaaataaagaaaaaattatgatacaatatacaaatgttttgagagattgacaaaggaaaggtgggaacgatatgctgcataatccgaccggtaaggagcggcttgcgctggcttttcttctcggaatgcttgcgatactggggccgctcaatatagatatgtatctgccgagtttccctgaaatcgccgaagatttaagcgcccgcgcttcgcttgtccagctcagtttaaccgcttgtctgatcggactgacaatcggacaggttgttgtcggcccgttaagtgacgcgaagggaagaagaaaaccgttattgctatgtatttttttatttgctttgttttctctgttttgcgcgcttgcaccgaacatttcaacactggtgattgcccgttttcttcaaggattcaccgcttcggcgggactcgttttatcccgtgcaatcgtcagagatgtgtttacgggaagagaactttctaaatttttctcgctgctgatggtcattaccgccgtcgcgccgatggtggcgccgatgacgggaggcgcgattttattgcttccgtttgcatcatggcatacgatttttctgtttttaacctttatcgggtttttgcttgttctcatcattgcgctcaagctgacagaaaccctgccgccggaaaagcggattccgagctccatcggaaattccgtgcggacaatgggaagcctgctgaaggatcggtcatttatcggctatgcgctgacggtcggttttattcacggcgggagctttgcgtatgtctccggaacgcctttcgtgtatcaggatatttacggagtatcgcctcaggtattcagtgttttattcggcataaacggtctggcgatcattaccggaagctttatcatcggccgtttcggcgggatcattcacgaaaaaagcctgctgaaaatcggcgtgattacagcgatgacggcgactgccgttctgctcgtcatgacgatcattcacggaccgctggcggcactggtgatttccatttttatttatatgattacgatcggcatgacgctgacaagcacctttacattggcgatggaaaagcagggacaccgcgcgggaagcgcaagcgcactgctcggcatgcttccgcttcttctcggttccatcgtgtcgccgcttgtggggatgaatgaagcgacggccgtgccgatgggggcaattatgttcacgacatccgttatcggttccatcgctttttttgccttaacaacaaaaccggagaaagcaaaaaaggagtgaaatgattcactcctttttttgatgcccgctattcatatttcttcagcacgatcgccgaattatgtccgccaaagccgaatgagttggaaaggccgatcgttaacgattgatggcggggcccgtctgacacatagtccaaatcacatgccgaatcagggtgctgcagattgatcgtcggcgggatgatgccgtgtctcaggctttctgtcagagcgatggcttcaacgccgcctgccgcgccaagcatgtggccgagcattgatttgttggccgtaaccggaatgtcatacgcaagctccccgaataatgttttgattgccaatgtttcagaaagatctccggcttttgtgcttgtcgcgtgggcgcttacgacatcaatgtcttccgctgaaacgttcgcctttttcaaagcatttttcatcgccaggtatgcgcccgtcccttccggatgggaggccaccatatgatacgcgtcagagcttgcgccgtagccgagcacctcacagaggatcggggcgtttctgccgattgcgctatccaatgattccaatactaagatgcccgcgccttcactcatgacaaacccatcgcgatcagcgtcaaacggccggcttgccgcggcggggtcttcgtttctcgctgacagcgcgtgggcattgccgaagctggctaatgacaaattcgtaatcgccgcttccgctcccccggcaaacataatatctgcgtcatcattccgaatggcgttgaatgcttccccgatcgacgtattgccgatggaacacgcggtgacgggagaaagtgaggggccgagcgcgcctaatctgatgctgatttgagcggcggccgcgtttgagatcatcatggggacaaggctcgggctcacttttcgcgctccccgttcatttaaagtatgaacgttatcaatcaaagtcgtgatgccgccgattcccgagccgacgtacacgccgaggcgttcacggtcaatctgatcgagctgaatcccggagctttcaagcgcctgttccgctgccgctaaagcaaactggctgaaacggtcaagccgtctcgcttcttttctgccccatctttcttctgcgtcaaaatcacggacggtgccggctatttttgtcttggagccggagacatcaaacgaatcgatgagagaaattcccgatgttccttccgtcaggtgtttccaaaatgtatgcacatcattgccgagaggtgaaatcactcccattccggtgatcacaactcttttcatggtcattcctccttcggtatgtatttattgtaactcgcaattatcctattacaagttgttgattatcctagtataatgaataccagggtaagagaggagagattcggtatgataccagaaggaagattgcaggcgctctcagagtttttaaaaacgcagcgggccaaaatttctccgcagatggccgggctgccgatgggcacacggagaagaacgcccgggctccgaagagaagaggtcgcgcaattagcaggcgtaagcaccacgtggtatacgtggctggagcagggcagagacattaaagtgtccgcagccgtattggacgcggtttccgatgcgctgcagctcaacaaagatgagagaaattatttatacgcgcttgccattgaggagggcgtgaagcagccgtttgccgcggaggaagaagcggttatcagcccgtcgctttcaaaaatcctgcaggagctccgttattgtcccaccattatctcggacaggcgctgtcatatcgtgggatggaatcaggccgcggctcacgtgtttttagattttgaacaaattcctcctgaaaaacggaatctcatagagctattgttttccagaaaagaattaagaagtttagctgtgaactgggagcactttgtgaaaggattcatcgccattttcagaacgtactacggccagtatgtagctgatacgtggtattctcagtttatagaagaaatggagaaaacgtattcggaatttcatacgctgtggaatgagagcgaagtcagctcggcacccgaagtattaattgagttccgccacgcgaaggcgggaaaaatggtctttaacctgacttcatttcaggttcagggcaacagtgatctgcgctgcagtgtgtatacgccggtagatcataccgaaacggaagcaaagctgaaaaagctcttcgaaaacaggtgaagaacagaaaaaacgggaggcggccgcctcccgtttcagtttaaaataaaagcatgagaccggcgatggccggtgttaaaaagatggctgatttcagaatgactttcggcacgtggttggtgaatttcgctccgacatatgcgccgcacatcgtgccgatcagcactttgaccaacagtatataatcgacaaatccttccgtcacataaccgagtcctccgccgaccgcaagcgggataatgacaagcatggtggtgccgaccgactggcggatggataagcgcaaaagaatcattaagccgatctggatgaaaggggcagagccgatcccgaacgttccggacaagattcctgcgatgataccgagtacaacggctttcacccatatgttcagattgctttgccgtccggaatcttcatgtgtttcttttacaataaataaccggactaaaataagcagagcggataaaaacagcatgcccgccgtcaagtaatgcagcaaatctgcagggataagggaagtaagccttgccccgaaaaacgaaccgaatgccgcaaaaacgccgacgatgaggccgattttcatctgaatattgccttcacggtagtggctgaaagcccccgataaacttgtgaaagccattccggcgagggaggtgcccaaagccgtatgaatcggtacgtgaaacagtatagttaaaagtgcaatgacaaaaccggctccccccgcgccgataaaccctagaataatcccgagaaggaacataacgagtataataagcacaatcttctcctccatttagatgcctgatcaccatgttcagatccgctttatcaggtttttaacaatcgatcgtcgtccgtcgaccgtcgtccattatctttatgttacctcaaatttgagggattggcaagaagccgaatcgcttttatacagagggtttacagctctttcaccatcactttttccccgtttgagtccagctctccattgaataagaagccgaatttttgataaagccgcaatgcgtgcacgttatcttcaaacagacttaaataaatccgtctgcactcatatattcgaacgagatggcggataagggcatcaagcaacagcctgcccaatccacgtccctgataacgttcatcaataaaaaaacggtcaagccacactctgccgttttcattttcctcatcatattccggaaaccatccgtacatggcaaagccgactaattccccgttaacataaagaccggccggctgataatgccggcaatcctcagcatcttgtaagcactcttccgcggtttcaataaatgaagtctggctttcccttacatgaagcgccagtatatcagcacggttttcttccgtgactgctctgatttcaatcgtcatacttgatactcctcttctgctttttctgagacggtaaagctttcattgcgtaagccatttgtgaatcagccttctctcggatacaatgatcatcataaaggatatggttaccgtatagtcaaggaggcattatgagcgaagacgtcagaaaatacttcacaacgggtgaatttgcaaaactgtgccacgtaaaaaaacaaaccctgttccattatgacgaaatcggcctgctttctccggaaatcaaaaaagcgaacggatacagatactattcctatcatcaattcgaactgttccaggttatcggtctgtttaaggaggtcggcgtgcccttgaagcagatcaaaccgctcttaacagacaaaacccctgagggtatcatcacgcttttaaaagagaaatcatcagaaatcgaaagcaaaatcaaaaagctggagcacctgcaaagaatgattcagacaaaggtgaagctgaccgaacaagctttggagacagacttctcctccgtctcattgcagcgattagatgaagagacacttatgataggacgacccgtactccatttgccagaacggcaatacactgcggccatttccgaattgatccgctatatgcgggtacatgaactcgatcaggggcatccggtcggcggactgtttgcgcgggagcagattctgaaaaaagaattctacaactacacccatttttatatgaagacagaagaaggcatagagaataatgacctccatatcaagccgaaagggctttatgccgtcgggtaccaaataggggatgaagcggaagcggcttaccgcagcatcatgcagtttattgaagagtatgggctggaaatgggcgattatgcatatgaagaatatttgcttgatgaggttgtggcggacgggtttgacaatcagatcacaagaatccagctgcaagtccgcaatcgataaagccgatgccgccgttcgtttacgtcttctgacaaaccttgtataatgagaaaaatcagattgcaattgaggtgaaaaacgatatgtttctagcgcccttatttgaacatgatgtaccggcagcacttctccgcccttaatggaggaaagtgactgcgcttctctccgttaaggcatatgacgtgacctaatatgataacggagggtgcatcaaattgaaaaatacattgttcggttcgatttatttggcattggccgccagtatctggggcggtatgtatgtcgtcgttaaagtagtggtagcggtcattccgccgcttgaactggtatggctgagatatgcggtggcgcttttttcgcttttgattctcagtttatttacacgccaatcctggaaagttcataaacgtgatttattactgatcgctgcgatcggattgatcggcaacacgatttcgatcgtcacgcaggaaatcggcacgaaattatcaaccgcgcagatgggtgcgattattacggcatccactcccgcatttatggttgtatttgcccggctgattttgaaagaacggttaacgctgaaaaaaggaatatcgacagggctggcgacgatcggagtattgctcattgtggggaacggagatctcaatatgtcgagccagttcggcggtctctcgcttctggctggggcgctgacatgggctttgatgtccgtgctgatgaaacgggttcccggccattactcaccgcttgtcgtcacaacgtattccatttgcgtcgcatttgtcatcctgaccccgtttacagagggcccgcttcgggagattcctttgtctcagcttgcccggcctgagatatggggcggacttttatatctgggtgtgatctcaaccgcctgcgcgttcatgctttggaatcgcggattacaattgctgaatgcggcaagcggcggtctgtttttcttctttcagccgctttccgggacattgctcggctggctgctgctgggagagacgatcggaggaaccttctggatcggggcggcccttattgtttcaggcgtcgttctcgtcatgaaagaaaaatagaaaatgaaaaaaagccattcagcaaatgaatggctttttctgatttcccggcaggattcgctccgccataaacagaaaacaaggagcagaaacggggtactctcaaggtgcaattcgggtttcgtttaattaacataacgggcggtggaaaaaatggagccaaaatggcttgaatgggcaaaacagcttcaatccgcggcgcaagcggggctggcttattccaaagacatatatgatattgagagatttgaagaaataagaaaaataagcgtggatatcatggcgcaacataccggcatcgacaaaagcatcatcaaagacgtattcgccggtgacacgggctatcccactccgaaagttgatatcagagcggcagtttttaaagatcagagcatattaatggtaagagagaaaagcgacggcagatgggcgctgccgggcggatgggctgatatcgggatttcaccgggcgagaccgctgtcaaagaagtaaaagaggagtcgggaatcgacgtaaagcccgttaaactgttagctgtaatggataagaaatgccattcccacccgccgtccgccgcccacgtttacaaagtgtttatccgatgcgagatcatcggcggccggctcagggagggaacggaaacaagcgcggccggcttttttgcggaaacggaactgccgccgctatctgaagcccgcaatacggaaagtcagattgaaaagatgtttgcatatctcaaacatccggacgaacccgtttattttgattaaggcagcaagcagaaagaaaagggggcccaagtataatggaggattcaattaaacagcaggcgcagcggcaatttgctaaaaacgccgcgaaatatgtgactagtcccggatacgccgcaggagaggatttggcatatctcatttcagcttccggtgccgaaaagcatatggacgtgctggatatcgcgacgggaggcggacatacggctaacgctctcgctcctctcgtacgctctgttatcgcatatgacctcacggaagaaatgttagcagccgctgaagcatttataaccggaaacggatggacgaacgtgtcattcgaaaaaggcgatgctgaaaagatgccgttttccgatgctgctttcgatatcgtcacatgcagaatcgcggcgcatcattttcccgatgtcagagcctttgttcatgaagcgtttcgggttgtcaaaccgggcggcagactgcttctcattgacaataccgcacctgaaaaggatgaatatgaccatttttataatgacattgaaaagaaacgggatcagagccactttcgggcgtggaaaaaaacagaatggcttcgttttctggagacagccggcttccggattgaatccgctgtctgctttttgaaaccatttcaatttaccgtctggtgtgaacgggcaagcctgactgaagagaaagccgcattactggaaaaacagatgctggatgctccttgtgatatacagcggtttttttctgtagaaaaggatcaatcaggccgtattgcgggcttcacaggtgaatcggcctgtttctgcgcgctccgtcccgtctgagacgaaaaaaccgctgtgcagttttcctgcccgcggttttttcgtattatctgttcttgatttgagaaataatagcggaagtgacatcttccgttgaatgttttccgccggcatcaggagtcagaataccgctgtttgtgaccgtttcaatagattgtaagaggagatggcccagttcctcttctccgaatgaatcgagcattaatttcgccgtccatatttggccgataggattggctattccttttccgacaatatccggggcggagccgtgaacaggctcaaacatggaaggatatttgccgtttacattgatgttggctgcgggagcgattccgacgcttcccataatcgccgcgccgatatctgtcagcacatctccgaacagattcgaagcgacaatgacatcaaagcgttcgggctgcgtgacaaagaaggccgccagtgcatcgatgtgctgggaatccgtctcgatcccggcgtactcccggctgacctctttaaagatgtcatcccagaacggcatcgagtgaacaataccgtttgatttcgtcgcgcttgtgacgtgtttccgccgattgaaacaagtttgtttgaatgctgactgagtgagtcaactccttaatcctccctgcaatccgcatactgttgactcactctgggaacgcatcatcacacaggctccctgacatgcagatcgatttccacttcagttttcctttttcattttgcacatttctcctgtaataaaaaaaagcaggccatcgcctgctcattatgtattacttagtcttatctatatttatattttactccagataccttagtagatgcatttgaccacttataaacggtaaccgtgtaagaaatctctaaaccctttttcttagaattagcagttttaaaaggcttaatcatattattagctcctacttgatacattaaaacacttaaaccagtagaagggtgtaccaacccaataatataaccgagaataagccctttattagaccccatgctgttatatctagaaaccacttttttcacctgattttttgtgtaataaacctttaccctttttttaagaagaacatcattatcacactgagtcccaagatttgtccgtcgacaagctgcttcagaacttggagcgaaagcagacaacacagtagcgagaatacaccccgctataaataatttagtaaccttctttaacacttttttctctcatcacctttactccgtttcgcaatgctataaatcactaatgcaccaacgaatatagcaaacaaaacagttaataatacattacttaagtcaaatacagaattaagtaataatactataattatatataatatcaaaaaaagtaaaatatttttttcatattttttacctctctaacttttttgtgtaaagacatatttgcggatgtaagatgccaatagaccatcttaatcgacctgtcttgtaggtgtatcctcttttttcaccacaattaaaggaggggttaccgtttccttgcagttcccctgctgcgatttgacatacaattttctctctctatctctgtaaaaaattgtatcatttctttgtcaaaaccccagccgaacgctgccggttcgaaaacagatcactcattccgtaccccgccgggaaaggaccgcgtattgaatggcgatttcatcttcaccctgatagatgctgctgccgacagagctgtactcaccttcccggacgtttacagatcaaaatcggagatgtagttaccggcgtatcttgatgggcagcccccacagcgaaacatgatcggggacgagtttttgattccccaccgctcccaaaaacaaagcatcaaagtgctgtaacgtttctaatccatcatccggcatcatagtcccgtgctccaaataatactcgcagctccgcggaaaagaagtgaaatcaaaggcaatgcctccatgtaattcggcgatcgcgttcaacacccgctccgcttgcggaacgacttctttccccacaccgtcccccggtatgccggcaatctagtatgtcttcatgtttccgtcacctccgaatgaattgttttcggtttacggaataccctcgaccaactatacttccatattacggcacctccgttatgctgacaagctctggaatgttgcttccatagataaactgttatatgatcttggtaacaataaggcctaaattgtatgaagaggtaggaaagatggataattttaaattagataagccaatcccgtattatctgcagttttattcccaattgaaaaaaatgatatttgacgggatttttaaaccgggtgaacggctgaatgagactcagctggcgaaggatttcggagtcagccggtcgccggtcagagaagccatgcggctccttgaaaaggacgggcttctgacggcagacgatcgaaacggctttgtcatttattctttgtccgttaaggatgttgaagagatttatcaaatcagaatgtcacttgaatcattggcggtcgaactggttattgatgaagcggctgagagtgaaattgacctcattgaaaaacagctgcgggagacggaagaagccatcaataaaggcgtcaaagagactgagattatttccttaaacgagtcgtttcatcggctccttgtggatttcagccgcaacagccggctggccatgctgcttgagcatgtcaatgtgctgattcatttttgcagagttcttaattttaaaggagatgaccgtgcggaggttatcctgcatgagcaccggaaagtctttgaagaaataaaaaagggcgataaaacaaaagccgtgcaatatatgacggagcatctcaagcatgatgaagaacatctgaaaggtgtgctcaaagcgggtgaaacagacgaatcatcacgatagacaaggtgaaaagccttgtctttttttgccgatgtcatcgaaccgtcataaagacctgacgaatgttccttgcatgattttttccgcgtcatttatgatggatatggaagagacgcaaaaaaggcaaaggagtttgaaaaatggcgaaacatattctgatgatcaattttcccgcagaaggacacgtaaacccgactttgggtatgacaaaggccttcagcgaacggggcgatcacgttcattatatctcaacggaaaaatacaaaagcagactggaaggagtaggagcgaaagttcatcttcacagcgatctgctcagaatgacacccattgatcccggcagtccgtccggcatacttgcatttttaaaggttcatatcaaaacgtcactggagattttacatattgtgcagcggctggcagaggacattcaattcgacgccgtctattatgataaatttggtgcgggagagttggtgcgggattatctcaacattcccggcatctcttcttcagcatccttcctgttcaatgaagaccgtctgaaaatactgccgctccatccggaatcgggcgtgccgtttcagccggacagggaatgtgaagagctgttggccgagatgaaagacaaatacggtgtcgcccctgacagcatggttcaatttatgaacaacacaggtgaattgaacgtcgtctatacaagcagatattttcagcccgaaagtgagacattcggagatgagtatttatttatcggtccgagttttccgaagagaaaagggcgcgtcgacttcccgattgactcattaaagaatgaaaaagtcatttatatctcaatgggaacggtgctcggggacacggaagcgtttttcaatctgtgcatagacgcgttctcagattttgaaggaaaagtagtcattgccgccggggaaaaagccgatctgtcgaaaatcaaacaggcgccggaaaactttatcatcgccccgtacgtgccgcagcttgaagtgctggagcaggccgacgtgtttgtcacgcatggcggaatgaacagtgtaaatgaaggcattcattatcaagtgccgctggtcgttattccgcatgataaagaccagccgatggttgcgcgccgcctgactgaattggatgcaggctgtacagtgcaaaaagatgaagtgagcgctgaaaaggtaaagcttgccgcggaagaagtgctgcataacggaaaatacaaacaaggcattcaagccattaatgaaagctttaaagaatgtatggacatgcaggatgttctggcccggatcgaccggtttattgaacaaaaacatgctcaataatacatggaaaaagcctgtttcctctgccaaagggaaacaggctttttataatggcttttagatgatgtgatgttcttcatttgcaagtttcacaagagtcagaagagattctgcctcacgtgcgttgagtgtttttgccagacggtctttttcaaagatctgctggccgaagacattcactgacgcctggtcaaccgccgtgtgccagttcttttgtgaatgattctcggaaaaagagaaaacaaacacggcaaagaccgctataagcatcgccatgacccaaaatttttgccgatttcctgctgctgacataggccgcctcctaacgttcattttactggtattagatcatatatgagctgtttttcatagagtaaagaagtcattatttcaggtagtccaaatgaaacggagcacagccgaaagcccgccggtcaggccgatgagccaattcatattttgttcatattttattaaaagtttatccaagcctgtcctttacagtggatataaccataaaacgctgctgaaaggggccttgaaaaatgcatattcatatgatcaacaaaaaccagtttgagagtgacttggaggcggccggcttcatccgtcaggcagatgatattatcggcaaaatgaaagaatacgtaacggaatacgcctcttcatccgaacggtttctgattgaaattcaaaccgtcatgaacgaatacaaagccgtcatctgtgcgatgttttcgactatggaaattgccggcgcaaaaaaagacgagaagcatgttgagttcgaagcctgcacagtgttgtgcgaataaaagaccttcattaaacctccgcggctgcctgaacggcagtttactgactggtgttccgggaagggaaaatattgaaacttctaaagcggctgttcgtataaaagagtaaatcagcttgtatatggaggttcgtgaaatgaacgataagaaaaaacaagcttttgaacagcttttcagcactttagacgaaagacatgaaataaacggagctgtattggcagcggaaaacggccgcatcttatatcagggttcattcggcgctgcagaactgaaaacaaagaggatgctgaatgaccaatcagtctttgaattggcctcagtatcgaagccgtttacagctttaggcgttatcattttagagcagcgagggaagctgcgttatgacgatatgatagagcggtggcttcctgattttccttatccgggcattaccattcggcatttactccatcatacgtcaggattgccggactatatggagttatttttaacacattgggaccgggacagaattgccgttaatcaagatgtgatcgatatgcttaagcagcataaaccggatgcttatttcccgccgggcaaggagtggctatacagtaatacggggtatgcggtgttagcggttattatagaaattgtatcaggcatgagttttgctgaatttatgaaacaagccgtatttcatccgcttcgtatgcacgatacgcggatttataacagaaggctgagtaaagaaaacattccaaactatgcatatggctatgtgtatgatgttcattccggagaatatgtgctgccggatgaacttgaggaaaccgattatgtcgtctttcttgacgggattcaaggtgacggaaccgttaactccactattagagatttatatctgtttgatcaggctctttataaggaagaaatcatcggcaaagagtctaaagatcaagcgtttacaccgggctattggaatgaagaagagcaattcggatacggatttggctggatgattcaaaacagcgcccaaaaagggaaggttatcagtcacgacggaggctggccgggttattcaactctgatgatccggtatattgaccagaacaaaacactgatttatctcagcaatatggaacaatcgtatcaatttgaacaagctgtgattgccgcggccgtaaacatcttatttgatcagccgtacgtgattccgaaacgtccggcggatcagaaaaaagcagatatcgatcctgcgatttacagcagatttaccggcaattactcatttcaggatgacacacatgcatcggtgacggtaaaagaaaaccgattgtatcttgcaatagacgggcagacaccatttgaattattcccaatgacggaaacccgttattttgtcagggcgctgccgcttgaaattgaatttgcaggtgataaagcacaaactgccccgcatttcgttttatatcaggacggcacagaagaaacggctttgcggatagactgactgacatgcaaaacaaaaccgccgtcctgagaagacggcggtaatagaaaagtcaaacccctttaatgacgcgaaattttcttttcggctctgacataaatatagaagaaaaaatcatagctccgaccattgtgatgtattccatataaagcgaaacttctgccaaaaccaaccccgcaatcattaaaacagcgcccaataccaccgcaaaaaccttcgttttcatgatgagttcccctattatctgataattaaattatactgcatctctattaatgtgtacattttgtgaacaatttcacctgataaaaggcaataaagagagagttgaagaattaggagaaatgacaggccatctttttgttttaccgaagaaacgaaagggaaaatgaaaaatcaaaaaggcaaaggagttcttgaaatgaaagcgagactatttttattcagcatgtttctcctgatccccgttctggcgcttgccggatgcaacggtcaatcttcaggaggaagcgaaaaagcgaaagacaaagaaacgcactctcacgaagacatgaatcactcaggttcatccgaggtgccgaaaggtttaaagaaagccgaaaatccgacttataaagtcggcagtgacgtcatgattttagcttctcatatgaaaggcatgaaaaatgcgcaaggaaccgtaaaaggtgcttatgatacaacggtttacagtgtatcttacactccggaaacgggaggaaagcgcgtcgaagatcacaaatgggtcattcaggaagagctgaagggcgccggtgataaaacgttaaaaccgggtgacaaggccgtgatcgaggcatcccatatgaaaggcatgaagggtgccgaagccgttattgattcagccaaaaagacaaccgtttatatggtcgactatacaccgactgacggcggccaaaaagtaaccaatcataaatgggtgacagaagacgagcttgctgccgcaaaataaaaagaccgccaaagccgaaggaactcctttggcttttttgcggtctcacatttatgcggattttcttttcaaggcaggtctcgttaaagagaatacagctaacgcgacagcgataatgacaatcaaaccgccgcaccaggctgttgctgtgacagaaccggtttgtccgatcacgccgccgccgatggctgacccgagcgcgatgccgatctgcaaagcggacgtgttgaagctttgctgaatatcggaagactcaggcgcaattttgattaaatagctttgctgcgccggcgcaaggctccagctgagcaatccccagatcaccatcgcaggcaggaaaatgattaaagaaaccgttgtcagcggaagaataaacaggatcagagcgaaagaaacggtcacaagcatgatgcttttaaatgctcctaaacggtcatacagccagcctccgaacgggccgccgcataccgctgacagaccgaacaaaaagtagcatacactgacccaaacggaactcaaatgaagcgttctttccaaaaaaggcgcaaagtaggcatagagtgtgtaatgccccgccaatgtaaacaaggtgacaaggtgtgcgctggcaattttggcggtcccgatcgtcttgatctgctcacgaaacggaatcattttttcagcaggtattttttcgaaaaagacgctgataatcagcatggaaatgagagataatacgccgattcccaagaacagaacacgccatccgaaggcattgctgatgataatgccgacaggcacgcctaaagcgattgcggagctgaaccccatgaaaatgatgccgatcgcccgcgctctgtattcaggcgccacgattttaggagcaatcgttaaagaaaggacgacaatcagccctgtgctcatggaagcgagcacccgtgacaccataagaacggcgaaattgggactgaaataagcgaccagattacttaggaagaaaataaacagtgcgattaaataaagccgctttcgttcagcctttgccgtcactgccaaaagcagcgggccggataccgcgtaaccgagcgcaaacacgctgatcagctgccccgcgctgacaatggatatatctaagtcggaagcgatttgcggaagaataccgcccacaattaattcaaccaatccgactgcgatggtagatgctgcaagcagaaatactttgaaattcatgtacagatactcctttttttattttttagaaaataaaaaatcctgattacaaaaagtgtacgggacaatttttgtaatcaggattttacggttcctggtagacaccctcaaaccatatcattgaggttatacaatatattgcaatattcggttgtgtccgtttctgcaaaaaattctaccataatagtgagggagattccatagaaaattcgaggaaatcctttcaatttcaatatcggcggctgtaacgtcattgatgaagcagggaaaaaaatttatgataaccgtaaggagtctatacagatcaaacattacacagccggaggaaaccgatgaataagtacgaaaaaatcgccaacgaaatgagaaagaggattaaaagcagtgtatatgacatagatcagccgatcccggatgaaaagacgctcgctgcggagttcgggtgcagccggatgacgatgaagcgggcgcttgatacacttgcggctgaagggatgcttttcagaaaaagagggcacggcacatttatcattcaatcagccatgcaggatgagcacgttcacgtagtcagcaacgaaattctcggcttgagcaatttgttaaaaggcaaaaatatcaagagcaaggtcatccggtttgaagtgcagtttccgtctcaagatgtcgccgcacatttggctatcgatgaaaagactcccgtctattatgtagtgaggctcagaatcgttgaaggcgaaccgtacgttcttgaaaaaacgtacatgccggcgagccttatacccggcattaatgacgaggtgctcaaccattccatctacgatcatattacgcggggattgcagctcaaaatcgcgggcacacacagaaaaatcagagcgtgcaagtcggatgatatggatcagcaatatctcggctgccggccggatgacccgatacttgaagtcgagcatgtaggctttttggacaacggcactccctttgaatattcattttcccgccaccgtcatgacaagtttgtcgtgacctcagtcaatataaaacgttcataaaagcgccgaagagtgagagaaaaactcactctttttttgttgccgctgatttacatcgtcgcttcttttatgttatattacccaatgatagaatcatcctacaaatttcagaggtgttttgatggagatatccaaaacaagcagactgtcgctcgtagaacaagtggtggcgcaaattgaatcgttaattcaatcggataaatggccggtcgggacgcgcattccccctgagctggatttaatgaagcaatttgatgtgagccgaaacacgttgcgtgaggccattcgggcgctcgtacatgccggcctgctgcagacaaggcaggggagcggtacgtatgtcagctcatccagtgttctcggcgcggcattttaccgccatattaaaaaatcaaatttgcttgaaacattagaagtcagatacgcactcgaaagagaagctgcacgattggcggcggaaaggcgtaatgacgaagacctgaaagcactgaaggcatgcttggatgaatgtgaagcggccttgcaaaatgaagatcgaaaacggtatgccgaagccgacattaagctgcacaaaacaattgtacaggcggcccataacaatatgctttctgatctatacgagcatatgacggaggcgctttgtgcgtcagtccataacctgttggaaatcacccctgctatccggatccacacccagcttgccgccgcgattatcggacagaaaccggatcaggccatggaggccgtcaaccaatacatcacagtatttaaagatacaatacacatggaggatgaacatgaaaattaaagacgaacatcaagttctgcaagcaagtcagcgtaaaaaactgatattgctggtcatcggagtcatattgataggggccaacctcagagcgcctctgacatcggtcggaccgctcgtttcctcaattcgggacagcctcggcatgaccaatgcggctgccggcaccattacgacagtgccgcttttggcctttgcatgtctgtcgccgtttgttcctttattgtcccggcgcttcgggaccgagattgtcttactgtcatcattaattgtcctgacagccggaactctgctgcgctccatcgccggaatcggcactctctttttcggaacgatcctgttgggattgtcgatcgccgtatgcaacgtcctgctgccgagtctcattaaacataagtttcccggaaatttaggcatcatgaccggcgtctactcggtttctatgaatctgtgcggcgcgattgcatccggcatcagcgtgccgatcgcctcttcagcgggggtaggctggaaaggcgcgctcggctgctgggctatcctttcttttattgcgttcgtcatgtggattccgcaaatgcgaggacgcgaactgcccgtccgcacgactgggacaaacggagagaaaaaaaacagtctgatgcggtctccgctggcttggaaggtaacgatgttcatggggctgcaatcccttattttttacaccgtcatcgcttggctgccggaaattcttcagcagaatggactcagctcaagtaaggcgggatggatgctttcattaatgcaattctcagtcctgccgattacttttatcgtgccgatcgctgccgctaaaatgaaaaatcagcgcgcactcgccggactgacggctttatttttccttatcggcattgccggcgttcttttcggaagcccggctctcactccgctatgggtcattttgatcggaattgcgggaggctgtgcgttcagtctggcgatgatgttcttcagcctgcggacccggcatgttcatgaagccgcggcgctttccggcatggcccagtcattcggatacctgcttgccgcgttcgggccgcttgtattcggtttgctgcatgacatcacgcacggctggacggttccgttattcatgctgatcgcagtctctgttctgattttcattttcggagtcggagcgggaaaagcggaacagatcaaaacagcataaaaaaacaaaggacccgtttagggtcctttgttttttatttaaaaagctgtctcaggccgttacgctgtcagttttaagccgatgacaccgatgaggataagccccagagacaccaattgtgacagattgaatttttctttaaaccaaagtatgcctacggccgaaacgccgatgcttcccatgccggtccaagccgcatacgcgacacctgtgggaagaacctgcatcgctccggaaaggcaaaagaatgaaagcataaagcctgttaccatgacaatcagcggccacttttttttaaaaccgtcaatatgtttcatggcaacggccgctacaacttcctccgctccggcaataaataacagcagccatgccattaatgttcaccccttgtttcagtttctttcgtaaataccttcattcctaaaatgccggacaacagcaaagccaaaaagaatatttgtccgattgaaaacgattcgcctaaaatgacgcccgttacatatgtgccgacggtgcctattccgacaaaaacggtatatgcggcagccatcggaatttttttataagagcggatcagcatcagaaagctgacggcaatcaaaaggaaaataccaatccaatcaaagagcgaatccgcatgcttcagggcggacgcccaaactacttctaacaatccggctatcaatacaagcagccaatacatgatacagtcacctcagttatgaatgaatgtcagtcatttttacggcggtcaaaaatgatcggtctccgccaatcatttctgcaagcttcttttgagaaagctgaatatttcttttttatatacttcgagatcgacatcctgttcacagccgatataaaaccgttcagccgcgttctcgacaacgttgataatcgttctggccgtccatctgacatgaatgccgctgatgacctcaccctgttcaatggccgtattgatcatgccttccagccaggaataataaggctgataaatggcttcccatttctccattgaatgatcgatggcaagaccggaataacagagaacgataatatctttatgaagccgggtgatgtgaaatgtctcatctaccaaaatgtccagcaacgtccaaaaatcttcagaaccgtccgttttcccttttattctgtccagcgtagtgtcgagcaggttttctgcaatcgcggatatcagtgcgtttttagaagaaaaatataagtaaaacgtaccttgggccgttccggcttttttgacgatttctgaaatggatgctttgtctaatcctttttcagaaatgacttcaatcgcggcttgcaggatcttttcgtattttcccgagctttgttttgccaatagaggggttcctccttttatgaatgactgtcattcattttatcgcatgttcgcttttttgtcatcccttaacataaaaataccggaaagaagaccatacttctttccggcattcgtcatttatcactgtcgatcatagccttcggcagacctgtatattttgcccagtaataaataccgagcgaaccgatggcgatcagaatcaggtcaagcggattgctgataatgcccaatccgtggccgaacgagccgagataggagaaaatcagcatcatgacataaaagccgacgatccaccatgctgatttcagctgctggcgtatgctgacatcatctttgggagcatatttactgaaacagagatagatcagaaacatgacaatttgagaaccgagaagccaggatacggtgcgccatccggaccaatatacaatataagaggtaaaaataaacgacagcggcccgatgatgctcatcccttttaaataaaacggtctgttaatgttctttgcgttgactctcagcgccgcagaagaaatcggcgcaatcgcataagacagaatcaatgcgacggagcatacgttaacaagagcgttccaagaagggaacggaagcgtccaaaaaacagccagaccgaacgaaagccaaagggaggcacgcggtgtcccggtttctttattgactttagaaaaaatgctgaataatgttccgtttctggcccaggcatagacgagacgtgaagtcgtattcataaagatatttccgttaccgcccggtgataaaatcgcatctaaaatgaccaatgtcgccagccaccccaaaccgagcaagacggcgatatctttgaacggaagggagaattcagtcccgatagccggccatccgtgcttcagggtatccccgggatcgccccgataaaagtgagctgcagcacggtataaataatagtagaaacgataatacaaacaatcaatgcaatcggaatgttccgcttcggattctgcacttcactcgcgacagccacaatcggatgcagcccaaggtatgcaaacatgacgccgcctgtggaaatcgcggcctgaattccggtgaaaccaaaaggcgcgaatccgtgaacggtcatattgcccgggtgaaaatgaaaaatcagtacaacaattaccgtaatcggtacgacatatttaaaaatcgaaataatgaagtttgctttcgcaaaggttttgacactccagtaattgaggaggaagaacaggcagagcagcgcaaattgcaatatccatccggcaattgtcggagaatcagagccttttacggtcaaaccgggaaaccaatacgccacgtattggcggaccgccgttacttctatagaaataagactcgtgtatgccacaatggtgacaaaggaaattaaatatccgaccaggtgtccgtgtgaatatacgggataccggataattcccccggtccgcggcagcgcggcgcccagttccgcataaaccaagccgatcaataagatgattcccccgccgatcagccaggaaaaaacgcctgacgggcccgctttagaggcgacgttactgacggcaaacagccatgccgaaccgaatatggctcccatgccgattaaaataagatcaaaaagtgacatagttttctggaagtttccttgcttagacattcgctgcctccttaaaaaagacattgttctctttacataattcccattatcattcaaacatacccagccggccggctggaaaattaggacaactttcgaaacgaagtatgtacagaaatgtgctcacatcaaaatcacggccgtatggcaagatctcccggcttatattccccgttttgaacacattcaaacctcatattcagaaaaacaaaaaacgcccgaaacaggcgttttttgttacaagttcatatctttcagtccggggctgtgctcattcggaagctcgggaagttccggcacggggaaacctttaggaggctctgacacacttaattcgccgccgtttcggctcggcgtcgttccctgcagaatttctccgatccgtgtcggatccagtctgaaattaaattgggtattatgataacccatttcaacgaatttccggcattccgggtatttttcaatatcataattcggcacgggaaataatttgccccattcgacacccagtgtttccagcgcttttgtaaatgcattttgatgggcgttgtcacggacgatcagaaaaccgagtgtttctctgaacgtctggtttgagctcatttcataaatgcgcgtcttttgcagcacgccggttgattccagcacgacattgtccaatagatcggaaatcagattcccgtggttgtatacccaagacccgttccatggattgccgcttgcatcggcaggaagagaactttgcgccccgataatataatggtgcggattggcgtgtttaaccgcttcgtctagcggcgcctgatctgctgcctgatttccggcgccctcagcgccgctttcatccagcagcgcattaatcgtatgctggacgagctcaacgtgtgcaatttcttctaaaaatacgccgcgaagcaggtcgcggaactgcttttcttttcctctgaaattagagctttggaaaaagtattgcatcatcgtccgcatttccccgtaatgcccgcctaaaatttcctgaagcaccttggccgcggccgggtccggcttgtccggtttaatgatattgatcagctcttctttgtaataatacataaacagcgcccctgaaagaagttttcggttcttctgttagtgtctttgcaaagtcagtttttatgtatcggcatcaaaaaaaggacggaaagcgtgtccgtccttttgtgttaagcctcaaccgccccgcgaagtttcgtgttgacaagcccgttccatccttgatccatcgtactgtgaatctcggagcttttccgattgactttattgatgacggcttccggctctttccatccgccgtgaatgagagtgaattccgtatctccgctttccgtttcctttaagacaaaagagacgatccagccttccgtatcccacgaaaaagaaaggcggtacggcgcttcaatatccagcagcttgcacggagacggaccgaacggagattccagctgaaactcactgtcttcttgaggcgtgaaatcattcggcataaaccagagagacaggccgtccgccgtagagaccgtatcccagacaacttgtatcggcgccttgaaaacggcggtatgaataatgtccggtaatggctgattgctgttgttgtttttgttatctttgttttgtttatcagacatgatgcgtaaccactctttcgctgtttttacttttgatcatactacacagggcaggacatttgaaaacaaatcaaacttattttatgcttttccaaagccattcaattcattttaaggagacgtagtgatgacagatcaatttaaagcgttagtagtcgatcagcgtgaagaccggttttcagtcagcgtacgggagctggcggttcaggaccttcccgagggtgaagtgctgattaaggtttgctactcaggggtgaattataaagacagcttggctgccattcctgacggcaagatcgtaacctcgtatcctttcgtgccgggaattgatttagcgggaatcgtcgtttcttcagatgacgcccgttttaaagaaggggacaaagtcattgcgacaagctacggcataggcgtttcccattttggcggctatagcgggctggcccgcattccggcagattggatcgtgccgctgcctgaaggtctgacacttaaagaagccatgacgatcggaaccgccggcttcactgccgcattgtccgtccagcgtcttgaagaaaaccatgccgctcctgaaaaaggaaaggtgctggtgacgggagcgacagggggcgtcggaagctttgccgtctccattctttcaaccttaggttatgaggtcgaggccagtacgggaaaagaagaagaaagcgggtatttgaagagcctcggagcaaagacggtcattcaccgcgacgaagtgtataacggcacgttaaaaccaatgcaaaaacaaaaatgggcagcggccgtcgatccggtcggaggtgagccgcttgcttcagttctcagtcagattcagtacggcggatcagttgctgtgagcggactgacagcgggaacgaaactcccggctacagtctttccgtttatattgcgcggcgtcagtctcttgggaattgattccgtattctgtccgatggagacaagaaagaaaacatggcagcgtttagctgatgacttcaagcctgcagatctggaggcctttattcaaaaggaaattacacttgaagagctgccggatacgcttcctgcccttttaaaaggagaagcgagagggagaacgattgttacaataaacgaagaataaaacaaaaacccccaatcagcagttgggggttttcaatatgtaatcaattattgattataataggggtaattaattgagtatattatggaaataaattgatataaaacgaaaattgattatatataggtgatataaaggtgagttataaaattttctgaaatatttattgactgaaagcgcttttaaaattatgatattaacataagtaccaataatatcattataacttcactacaaagtaactataaaataacaatatgacgagagggggagagcgaataatcactataaatgataacgctttcggaacattttcttcttatataactgttttggacggtcagaccttgtatgcagacgttagaggtgtaaatattgataactgaatattccgatattatctctgtgtaaaaactaggaggatttgaagatgaataaaaatagcagccagcattcatttttgagaaccatcattttagtatcgacattcggggggcttcttttcggctacgataccggtgtgattaatggggcgctgccgtttatggcggaagctgaccagcttaatcttaccgctttgactgaagggatggtggcgagctccctgctcttgggcgctgcgatcggcgcggttttcggagggagattgtcggactataacggcagacgtaaaaatatccttatccttgccgttttgttctttatagcgacgcttggatgtacactggcgcctaacgtatcggttatgatcatctcccgttttctgctggggcttgccgtcgggggagcatccgtaaccgttccggcatatttggctgaaatgtcgccggcggaaagccgagggagaatggttacccaaaatgaattgatgattgtaacgggccagctgcttgccttcacgtgtaatgctatcatcggcaatgtgcttggtgatacctctcacgcttggcgttatatgctcgttatcgcggcccttccggcggtattcttgtttttcggtatgctgaaagttcctgaaagtccgcgctggctggtttctaaaggaagaaaagaagatgctttgcacgttctccggcgaataaggaatgaagagaaagcgaagtctgagctcgctgagattgaatctgcctttcataaggaagctcagatggagcaggcgacctttaaggatcttgccgttccgtgggtgcgccgcattgtgtttatcgggatcggaattgcggtagtgcagcagctcaccggcgtgaattcaattatgtattatggaactcaaattttaaaagatgccggttttgagacaaaagccgcattaatcggcaatatcgctaacggtgtgatttcggtgctcgcgacttttgtgggaatatggcttctcggcaaagtcggccgccgcccgatgctgatgacggggctgatcggaacgactgcggtgctgcttttgatcggagttctgtctgtcgtgctgaaaggatcgcctgctcttccttatgtggttctttcattaacagtcactttccttgcgtttcagcagggggctgtctctccggtgacctggctgatgctgtcggagatattcccgctgcgattgcgggggcttggtatgggggtgactgtcttctgcctctggatcgtgaacttcattgttggtttaacttttccggtcatgctcgcaaacatcggattgtctgcaaccttcttcatttttgtcctgttagggatagcgtccgttatatttgtgaaaaggttccttccggaaacgaaaggtctttcgctcgaacagcttgaacaaaacttccgtacctatgaaaaaacagatcgtaatagcgcagaagccgaggtgagcgggtaatctgaatagacgcggggttcctgggaatcctgctttttatttattatatagaagggaataataagcggaaaaaaagtttcgtaaaagtgttgacctaatttaaagtgcgtggtatattattaaacgtcgctgatgaacaaagcgataacgacaaatgagaaaatgatctttttaaaaaagactttacaaattctcgaaagcgtgtataataaatgaggtcgagaaaaaagacttcgaaaagaaataaaataacacttgacatcataactgattggtagtatgatagttaagtcgcctgataagcgcccgtagctcaattggatagagcgtttgactacggatcaaaaggttaggggttcgactcctctcgggcgcgccaattcaaatgcgggtgtagtttagtggtaaaacctcagccttccaagctgatgtcgtgagttcgattctcatcacccgctccattataatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaat

SEQ ID NO: 2 - DNA, 1000000 bp, Bacillus amyloliquefaciens
tattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattcgattcttcgagatattgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatgggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcggggtttccccctgtgagagtaggacgccgccaagcttttctaaaattttatcatcgcggggtggagcagttcggtagctcgtcgggctcataacccgaaggtcgcaggttcaaatcctgcccccgcaaccaaaaattaaatggtccggtagttcagttggttagaatgcctgcctgtcacgcaggaggtcgcgggttcgagtcccgtccggaccgccatttttattgtaaacgaaacgatcatgttttcgttttttttgtgttttcttttaatgctggcagcttggtatctaaccaagctttcttttatatcgttaaagtcttggatattgaaacataatccgatacactagaaagagctgtatttcacaagagcgtcagaaaggaagacgggagatatatggatgagtttgatttgattcacagtattacaccgcattcgcattatcatccttccgtcgatgtagggatcggtgatgatggtgcggtttatacagcgtcaccccacatgcagcaaattgtctgccttgatacaatggtggagaatgtccattttaaattagagtattcctctcctcatgatatcggttataaggcgcttgctgttaacattagtgacgtggcggcgatgggaggcattccgaagttttatttggtgtctctagcggttccttcttgctggcagaaagctgacgtccaggcaatgtatgaaggaatggcggaactggcgaaactatatcaaatggatttgatcgggggagataccgtctccgcttccggtcaagccgtaattaccgttactgtcatcggagaagttgagaaggattgcgcttgtctgcgaagctcggcaagacccggggatgttgtgtttgttacgggggatatcggctcgtccgcagcaggactgtctcttttgttgggagaaacacatccttctgcttttcatacgagtgattattttatccaaaaacataaacggcccgttccgagagttcaagtcggccgcttctgctctcagcttcagcgcgcggctctgaatgatatcagtgacggattggccagtgagctgcatgaaatagctgcggcaagttcagttacgatagaaattgaagaacaacttctgccggtgcatccggatttgcctgaggcagattctgagtggaagaaatgggtgttattcggcggtgaagattttgaattggttggaacggtttctcagcaagagtggacctctctgcttgattactgcactcaatcgggcattccgattgcgaagataggggcggtatctgaacggaaggaagcatgtgttcttttgacagccaatgatcagagacaaatcgtccttgagaaaaaaggatacaatcattttaaataagacgggtgactcactttgaagacattacaatggagaacgaaaaaccccgaagaaacgaaagccgtagccaagcttgccgcttctttggcaaagccgggagacattttgacactggaaggcgacttaggcgcgggaaaaacgacttttacaaagggttttgccgaaggactgggaatcacgagagtggtaaacagcccgacttttacaattataaaagaataccatgacggttcgattcctctatatcatatggacgtgtatcgtatggaggatgaaagcgaagacttagggcttgaagaatattttgagggacaaggcgtctgtttaattgaatgggctcatttaattcaggatcagctgcctgctgaacggctgcagatcgtcatcaagagagccggtgatgaggcaagggacattacctttacggcttgcggaacacggtatgaaacgctttgtgaggagataaataaacatgacaatactggcaattgatacgtcaaattacacgctgggtgccgcgctcgttcgagagaaaacggtgatggcggagtatattacatatttaaaaaagaatcattccgtgcgggcgatgcctgctgtcaattcattgctgaaggattgcggcctaacaccgcaggaccttacgaaaatagcggtggcgaaaggacctggatcgtacacaggtgtcagaatcggtgtgacgctggcaaaaacattggcatggtcgctgaagcttccggtttccgctgtctcgagcctggaggtgctggcggctaacggacggcactttcaaggactgatctgcccgttatttgatgcccggcgcggacaggtatatacgggactttatgaatatcaggacggccgcttacaatccgttcttcctgatcagaatgtgcttttgactgattggctcgacatgctgaaagaaaaagcgtctccggttttatttttagggcatgatacagccattcatgaagaaaccattctgcatgggctgacaaatcaagcagtgataggaacggctgcacagcataatccgcggccgtcagagctggcgtttttaggcttggaaaaagaagaagcggatgtccacagccttgttccggattatttgcgtctggcagaggctgaagcgaaatggatggaatctcaaaaatagggtgatagggatgaaaacgaaaacggcgattcgaagcatgcggccggaagatattgatcaaatttatgaaattgaaacagcatcctttacttctccgtggacgaaggattcattttatcatgagcttttggaaaatccgtatgcccactaccttgtcattgaaaaggacggctgtctggcggggtattgcggaatctggattattatagatgacgcgcagattacgaacatagccattaagccggaatatcggggccaatcgttgggagaagcgctgtttcgctctgcgatagaattgtgcagagaaaaaaaggcaagaaggctctctctcgaagtcagggtctcaaatcatcccgcccaatccttatataagaaattcggtcttcaggccggaggaatcagaaaacaatactatacagataacggggaagatgcgttattaatgtgggtgacattacatgagtgaaaaacaagatatttatgtattaggaatcgaaacaagctgtgatgaaactgcggcctcagtcgtaaaaaacggaaaagacatcatttcaaacgttgtcgcttctcaaattgaaagccataaacgtttcggcggggtcgtgcctgaaatagcgtccagacatcatgtggagcagattacccttgtgattgaggaagctctttcaaaggcggagatgggctttgatgatcttgatgcgattgccgtaacggaaggacccggacttgtcggagccctgttaatcggggtcaatgcggcaaaggcgttaagctttgcccatcaaataccgttagtcggcgtccatcacattgcgggccatatttatgcaaacaggctgataggagagcttcagttcccggcgcttgctttggttgtgtcaggcggacatacggaattggtttatatgaaagaacacggttcattcgaggttatcggtgaaacgctggatgatgccgcaggcgaagcttacgacaaagtggcaagaacgatggggcttccttatccgggagggccgcagattgataagctggctgctgcgggaacggattccattccgcttccgcgtgcgtggctggaagaagggtcttacaatttcagcttcagcggcctgaaatcagccgtgattaacacgcttcataacgcctcgcaaaaaaatgaggtgattcctccggaggatcttgccgcaagctttcagcagagtgtcattgatgtactgacggcaaaaacctctaaggccgcgaaagaatacagggttaaacaagtgctgcttgcagggggcgtagccgctaacaaagggttgagagccgcactgcagcaggaattcagccattcgggagatcccgagcttgtcatcccgccgctttctttatgcacggacaatgcagcgatgattgcggctgccggaaccgttgcttttgaaaaggggatccggggctcgtacgatatgaacggacagcccggtttggaattaacatcctttgatcgtctcacgttgtaaaacgtgaggcttttttttacttattaacagataattctaacatatccacaggattgtgaatatattcagaaatccagtctggataagggactgaaagttgttagtaaagtggataaagtcagaaaattttgtggatagtgtgtataaaacgcttacttaaatggctgacaaggaggatagctgtggataaaaaagcaccccttaaagaggtgcttgactttttctattcttctgaggagagttcctcccattctgctaataagttttcgagcttttgattctgggcttcattctccgcgtgaatggtctgtactttttcatgatcctgatacacgtcaggatcgcacagcagctcctcattggcactgattttctcttcggcggatgagacggccgcttcgatttcttcaatgcgtctcaggcgctgccgttctttcttcttccattctttttcttcctcgtaagttcttttcgtatcctgtttgaccttgccggcaggctgagtctgctccttttcctgccgcttcatttcttccagttccagctgctgtgcttttttctcggtgtaataatcatagtctcccaaatattcttctgcatgatcaggtgacagctccagcactcttgtggcgatcctgttaataaagtagcggtcatgcgatacaaataacagtgttcccgggtagtcgatcagggcgttttccagcacctctttactgtccaggtcaaggtggtttgtcggctcatcaaggatgagaaagtttgctttttgaagcatcagcttggcaagcgcgactcttgctttctccccgccgcttaacgaacggaccggtttcaggacatcgtctccgctgaacagaaagttgccgaggcatgttctgatttctttttccggcatgtccggatattcatcccacagctcgtccagcacgcgtttggacgatgtcagttcagcctgctcctgatcgtaatagccgattgtgacattggaaccgtacgtgatcgacccggattccggactgattgtattcataatcgttttcagcaaggttgatttgccgattccgttcggtccgacgagggcggcgctttcgcctcttgtaatgccgaaggtcaggtttttcaagagcggcggctggccgtcatagctgatggaaagatcctgtacgcgcaggacgtcgtttccgctctgttttgtaatgtcaaaacggaaggcggcggatttctcatccccgagcggctttgccatgacgtccatccgttcaagctgttttcgtctgctttgggctcttttcgttgtagaagctctggccagattgcggtcgacaaaatcttgaagcttggcgatttcgtcctgctgtttttcatacagcttcaggtctttctcatactgctcagctttttgttctaaataggcgctgtagttgccgaggtattttttgctttctgtccgtgagacctcgtacacttggctgacgactttatcaagaaagtatctgtcgtgggaaacgatcaggattgcgcctgaatatccctgtaaataatgctcaagccatgtaagcgtatcgatgtcgagatggttcgtcggttcatccagaataagcagatcaggctgggtcagcagcagttttccgagcgcaagccttgttttctgaccgccgctcaggctttgcactttcacggaatcgtcaaattttccgaagccgagtccgtgaaggatagatcggacgtccgcttcatattgatagccgcctttatccttgaaatcctgctgaagcctgtcataggttttcatcagcgtttcaagctccgcgggggcggccgtggccatcttttcttcaatagagcgcatctctttttccattgctttcaggaaatcaaaaacgctcagcagttcttcttttatggtaagctgggattccaagcctgtgtgctgggcaagatatcccatcgttaattctttcggtttgattaattcacccttttcatatgaaaggtgacctgcgataattttaaggagagttgatttgccggctccgtttctgcctactatggcgatgcgatcccgagatctgacttcaagctttatattgtttaaaataggatcagcgccaaaagatttggatagctgattaatttgtaagatcatcatattatttcacctctgttataataagttaagtgtagcttatcaacctgctgtcagcaaacaatacatcagaattggaacattataggataagacatcagggagaaaatagtgtatgatcagaagtaaggagagtttaaatatgaatggattttctcattttaatgaagaaggccgtgcccgcatggtggatataagcgataaatcttcaacagtccgtactgccgctgcgatatccagcgtacacatgaagcatgacgtgtacagcagaatcaaaaaccgcgagatcggaaaaggagacgtgctggctgtcgcacaggtggcaggaattatggccgcaaagcagacgtcagcgattatcccgatgtgccacccgctttctttaagcagcgtcgacatttcattcggctgggaggaaaaggattccgaagccgttcttcatatacaggcaagcgtaaaaacgaaagggagtacaggtgtggaaatggaagcgctaacttccgcttcagtctgcgctttgaccgtgtatgacatgtgcaaggcgctggataaaggaatggtcatcggcccgacctgcctcatggaaaaaacaggaggcaaaaacggtgattttaaaagagatgcatctgagtataaagtggaggaccaatcatgaacaaggatcaatcaaaaattccacaggcgacggcaaaacggctgccgctttattatcgctttttaaagaatttacacgcgtcaggaaagcagcgcgtttcatcggctgaactgagcgatgcggtaaaagtcgattcggccacgatccgccgggatttttcctatttcggggcgctcggcaaaaaaggatacggctataatgtggattacctgctgtcatttttcagaaaaacactggatcaggatgaaacgacgaacgtcattttgatcggtgtcggaaatttagggacggcgtttcttcactataatttcacaaaaaataataacacaaaaatatctatggcttttgatgtgaatcagagtaaaataggaactgaggtaggcggtgtgcctgtctttgatcttaatgatttagagcttcacataaaggatgaacccgtggcgattcttaccgttccggcggttgccgcccagtcaatcaccgaccggctcgtgtcactcggaatcaagggaatccttaactttacgccggcccgtttgaatgtgccggatcacattcgaattcatcatatagatttagcagtagagcttcaatcattggtttatttcttaaagcattattctgttttggaagaaattgaatagcgaaaggaggagctgcacatgatcggtcctggaagcctggcggttatcggtgtggtggcggtgattattttcggtccgaagaagcttcccgaattaggaaaagcggcgggggacacgcttcgtgaatttaagaacgctactaagggattagccggtgaagaagaggaaaaaaagaaagaagaacagtaagataggatgacgcgtatgagagtgaatcaaatgacgcttgtggagcatattgccgaacttcggaaacgattgctgattgtggcgttatcctttacggttttctttattgccggcttttttctggcaaaacctatcattgtgtatcttcaaaaagccgatgaagtaaaagagctcacccttaatgcttttaacctgacggatccgctgtttatctttttgcagttcgcgtttatcatcggcatcattttgacttcgccgattattctctatcagatttgggcgtttgtcagcccgggtctgtatgagaaggagcgcaaagtaacactcagctatattccgatttcgatcgtgctgtttgtcggcggtgtgtcgttttcttattatattttatttccgctggtcgttgattttatgaagcgggtctcgaatgacctggatgtcaaccaggtaatcgggattaccgagtactttcattttctgctgcagctgacgattccgttcgggctgctgtttcagatgccggtgctgatcatgtttttaacgagactcggtgttatcacgccgaggtttttatcgaagatcaggaagtacgcatattttgtgctgctcgtgatcgccgcgatgattgcgccgcctgagctgctgtctcacttgatgattaccattccgctttgcattttatacgagatcagtatcctgatttcaaaagcggcgtatcggaaaaggcagaccggcagtgaatctgaccaggacgtatcagcataaaaaaagccatttctcaatgatgagaaatggcttttcttttattatttttggtttttcttcactttaaatgagaaggcgaacattttaaacgagatgctgatattataagcggcgaaaaccatcagcagtatggaataaaaagaccacatgcttcccggagagcttgcggccaaatacgtaaagatacagccgactgcgaaataaatcaagccccaagtcattgggttcctcatacaaacaatcctccaataattaattgcatttgctcactatgctgttcaatatatttttgggcggggccgagctgcatgaccacgacaatggtattcatcatgacatgggcgaatatcggcacaataatccgtttcgtctgcacatacaagaacgcaaaggtaaagcccatggccgtatacagcagcaggtgcgtgaggtcttgatgcacaatgccgaaaatgacggaactgatcagtccggcgataaagaaattcgttttttcatataatacaccgaagatgatcttccggaaaatgatttcttcaagaatcggcccgacgatagaagaaacgataatcatgagcggcatggctttaataatgttaagaatggctttcgtgttttcggaaccgctgcccacatgaaagacatactgctcaatcatcccggcgattccctgagaaaataaagcgagccatattcccgcgaccgcccagagaacggacatgccggcggatgctttcttcccgtttcttaatgtctgtttcggcgcggttctcaaaatcaagagaacgataatcaggcagataaaaaagcttacgacggaataaatcccctgagccatggtgagattcgcattcgtagggtgcccgcccgcatagccgaatttgtacattaaaggaatgccgatcaatgcggaaagctgcatgataacatatgtcaaaatgatataccaatactgttttctcaaatgatatgtactcctttatcctataaaatcaacttatttgttcttattgtaacacaagtgaacttgacgtgaaaaaaggagaaaatcagtgcgagagagaatcatgtaagcgtgaaaattttttattcttatgacttgaaattggaagtgagattctttattataataactgtgttagcactctttagagctgagtgctaaaattacatattcatactattgaggaggttattacattgttaaagccattaggtgatcgcgttgtcattgaactcgtagaatctgaagaaaaaactgccagcggaatcgtattaccggattctgcaaaagaaaagccgcaagaaggcaaaatcgtggcagccggttcaggtcgcgtgttggaaagcggagagcgcgttgctttagaagtaaaagagggcgaccgcattatcttctcaaaatacgccggtactgaagtgaaatacgaaggtactgaatacttaatcttacgtgaaagcgacattttagctgtaatcggctaagcaaataaatatttttaaaaattcgaggaggtttcgttaacatggcaaaagatattaagtttagtgaagaagcacgccgcgctatgcttcgcggtgtcgatgcgcttgctgacgctgtaaaagtaactttagggccaaaaggacgtaacgtggttctggagaaaaaattcggttctccgttaattacaaatgacggtgtgacaatcgcaaaagaaattgaacttgaagacgcgtttgaaaacatgggtgcgaagcttgtagctgaagtagccagcaaaacaaacgacgttgccggtgacggtacgacgactgcgactgtacttgcgcaggctatgatccgcgaaggcctgaaaaacgtaactgcgggagctaaccctgtcggcgtacgtaaaggtatggaacaagccgtaaccgtggcaatcgaaaacttaaaagaaatttctaagccgatcgaaggcaaagagtctatcgctcaggttgctgcgatctctgctgctgatgaggaagtcggaagccttatcgctgaagcaatggagcgcgtaggaaacgacggcgtcatcacaatcgaagagtctaaaggcttcacaactgagcttgaagttgtggaaggtatgcaattcgaccgcggatatgcgtctccttacatggtgactgactctgataagatggaagcggttcttgacaatccttacatcttaatcacagacaaaaaaatcacaaacattcaagaaatccttcctgtgcttgagcaagttgtacagcaaggcaaaccattgcttctgatcgctgaagatgttgaaggtgaagctcttgctacactcgttgtcaacaaacttcgcggcacattcaacgctgttgccgttaaagctcctggcttcggtgaccgccgtaaagcaatgcttgaagacatctctgttcttacaggcggagaagtaatcacagaagacttaggccttgacctgaaatctactgaaatcggacaattgggacgcgcttctaaagttgtagtaacgaaagaaaacacaacaatcgtagaaggcgccggcgacactgaaaaaatcgcagctcgcgtcaaccaaatccgcgctcaagtggaagaaacaacttctgaattcgacagagaaaaattacaagagcgtcttgcgaaacttgccggcggcgtagctgtcatcaaagtcggcgctgcgactgaaactgagctgaaagagcgtaaacttcgcatcgaagacgccctcaactcaactcgcgcagctgttgaagaaggtatcgtatccggcggtggtacagcgcttgtcaatgtatacaacaaagtcgctgcagtggaagctgaaggcgatgcgcaaacaggtatcaacatcgtgcttcgcgcgcttgaagagccgatccgtcaaatcgcacacaatgcaggacttgaaggatctgtcatcgttgagcgcctgaaaaatgaaaaaatcggcgtaggcttcaacgctgcaaccggcgaatgggtaaacatgatcgaaaaaggtatcgttgacccgacaaaagttacacgttcagccctgcaaaacgcagcttctgtagcagcaatgctcttaacaactgaagccgttgtcgctgacaaaccggaagaaaacgccggcggcgcaggaatgcctgacatgggcggcatgggcggtatgggcggcatgatgtaatcaaacggaaaaaacccttgatacaccaagggtttgaccgtttttcatcaccccaattaaccgaaaaaataacaaaaaaataacatttctttatgaaatcccgaaattgaggatgtttccaaaagtctgctggactttgtgggaggcatcctctttcatttttttggttacatgagtataaatcttcatcgttgttttcatgtcgtcatgcccaactctttccattacagttggcaagtcaacttttgcctcggccagcatgctgatatacgtgtgtctaaatatatggggagtagcatgttttttaattgatgttttttccagtattctttccattcttacaatgatattttttggtaaaaagggatagccattctcacgagcaaataggaaattaccgtcgtggtattcgcttggatcaatcctggactgtaggcgcaacttcttttgtttggttacatgtgccttcaatatatctattatctgatcgtcgagagtgatagttcgcaccgatccggctgttttcggcggagttaattcataatttctcatattgttatcttcggaatatatggttttagtgatacgcagctcttttgtttcaaaatttatatcaggaagtttgagggcgcacatttcccctgaacgcatgcctgtaaaagcgagcaagtaaaatcgttcaaggtccatttccaaaccatggacttttactgctaagaggaactcttcaagttcttccctttcaagatatttttgctctattttactactttcaatatcttctactgtcattctctttttaggaactacagcgccagccactggattatcttttaaaagcttcacctttacagcgtatttaaaaatcattccggctgtcgtatgcacaccactaatggtggtacgggcatattcttgatcagtgagatcgttgagtattttttgatattttcttcctgttacctgagcgatattgattttagcgatataccggtttaagatgttaatttctttccttcgaatacgcagagttgcttttttctttcctgtgagagcatattcgttcaaccattcggcagcaagcttttcgaaagtcatttttttaacaactgattcatcaatgccatcttcttttaaggcatcaatagcatctctaactctttgttcagcttctttttttgttttgccacgccgcgcaatttgtttgcgtttaccggtaacgggatcacgaggtccgtcaccaacagccagccattttttacccttgatcaattcctctgtatacattttgtcaccccaatttttcaatgaatagttttaaagagctgtttatacatcaagaatgagaactgttttcttgtatacatatcgagccgtttagcagcaaattgatatgtaacattaaaggtatcacctattaattttataacctctgatttcatgcgtggcaacgaaatcttttcaagcataaaactaggtacacagaaatgatacataaagctattagcctgatactcttgcaactggcgaaacatacgattcatgttgaactggtttccgcaatgtttaatcacatgccctagctcatgaacaaagtcttgccactgttcttgcggagaggctcgagcatcaaggacaacgctatactcaccgttaatttgaaacatgcagctttctctttgctcataatgcagccagatacgaaatgccgcggcaatcctttctaaatcaatgtcttcaggagtctcaatatttaatttgtaatagatttttttcacttcttcttcaagatacgataactggattgacattaaaaacaccaccatgtagggaatgtatgttctgtttttggtgtgaaagaaaagcccgaggaagaagggctgtcataaattcaatagctgtttctttttaatttcatattcttcttgagtgatagcatccatatccaacaattctttatattttttcaattcatcagctgcagatacagtaggggcaggagctggtggtattgttggagctggaatagactgatgttcttctatgtatttttgaatttctaaaaccataggcagttcatttgcgccaaaagtgaaggagttatcgtcttgtattgcgtcccagagtccacttgtttcattagcagctggcgttaaaaattgaaaatagcctgaggttactaatccaggtttttttatttgaagcccggacagttcactgattctataagatttctccccactataccctcgtgtgatagtgttaacagcgccttttcttgctactcttatatagtttccatcaagtgtgattgttgtttttgctgatttaaaatagtattctttagtttctttctttaaatcctctttttcactttcgtatctttcctcattgccagagatttttgattcaacatatttgataaagccgtcaatatcaccttctgatattgaattgatgtttaagtcttcttcggctgttttaaaatcaatcttatgtccaattaatggcttgcgactggcagtaattttaattatttctttatagggccaattctttaaaattggttttttctttttcaagacaatgaaatatacttgattttctgtagcaataaaatgcccccatgtcgcgtcactcttcatagttccgcaaacgagttcatgaattgtttcatttctttcatcaatcagaggtttagctgcttcataagttttcaagaaatttttagaagccttcatgcgttttttaaactgacagttatagatttcgccattttccatcaaaaaagacaaatttaatttcccctttataagtaatacacttgagtatatttttttctgatcagatcccgtttgaatccagatgcaatccagatgagaaagaattctatttcccttgatataattggcttcaacctactggtgaaaaattcttttccgatccagttcggttctaatcccgatccaatcctgatcttattagtaaacagaaataacataataacaataatataaataaaggtttcggcagttagttactttttaggcttacggccttcacgttcttctttctctttgaggtactttataaaatcaattgcttgtttttgtctttcttctgagaagtcactcgcttctctaaaggcgatctgtagatcaggatcatcaaaaaggtcattattaaaagtaggttctttgccagttaggagataatcagttgttacaccatacaaacttgcaagtctaacgagcatttctccatctggtttccttaaaccgtattcccagttcgcatatgtagacattgttttaatacctaatttttttgcgacgaaagatttgctccagcctttcttttctcttaattcagttaagattttccctgttatattatccattattatacacctttttttatttggtgtgtaaattttaacacggtttacacacaagagataattacttacacaaaaagaataaaaatatgttgacttacccttattgtgtatattattatgtatttaacgagttacacgaaaagagtaaggtggtgagttaatagtgctagaaaaattacgggctacaagactttctcaaggaaagacccaaacttttatggcaaaaaagcttggctatagatacgcaagcggttatgcaaatatagaaatggggcgtacaaagccaagtcttgaaaaagcacaccaaatatccgagttactgaatgaagaagtcgatgagcttttttttaatgaaaagttacacaaaaagggtaacgagaaaactgcttaggaatgaaagttacaaaaaaacagtataggaggtcgaagttatggatcaaaaaaagctggaacaaattaaaaatttgttgaatggtatgtcccaatccgagtggagccgtgttaaacaacatgtcgatgtactgttcagttctaaagccgccaaattgcagtttgacgacccagaactgttagaagctaaccttaaacgtgaatttaggatgaatacttgatttggataaacattgggtgaatgcgatattcagcatttttgtaataaatattaacgtaatcttgctgatacatcgtgtgctcttctttagaattagggctccaaattgaagcaccttcttcccaccatatgtatggagaagacatagattcacctattttgcagtccggatcactagtcaagtcaacccattcaccacaaaggcaagcgtaaaccttagtagaagccattaaatctcaccaccttccatgcatattttaccacatgaaagtgagagattataaagctcattgtaaaggaggttttttatatgttcactatgcaatacgatgagaaattcattgaacagatagctgccaaaattgctgatagagcaacagacatgctggtagagcggctcagctctttgaacgagcttcctcacatcttgacgagaactgaagcgatggaggtgctgcggtgcggtcccactaaaatggcggaactgatggcccgtccggattttccggttaacgaagaatgtggcaaaaaaatccctacgactttgctttttaaatggattgagagcaacacgcgttgggttgctgagaacaccgcatactatcagaaaggagcttcggcatgaataatttacaaacattcaaaaatgaaattttcgaagttgcagccaaaattgagaatgatcaaatcctttttgatgccgagcaagttgctcggaacttaggcctcactaccgttgccaaaagtggcaacgtaacaatccgatggagccgtgtgaatacttaccttccggataactttccagaagtagagaaaggtgattttattcctgaaccattggtgtacaagctggcttttagagcatctaatcaaattgccgaacaatttcaagattggttagcctttgaagttatacccacaatcagaaaaaccgggggatatgtcgcaaatgatgaacagttcattcagacgtatttgtccaacgcagacgaaaataccaaattatttttcaaaacaactcttcacgcactaaaggagcaaaataagcaaattgaatctatgaagccaaaagctcttttcgccgaagccgtggaagcatctgaatcatctgtgcttgttggcgagttagcgaaaatcattcaacagaacggcgtaaagattggacctaacaagttatttcaatggctccgtgataatggttatttaattcgtaagacaggcgagtctttcaatctaccaacacagcgaagtatggatttgggtctctttgaaattaagaagagaacaatgaataaccctgatggttcaattagaactacccgaacgccaaaggttacgggaaaaggtcagatttattttgtgaataaattcatttcatcagaaacagcttgaaacaatctccacaaatttggggagattaatgttcgagaaaaggactagcttgtcccttcattaattaaattttaccagtgaacaactggatatatcaggaggcaaacatatggagaacaacccatacaatttgcataatctaccccggatcatgcgtagtgtccgcaaagcggcaggacttgcacagtatcagatcggtaatttgatagggggaaaggatcagcgatatgtttcggacgttgaaaatggattcagtaagcttaccccggaattatgcattaagtggtttgaggcgtgcgaggcatacgaacatattgatctggtacattatctcttcaaattgcacccgacgacggcggcgccaattgatccagcacttaacgagagtgcaagcgcggcggtaatcaatatgattcaccagcttgaagaagcattacaagcaacaaggcatttagcgcgctggttggcaaacgataggccaggccgacaacctgaagaactgcccatggccgatataaagcagatttttgatctgatcccagcaaataaaacgctgatatattcgctggcccgtagtcatggactgaacatgaaggaactggccgaaaggtggacgcggaaagcgctaatgagtcaggttgcaatggcgaaaacagaagaaaggcaggcggtgctggtatgaaaatcaatcagtttcttaaagcagatgcagattcagcaaaaaggaaaatcgagtcggcggaaaggctctctatcatgcttgcggaggcgttgcgggatggcgattatgaagaagctatcagtcttgcagggagcatcaaggttcttacagaggatataaaccggctgacgaataaagggcgcttacatcaaactgtcttaaatatggcggcccgcgggattcacctgagtgttgtaagtaggtgttcacaatgaatattgaaaatccgatggtcttgaacaactggcatgacaaactgactgagccggacacgcaaaaggattactttggggatgaagtaacggctttcgatgattacgtgatagatagtgctgagggtgaaatcatcttgagggaaaaccttgagcggtatctgaaggagcatcttggttttgaatttaaaaatgagcaataaaaaagcccacttggcagagtggactaggtaaggcgttttgataattgattgtattcctattataccaaaacgccccataaaaaacaatggaggttttatacatggctaaagcagttaaagtggcattcagtgagcgtgcggaggatcagcgacgtttaaggcaggtcggcggctcaattgtattctccaaaaacggtaaagcgcagtttagtttcccttcaatggatcactatcgggaatggcagcggcttggaacggaagcatataaaagaaaggtggcagaagcacaatgaatggattatcacaggtggattactcagattacatgccggcgccccagcaggctactggcgtgactatggaagcgatggtaagccgacaggctcaagaagtacaagcggcaatggttatcgcaaagaaattcccacgggacgtatacgcggcttttgaccggattaaaaaagcatgcgagcggaggctattggctgagaatgcggtatatgaatatccgcgcggcggcacaaaggtttccggcccatccatccggctggctgaggccttggcacagaactgggggaacattgattacggaattatggagttggaacaaaaggccggtgaatcatctgtcatggcttacgcttgggatcttgaaacgaatacccggcaaaccaaaattttcactgtgaagcatgaacggaaggcacggggcgccattaccaaacttgatgatccaagggatatttacgaaatggttgccaatcaaggagcccgccgggttcgtgcttgcatacttggagtgattccgggcgacatcgttgatgcggcggtagatatgtgtcaaaaaacattgattagtggacataaggaaccactggaagaccgactcagaagtgccttctccctttttaaaaaagagtttggcatcactaaggaaatgattcaggagtacatcggcagtaatgttgatgccttcactgagcaagatttcctgaaaattggtcgtatttacacggccctgcgtgatgggatggcaaagaaagaggattacttcaatgtgaaggccactagcgcgactaaatcaaaggctgaagaagaattcaaaaagctgaaagagcaagctgacaagcctgctgatagtaaagaaaaggcgggtgatcctgctaatgcggataccggcgctgaacaagaagaattattactctaacgagattgatagacactacatgtcaaattctcaatataaaagctttttgcaatgcgaggctgccacgatggcaaagttgaacggagaatggacgccgcccacatcggaggcgctcctcttcggccaatacgttcatgcctggcttgagggtgaacaggcttttgatgaatttaaaaagaacaccccatcactttttacacaaaagggccagctgtacaagcagtatcagttagctgatctgatgattgaggcgattcaaaatgatgatctctgtatgtttgttcttcaaggagaaaaggaagtcatcgtaactgctgaattgttcggtgttccgtggaaaggaaagctggacgtatacaacccagctggcggccgtttctccgatctgaaaacagcgcggtcattgcgggagaaagtttgggacccggaaataggatattgctcttttgttgaggcatacggatacatcgctcagatggcgctttacgcagagattgaaaaacggatgactggacggagcgaatggcttgagcccctgatcgtaggggtttcaaaagaagatccacctgataaagctgtcatcaatattgatgagggcaggctggaaatagagcttgaagagattgagcagcggatggatcggattttgcaagtgaaacacggcggagagaaaccagagcgatgcgaaaaatgcaagtattgccgggccactaatcaactgaacagcatcatccatttttcggagttggtgagctgatggaaagggagctgatcaggattcctatcccgcattgttatctctggctggtcaaaacggttcagcgcgacttgagaaaggacttgtatacccggtacacgactgactacttaaagacaaatgagccgtctctgagattagtagaagtagatttcaaggctctgacagcactgtgtgaaaggaagtaggtgagcggcatggatatgcaaggtttggggtatgtggtcctgccccggctgccatttaaagattcacgagacgagacaatatacgattatttattcaaacgggcggagtacagggcagatcaagaactaaagctcgggcagacaatcattaagcttgtagatttagccaagcgcttcaactggtcttctgatcagatcaaatactcgttagatcggatggtaaagcaagagtatttgaagctggaccggctgccgcaaaaacgcggtttcattgtgacggtgttgaattatgccgagtacatacagcttggaaattacaacaagaagatagacccggctccaatacctttaggacagcaggaggttgacgaaaaaatgaaaaacgcatttgaactattcgaaaacaaaacagcccgcaccattggcacgatggaggttcagcggctcggatatatggtggatgattacggtgaagagaaagtcatggaggcaatgaaacaggctttcagattcaagggcaacaacgtcaatctgaattacattgaagccatcctctcaaacccattcagccagagacgaaaggagaaacagcagtatggaagctcgcaaaacgcaagatatggacgcggcaatgaaggcaattctaaccaagctccgggatcggtcagcagcatcttcaacgggacaggccgcctcagaagaaaaggctgaatacgagtgctctgactgcaaggataagggcattattgtttaccgtattcaccaagacaccgagcgccaattgagaaaagagcataagacaatggaaagcctggcccctgatcaaatggtcagagaagaggattatcttgcggggaaagtatgcttgccggataaggcccgagaatggaaaaccacattttccaagcaatgcgagtgtgtgaagcggaaaaagatcgcccggcttatgaaggccagcggcatcacggaggaattcgaaaagctcctttttggaaacttcattaaggacgggaagccggatatgatcaaggacgcttatgagtgcgcggtggaatactataaggattttcagagcatcaagggaaaacgttcaaacagtatcgctttgctcgggcagccgggcagcggaaaaacgcacttgttaacggcgatcatgaacaacctgattaagaaaaaatcaatttactgcatgtatttcccgtacgttgagggaatgggcgatctgcgaaatgactttgatcagctggaaacaaagctcgacgctatgcggaaagctgaagttctgttcattgatgacttattcaaaccagtaaagggggagccgcgggcgacggattggcaagtggaacaaattcaatcggttgtgaattatcggtacctgaatcataagcctctgctaatctcttccgagcttgatacgggggaaattttggacatagacgaggcgctgggctcccgcattcatcaaatgtgcagagattacacagtgaccatcaagggcgatcggatgcaattaaaccataggttaggagattgggaatgacggaaaaagcgaacttcacagcaaccggcggcatgtacgtgttcgggcctgctgagcaaacggccggccaggaccttaccccggcgatccgggtgcttgaggaaaaaatcaaacaaatggagctgatgcacagtgcttaaagcggttatactgctgccggccatcatcctcacagcgccgtacaaggaaaagcagattcagcactgggaacaaattgacgggaggtaatgacggttggattccattcagtttatagtttacggcgagcctgttgcacagggaaggccgaggggatctgttataaatggcaaggttaaaatgcgtgatcctttgaaatcaaagaattttaaacaatatgttgcgctggtggcgtcacagtatcggccaaaacaagttattacgggacctgtggcaatggatgtcagagtattcagaccaatgacgaaagaaatttctaattccaagacaaaaagagaaaatgcggaaaagggtctcctgcgtcccgtaacaaagccggacgttgacaactatgtaaagggagttaaagacgccctgaatcatctgatttaccgggatgatagccaggtagtcgatctgaaagttagcaagttttacagtgaagagccccgggtggaagtcattataacggaaatcctgccataacgctttgtggagaaagtttgatgcttgagaactaaatcaattcaggaggttatcgctatgcaagaagaaatcaaccgatacaagcctggtccagttaagaagtggaaaatgacgccggagcaattggcagcttacatcgaaaagcatccgatcatttaccgcgaggaattaaaaccatctgccggagtaacgatgcggctgccgtcgtaaaacgtaaaaaagcaccgaagccgtggccccgatgctctgatatgaactggtacttctatcatagcacagggggcggccagagtgaacaagccgacagaaataaaaaatcatgaaacaactattcagcaaagcatcgagccggggaaagtccgcatcatcgttttagatggcactgaagggactgctcatctaatggacgccccggaacacggtaaaacaatcattcaaacaataaaaggcggcctggctcgttgtgattacgagatcggccataaattcaattagcaggggttttcccctgcgggggaggaacggaaaatgtatcaaaacgaaattgcccgcaagtgtgaacgctgcggaaaaatatattattcagctcaatgggttgtatgcaaaacatgtcttttagaccgggaggcccgggcatgaaagaattcaaaatcaacttgtcaaaaggtgaggttttatataccggctcttacatttgcaccctttcgaaaacggcggccagtacaccggagcaaatatctttagaagcagcagccgaaaagctcgcggaagagttaatcatgcaacaggctatgaatcgggagcaccagcgccagcaggatgtcacggtcattcagtttcggcaggctcaggaagatattaagttgctacaggcggagaacaagcgttatagaaacgcattagaattttacgccaatgaaacgacgtatacaaacgaatttgaagactgtccgcctgctgtcgaactcgacggagggcaaacggccagaaaagcattggagggggctgcggaatgaataacataaaaatccgatacgtattccgacataaggaaacaggcaatgttgaattgaaaacgtactatatcagtcagcttgaagaacgcccggcgcgcaaactgtctcccgtcttttgtgaagagtttggttacgagttgatcagccgcgatttatggacgggcaaaaagcttatggaaaaagaaatatatgcgggagatattatctgttataaatcacacggccgggtgtttaatctagtcgttaaatggtcagaagatgatgccggattttatgcgggtggaatacgttgggattttgttcaaatgtatggtgagttaatcggcaacgtacatcagaatcccgaaatgttaggcggtgctgcaaaatgatgccattacaagtcgaactacaacggaacgtgaaggccacgaaggacgaagcgatgaccgtcgagcaggcggccgagcttttaaaggttcacccggattacatcccgacgctggtcgctcggtctgacgatctgaaaatgatcggtgaccataccattatcgctaaacgggataaaacaaatatctggctggtcggggcatgcgtggggcttttcttcttcgctatctccgtgctgccgaatttgatcgggggttaagggatggcacgctcaccgttaatctggtttggcggcaaaggtcgatacgccgatcacatcataaataaaatgcccgcccataaggtgtacgtcgagcctttcggcggcgcggctcatgtcatagcgaataagccgcaaatgggacatgaagtgtataacgacattgacggccatgtggtgaatttcttgatgcaagtcagaaaggatccaaaggccatgcagcaggcttgcgaatccattccgtacagccgggcgctctatgagaaatggaaaactgaagattacccgcaaaatgattttgaccgggctgtcaggtggttttatatgaatcgctccggcattagtaaggggaacgtggaggaagtgccgcagacaggctggaggcatagcacacaaagcgggcagaaccctgctggcggatacataagcgcctgcgctgccttcgagtctttcgccaaccgtatgaagggcgtcatgatcgaatgtaaggattttcgtaacatcatcgagaaatacgatagcccggatactttgttttatgtggatccgccatatgttgggcgtgaacggttttatgctggcggctttaacgaagaggatcatcgggaactggcccggctgcttaatcaggtcaaagggaaagtggttctttcttattacgatgatcctttgatactcgagatctacccgaactgggagtcagaaaccttttccgcatacaaacaggttgtcggcggatccggaaaaagccgcggggctgaagaattattgctatttaactataaaatcacacaactcagcttatttgatcaggagggaacccaatgccaacagcagagcaattgaaacgaatgaacgacataaacgatttgatcaagcttatcgcaagcattgatcatcgtacattctaccgcaagtcaaaggatcgcatagcgtatttcagatttaagaaaaaactgttcttcgttgatgattacacgggcgctgatgtttacccgtatgaattgggatacggcagttcaaacggcttttcgcatgggggcaacatgtggcaactggtcaacagcttcagaaaattcatcataacagggaaatgcggcgagctgagggattataaagaaatatgggcttacagctatgaaggatgtatgaaaatccgtcagaaggcgaaggagattggtttcattgaaagtgttgattacccctacagctttgatgaatgggcggatagtaaatgatcgaatatcattgcccggactgagattataaaaaacttgatttagaaatccgcgcagatgcccgctgcccgcattgtgggcgctgcataggtggtgaagtggaaaatagaagagcatattagaatgctcttctattagaaaattaatagacaaatacgtgtaactgaccgtatactgatccatttttgaatatagttaaatatgcatttccagctttattgccacggacaagcccattggtatctactgtgaaaacagcgctattatctgaatgataagcgaatcctgatcctaaatatttggcatctaattgtttagaacccccggctctcacttcaaaggtatcgtaataggctttaattggaccaggagatatagttgtttgcgtttcatttttttgaggagttatctccttagcggaagccataccactaatggaaaaagctaatacaggaatcgctagtgcagtaacagcagtctttttgaaattcattttaaacactccttaggttttttattgaacacagtaataattcgagcaaaataatgattatccttgtaaataaatgttaattatttgtgaactaggaaggggaaaataatgaaaaaactattcaaatcaatcattctatcagctgtattacttatgggagccgcggccgttgcgccgtctgcttccgcagcatggtccggctggcaaaatgaatccgggtacagcggccgggtgtttacggatgccgcgacttacacggccggcgcctcaacggtggactggaaagccgagaaaaaaggctcaagcactctttattacacggccggcgtatacaagaagcgtagcggcggcgggcttactgaaacgaatctggtacagcgaggcagcttcaaaacggcaacgcctctgaaatcattcaacgtgaaaacgatccggaataagaccgggaaagggacctatgtcattcagctggactgctactctgattccggcaagtggaactatatcggaacatttgaatcagcaaaatttcaaatcaaataagggggattcgatggcgctgagaatagtttttatgctgatggggttaggtttctggttttatttccagtacgaatacaggccggacatgaaagcaaacatcacgttaataggcgcaatcatcgcattcacggccgcggcgttttttcaagatattgataagtatatagagaagagggaagacaaatgaacggattttctgagattgaacttcaaatgattgttgatgaattaaaaaagggtatgcctttacaactgcagcttgttagccatacgtcaaagctgattgtggcttactatcaggaatacaagaagaatccatatgtggagccggcggacgtggtgcctctagctgttaaatccggaatgaatcaaatgggtcttaattaggaggagagagatgttaatagcctttaaaatagctctcttgctggtcctgatagtctctcttatgggagttataggagaggataaggattcacagctaagaaatcacttaactgcaatttgtatagtagcgatcatcgggaacattgctacatatgtgctgctttaactgaataagtccaagacggaaagcctgcggacactgatcattgcacagaatcactgtgctctgattggtgtccgttttttatttgaacggagggatgacatgaagcagaaaaagaaaaagcccaataaaaacatgcaggagcgctcagatcgtttctggcaacaaatgatgaacacaaacatgcaaacacttaaacgaggcaagggcggcgcatttaagcgcaaataaagggaggaatcagaatgcaagatttaatcattgagtacaaacgagctttaagagaaacaagaaaaatgtatcggctctacaaagatacggctgaagtcaatctgacggctgaacagatcaacgacaaaaagattatcagtagcatgatcagcgatattgaattcactcttgaatggctgcagaacggaagacagccgggcgcacgccgaggtgctgacagaagagacgcatatcaaaggacgattcttgctgaacctcgcttaattgatgcgctgccggaagaatacgcaatcgttcaagaagctgagggagaagtaagtgattgggataaggaaagaatcgctgatgccctatccgtgcttaccgaaagagaaaaagacattttcatgatgcatgctgtacaaaacatgtcattcgaagagatagcgcagttattggggattaaaaaaggaactgtgcagaagaacatcgaacgttcccgcctgaaaatgaaaaatagagcagatcacagcctattctgtttagcgtgaataggctcttttttattggagaaataatgaaaaaagcccactaaattacttgacgtgagtaaataaacgatgtataattaatgtatagaaaggagggaaagaaagtggctgaaatcgcattggtactggggattatcctcacaactctcacagttgttgagaaagtcctcatcatcagggaaaagcttaaagcaaaaaagcccaaaatcaaaaaacgcagacgtccaagaaagcgcagatgattttgagccgagggagaaggtagcgcttctcccttgctccaagtatagcaaatgcggcgactaaagaaaaatacttgaaagccagccactttcaaaaaaatgaaaagtgtacagtccactactgatattgttgttcttctcgccctggcgtatatgctgtttttccgtcaggatgtggcagcgggaccgttgaaaacggctctcgacattagtctgatcattttatttgttgtttcgatcatcgagaaagcattttccctttacttgaaatatcgtgagaaaaaaggatgattcaaaaatgtacaagcctaaagagcgtgacgcaatcaagaaattcctgaatgaagagatactcaatacaagtgaggcgcttgagatattggggttcacccgtcagtatctgaaccagttagtaaagaccggggaattagagccgatgaaagaaatgccccgggacaggctttttctgaaagaggatattttagatttccaaaaacataggcggaaatgagcaccctgttaaaagggtgtttttttgtcttacggttgccacctatttatgaaaagtgctttcgttcgacaaattttgcaaatagttcctttatcacactccttaaccgataataaggtgggaggtgagaatatgatgccaatggtaaaagaatttaatgattttttagagaaacaagggcatagatcatgggaagatattgaaaaagatatgcaagatgagttgtggcggattggtagaaaatacgatgtgacaggacctacagtattccatgagtatatggattggaaggcaagtaaacagaagaaaaaaggataggtttcattaagttacttttgttcatattatattattcagattaattctagaagtggtgagagaaatatggatttgaaaagaatagaaaaatcaattgttcatttaaaatgttacagtgaagataaacaagactttggtactgctctttatgtgaaaaaaggtaataagcaatatcttattactgtgaagcatctaattgtgaatagaaattcaggaaagctccatgaatctataaacaaagcaaacaaatatgctgagaatctcaaaactgtaggggtcgatcaaatatatcgattaggatctggtgagtctggagaggcgcctgtagtttatgaaaataatcactttgagatggacttggctattatatcacttaattttaatgagacaattgaatttaagagaaatttagaatcatccgattatacacctttggattttaaacacatttctgataaaaagttaacgccaggagatgatctatgtttgatagggtatcctgacttttctgatttaggtgtcgtcaatcctatgttaacaaatcagcatcttcctatttattcatttggcaaagtgtctttgttccataaccatttaaactattttatgggcaatatgtttagttatggaggttttagcggcggccccattatttataataataaggtggttggtattaatacagctcaaatagtaaactatataaattgtgagaaagaggagcaaccagttattaagtatccaatgaattatataattaaggctgatattatattttcgcttatgaaagaaatagaatcaaatgaaagccagcacctgcacctttaagggtgctttttttgttccttgtaaaccggttccggtaagtctcaggaaaactataggtggttaacggtctgagtgcggcgtcggtttagagggaatatattttccaaaacaaacacgaatcagaaggggcggcggtgaatgtagatggttgaaaagcacattcaggcgtataaggattacgtcaaaggcgtgaaatacaaggaccttgccgaaaaatacggggtgtcagtgaacaccatcaaatcgtggaagcagcggcatggttgggaaaggaaaaagggtgcacccaccgaaaaaagtgtgcacacaaaaataggcgggcaacccggcaacaaaaacgcattaggaaatagcggcggggcggctccggcaagaaatcaaaatgctgtatcacatgggttcttctcaaagtatctgccggaagaaacgcttgaaatcatggaagagattcaggagcgttcccctgctgatatgatatgggatcagattcagatacaatatgcggctattattcgggcgcagcgcattatgtttgtgcagaataaagatgatacggcaaaagagcttaaaaaggcaaaatacgcttatcatcaagatgaggacgaagatggcaatctaacatatgaaaaaaacattgtagaagaagaacttgaaatacagttcgcttgggatcgtcatgcgactctcttaaacgctcaatctcgggcaatgggggagctccggagcttgatcaagcaatttgaccagctggcgcatgagcaagatgagcggcgtcttaaattggaacagatgcgcttgaatatcgagaaaacgaagaagaccgttaatggcggcgatggaaacacccaagaaaatgatattgctgcaatgttgagaaaaatggtgaatgccgatggaactgaataaaaagcaaaaggaagtttgggacagctttattaaagagcaacccaaaattctaatttgtagcggcgcaaagagggcaggaaaaacattcgtgctccttttgacgttccttgctcacgtcagtaagtatcaaaatatgggtttatccttcatcatcggcggggctactcaggcagccataaaacgaaatgtcttgaacgatatggaactgattctgggtaaagaattgaggctcgacaagtcgaatgccgttgaaatattcggcaaccgtgtatattgctttgatggagccaatgctgattcatggaaaaaagcgcgggggttcacatcagccggcgcattcctaaacgaagcgactgccctgcacgattcattcgtgaaagaagtcatttcccggtgctcgtataaaggcgctgtggtcatgatggatacaaatcccgaaaacccgatgcacaccgtcaaaacggattatatcgacaaagacgggcaaatgctgaaaagcgggcggctgaacatcaggtcatttcatttctcgctgttcgacaacaattttctcgatccggaatatgtggagagcatcgtggcatcaacgccgagcggcatgtttacagatcgggatatacacggttattgggtggcgccagaaggagtcatatacaaggatttcaataaggacatccactatatcagctctgaggaattggaaaacaggcgcgtcaatttcaagaagtattttgcgggcgttgactggggatatgagcacccgggttctattgttgtaatcggacaagatgaccaggggtgtttttatttgctcgaagaatatgccaagcaacatgaggaaattcattactgggtgaaggtagcgaaaggcgtaaaagagcggtacggaaacattaatttctattgtgatacggcacgaccagaacacgttgttcgtttccggcgtgaaaaacttcgggctattaacgctgataaagctgtcgtatccggtatagaagaagtagcgcggctgttcaaacaagaacagctttttgttgttgaagacaaagttgaccggttcaaaaaagaaatctttatgtacgtctggaatcagaagacaggcgaaccggttaaggaatgggacgacgtgctggactcactccggtacgctctgtattcgcataataaaccgaaaagacggagaggggtgagctgatgaatcattttatagacatgattgaacagtccggcataacgcctgaattgattgacaagatcattcaggaacataagccggatcatgacagaatgaaaaagctttatgaacggtacgaggctgaggttcaaggcgttccgatcttatccagagaagccattgaatacgaagattttgaaacaggaaaattaaaacgtattgatcacaaagtaaacaataggcttaacaactcgtttgactctgaaatcattgatacaaaggtgggctatttgttcggccaccctattgcatatgagtttgatgagagcgatacgacaagcactgcaatacctgtaaaacagttgatcgaaaattttaatatggaaaataacattgctgatgaagacagcgagtgggggaaaatggcctctatttgcggttacggcgcccgcctcgcttacgttgatcgttctggaaacgagcgtataaaaaatattgatccatgggaatgcgcctttattactgatggaagtatccatgaacctgcttatgctttgcgatattacacggtgtacggcggaaagatcaaagcagaattctatgatcagaaatatgtctattatttcagtacgaaagacagctcagccttcacttttgataaaaaaacattgcatctttttgatggctgccccttattcggtttagcgaataacaaggaactaaagggagatgctgaaaaggttctttcgttaattgatgcgtatgaccgcacgttgtccgatgcatcgaatgagattgagcaatatcggctggcatacctgattttaaaagggttgggcgctgatgaagagacgcttgaccagctcaaaaagaccggagtccttgaattgcttgacgaaaaagatgacgtaagctatctgacaaaggatataaacgatgccatcatagaaaaccatcttgataggttggaagagaatatccttcgctttgcaaaatcggtcaatttctccgatgaatcttttggtgggaatgtttcaggggttgcgatgaaatataaattgatgtcgcttgaaaacaaatgcatcacgatggagcggaaaatgactgctgctctgcgttatcaatacaaactgatcttttccgcatggggcactaaaaggaaagcggcagcggaagattataaaaaagtttggttcggatttaagcgaaaccttccggcaaatgtactggaagaagcacaaacgacagggcaacttaaaggaatggtaagcgaagaaactcgcctatctctgctgtcgtttgttgatgatgtccagtatgagctgaagaagatggaagaggaagaagaggaatacaggctcaacatgccgccgttaacggatgtggaaacagacgcgggcggtgatgaagatgaaccagaatgatattgataagtacctggacgacatgatcactgaggatgctcagaagattgatgtcgtttttgcgtctcgcttaaaggagatcaacgcacaaattgcccggctgtatgcgaagtacagcaaggacggccagcttactttagccgatgccaacaaatacaatcgtctgaacaaggaaatggagaggatggccgaggaatctcacaaggctttcaaaaccattctgactattgttgaggcattagcagccaagcagtttttagagaattatatgcgttctgcttatctatttgaaatggaatccgtggttaacttgggttttagcatcccgacagccgaagtcattcggcaggccattctaaaccctatagctgaattgactttgtcagctatttacaggcggcatcgagacgattatgtccggcagattcaaatttccgtcgcacagggcctacaagcgggggaggattattccaagatcgcccgccgcattgaaagagcgaccgaatttgcccgcaggaaagcccgtgacgtggcgagaacagaagctcatagggtacaagtctcggcgaggatggaaagcgctgagaaggcctcaaaacggagcaaccttaaaaagatgtggaatgctactcttgatcttaaaacacgagccgggcacaggaaactggacgggaagacaatagaacgcaatgggctgttcaaatcaatttacggcggagtcgggccggctccggggcacatgaataatgcgaaagatgacataaattgccgttgtacgattgcttttaaagtaaacggtgtgctgccggatacgagaagggcgagggaaggcggcagtggggcaggccaaacaattccataccaaacctatgaagagtggtacaaatccattgaggaaaagggaagacgttaaacagcggctttttattttgtcctgagcatgacgttaaaaggcttatttttcatgcactcataacaggcgcgcactgtagagggcgaaggaggaagaagcgtaatgccaactttagaagatgtgaaaaaatttctcgaagaaaataaagaaaacgaagatgtaaaggcgtatctgaatgaactttctgccgtgtctgctgacaaggtgaatgggtttttagatacagaagaaggaaaacgtctcattcagcctcggttggattctcattttacaaaaggtcttgatacgtggaaggcgaacaacctcgatgctctgattgatgcaaaggtaaaagagctttatccagaagaaacagaagagcagaagcggatcaggaagctcgaaaaggagctggaagatcaaaagacagcggcacaacgtgaaaagcttttaaacaaagctgtttcttatgcttctgaaaagcaactgccggcagatgtagtggaattctttatcggtgaggatgaagaatcaacgatgaagaacctcggagcattcgaagagaagtacaatgctgcacttcaaaaggctattgaatccaagtttcaagagaatggccgtgatgtccagtccggtagcaatgaaccgacaaatcaagatttagacatcagctcgcttgcagctgaagcaagtattagaaaataaggagggctatttttaatgccaacatttaatccaaacaatgcattaatgcaagactcagtaaatgggaaggttccaaccgaacaaggaacgctggttttaaaagagtttatgacccaatctgctgtcacaaaactagcaaaatatgaagaaatgagtaagccggagaaggaattcacgtacttggcttctggaccgggagcttactgggttggagaaggcgagagaatccaaacttctaaggctcaatggttaacagcaaaaatgatttcaaagaaattgggtgtcatcatccctgtttctaaagaattcttgcgctactctgtaacagatttcttcacacaaatgcgccctgctatcgctgaagcctttgcgatcaaatttgatcaggctgcgttattcggtgtagattcaccgtttggaaaaggcgtatctgtatttgaaaaaatcaaggaatctggtaacacaattgcgttaaactcacttggcaatctatatgatgagttaaacggggtcatggctcttgttgaagacgctgacaaagatgtaaacggctttacaacaacacgccgattccgtcaaaagctccgcggcactaaggacggtaacggccttccgatcttcaacgatgcgacaggcggcgccacacaacaagcccttggccttccgatcggatatgtggattctaagtcatgggattacgaaaaagcggcattacttgcggctgactggaattacacacgttacggaatccctcaaggcatggaatacaaaatctcagaggatgcaacattgacaacgattgtcgatgcagacggaaacccgatcaacttgtatgagagagatatggttgctctccgtgtaactcagcaagtcggattcatgacactgaccgatgatgcttttgctgctattacaccagcaacggaggcgtaagcttatggggtacacatctaaaaactatagcactaataacggcgacaaattggtgatcggcggcgagctcgaaataaaagagggtgcgaaggtgactgggttatcgggttctgcgcctgctcctaaaactatcacttcggaaatgatcggcgacggagaagtgaaaaacatcaatatcggtgactgttctgtccaaaatcgtaacatcggcactggtagtgtacaaaatgccaacatcggtgccaaggcagttactttagctaaactcggtgacgatgtgaaagccaaactatctgatttagagaatcggataaaagcactggaaggaggcggcgcgtgatatgaaagcatctaacggttccaaaactattgaatgcactgaaaaggcttttgaggtggtttattctcacattggttttaagagagtggatgaggccaaacaatctaaagagctgaatgaacggccgggtacaaaccttcttgatatgactgaagagcaattgaaaaaggtgaataaggatgaaatcgttgcctttcttaaggagaacgaatatgaatttgatcccaaagcgcctaaagaggaactgatcaaaattgttctcggtgaagtgtaggtgattctatggatgttcaaaccgtaaaaaatatgcttggcataaaaacagacagccacgatacctatctggccgaggtcctacctctgttcatagatcaagcgaaagactggtgcaacaactcattcatggtcaatggagatgaaaaattaccagcaggggtaaagctgtatgtcgcgaaagcgatcgagcataacatgactccttccaacctttcaggccgaagtatgggagatgtctcatattcttatgaaacagagctgccaagcagcattacgaagcttcttgctccatacagaaagctgagagtcatatgatctatgaagaattcccgcatatcgttacatttcagcgttgggaagaggtgccggacggcggcgggggctatgttgaaaaattcactgattatctcacaatagaggcctttgtcggcgggattacgtcccgggaatattatcaggctcagcagcttcagaacccggttgatttcaatgtgtatttcccgtatcgcaatgatattgagaagacaatgcggatcatctacgagaacaaggtgctgactctcaaatcagatccgatcgaccagggcggcatgcatgagattatgaatttgaaatgtcaggttacgggggtgctgaagggcaatggctgaggtcagtggtagatgggtcaggcagatgcaaagagccacaagcgagttcagaagccgggtcatagatgatattaagcaactggtcacagacacggccgagctgatttacagccacgctgttctgaatgctccgaccgccgcaatagacgggggaacttgaaaaattcaattgaaatcgactaccaagagggcggcttacgggccgttatttctgttggtgccgattatgccgtatatgtggaatacggaacagggatttacgcagaggaaggcggcggccggcaaacgccgtgggtttattatgacaccaagcttaatagatgggtggtcacgcggggaatgcgggcacagccgttctggaatccagcggtggacgaaggcatgcggtattttgccagtcaaatgtgatagaaaggagctgtcatcatgcgatctgccctgtggccgttgcaggctgctttatttaagaggttatcaacagacgaagagctgaacgggcgcgtcacgggcgtctttgatgcagtcccgaaagatcagcaaaagccttatgtgacaatgggcgatgatgatgtatccccatttaaaaccaagacatccagcggtgaagaaatcaatgtggttttacactgctggtcaggttacaacggaaaaaaagaagcgatggagattttgagcctcatgcttcaagcgttaacaagcaggcccctaacaatagagggcttttctttatgccgttctgagttgcgcagcatgcaggtgatcaccgatattgacgggtacacgcgtcacggcattctcagaatgcgcttcacaataaacaattgagaggatgaacaaaatggcagatttattgaatggtattgatgaggtttactttgttcaaccgatgaatgctacttcaactgaaggtctgtttatcgcattccaaacagaaggcagtcatacgaaagaacaagatacaaaagatgaatcaacaaagtctggccgaattgttgggtacggccctaaatctgagagcatcgaactgacatactatgctgctgtctctgatccgggtcaaacggcgattgaagatgcttatgacaacgaagagacagttcaggtatggaaagtaaacctgaataaaaacaaaaacgataagcatgattctgaatatggacatgcaatcatcgagaacttagaaaaaagtgcaccgcaagatgggtttattgaggtttcaacaacattgcctgttctcggtaagacccgtaaaggtgaacttgatcctctgcctcaagaattaattgacgagatcagatcttctgccggtgccaaagagttcatgcagtttggcgagaatgccaaaaaaacaactacgccctaatgcgccccaaaatctatcgttcacggctacagctgacagcgtgaccgtgaaatgggatgcggtagatggggcaacttcatataaggtatacaggggagcgagcaagcagctggacgcaactgtcactggcacatcccacaccttgacaggaattgcggccgatacgaaactcacggtcaacgtctctgctgtgaacgatgcgggtgagtcctcaatgactgagattgttacgcaaacacaagcggttacgccctaacgttccccgcaatataactgcgaaaagcgccacttcaaatcaggtgagtttttcatgggatgcggtgaaaggggcgacatcttacaatatttacaggttttatgcaaaaatagcgactgtctcaaagaattcgtacacgtcgaatcctaacctgaagccggacactgcctacatttttaatgtgtcggcagtgaactcggctggggaatcggaacgatcggccaattttacgatacgaacagaaaaggaatcatagggtccgggcttcccgggctcttttttaacatacaaaaataatcggaggttttataaatggcttacttaactatcggagataaagaatacaaatcacgctgcgactttgcttttgacagattggcaaacgaaaaatattccactgcggacgaaaagggcaaaggcggcacaatgaatatttacatgagtctgctcaacgaagaggcttcctatctttctgctttttgggattgtgcactcgcttacttgaagaaagaaaagccatcaactgaggctattgaagaagcaatcatgaaaatcattgatgaagacgagacaggcgacgcaattgacaagatgatcaatgaagcattcacaacactggattcagcgggttttttcaaaggcgtaatccgtcagcgttggaagatgatggagaagatgaacaaagggaagaaaccagctccgaacgaaacaccggaaatggaagcgaaacggttggaggacgaagagaacggcaaggaagtcttgaagatgatgaaagaggcatacaaagagagaacgggatcgactacgaccaaataattacgaactccgcacattggctcggggtttatgatgtggatttaatcatgtcatggactcctaacgagtacaagcttctgctcaaaggagccaagttgcgagaaatagatgaattggagcttatggcaagaaacgccatgtttcatcgttacgccatgaatgagaagcgccccaaagaaacgaaaatgtttgatgcgaagaaggccagacgccaattggagcgcaatatcactggcgataacgacaaatggcgcaagtcagatgtaaacgagctcggcaaacgagccaaaggggttcagcggtttaatgatgcaatccgcaaccactttgcaaaattcggacaaggaatggggtgagggaatgatcgaaagactgacagcaatagttgaagcacagacaagaaaatttaatcgcagtatggatcgtgtcaacgatataatgcgccggatggctgatcatcacacagtcgaggttgacgccgagattgccagctttcaggcaagagtacggcaggcggcgcaacaaatagataactttgttcatcgacatcaacgcacgcgagttgatttagatgcggattcagaccctttaactcgggccatcaattgggcgaagcaaagattaagacagattccccaaactgtcaccacgcaattaatggggaatgtgcggccgttatcttccgcattggcacgcgctaaagcagggctatcggcggtggcgaacagaatcacaacgacgatagacggaaatcccactcctttagggcgtgctgtcgctgttgcgcggtcagccatagcatcagtatctcataacgtaactaccacttttaatgcggccacgtcgcctatcatgcgcggggtttcggctgtccgttcagctttggcttcactgccaaacagaattaccacggtcataaacggaaacacggctgcgcttatgcgctctgtggcaacggcacgcgctgctctggcgtccttgccgagaagagtatggattagtatagaagctcgaattgatcggtttgaaacgtcaatgaacaggcttgccaagatcacaaactcagtttcaacggtcatcggtcattcaattgccggggcattaacgtccctacttcctgcaatctcgccagcccttgcaagtattgtcggagcaatcggctcattgggccctatgctcggagtggcagccggcggagtaatggggttaaccagtgcatttgcaacagcgggaacaggcgcggcggcattcggcgcccttgctattacttcgataagcggtgtattcaaagcatccgaagacctttccaagctacaggagaagctggacaatgcaacaagcgcaaaagagcgcgctaaaatcatgaaacagatcaataatctgcaaaaatctcttggaaaagaagagagagaggcattaaagaacctcgaagactttaaagacaactggcgggacatcggtacgatggttcaaaagccgatcttaaaaacattcggtatgtctcttaatacgttcaaactcgcgcttaactcactgattccaatgtttgacgggctggcgaaagagggcgtgggactggcaaaaagcatggacaaggctttcaaggctccggacatgcagagattcatttcctatctgaacaaagaagctccgaaggcgtttgcttcattcggccgatctgccgggaatgtcttgcggacagttttcaatctcatcgtagcattcggaccgaccggaaagagcatgacaaagtctatcgaaggaatgacgcaatcatgggtgaaatggtcagcgaacttaggctcctcaaagaaattccaggctttcgtggagtatacaaaaaccaacggcccaaaattgttgcagattatcagaaacttttcgggcggcctgacaaagctgtttactggattcgctcctatgtctcaagacatgatgacatccctcgtagacctgaccaagcggttcaatgagtgggctggcagcgttacgaaaacaaaagaatttcaatcgttcattgactatattaaaaccaacggccctacagtatggagcacattggggcagatcgcgaaaactatcatcaacttgcttgttggcatggctccactaggcaaaacgattttggagaatgtaaacgggtttttgaaatttactaatgcggcgatggaagcaaacccggcaatcgggaagttcattgcggcgggtatttcattaatcggtgctttaagagctattgttccggcgatagtagcagtcagtgctgtaacaaatgggcttaaagactttatgactgctgctcgatatattcggagtttcagttctgccgcatccggaattagaatggccggattgatcacccaattaaaatcagcgatagttactatagggcaattcattgcgagatataccgttatggcagcaaaagcaacagctaatgctgtgaaaatggcagcatcatggactgcgatgaaaatcggttcttttataacaatgctgaaaaacggcattaagcagatgggacttttcattgccagaataactgttttagcagcaaaatcagcagcccaagcaacacgtatggcagcggcgtggactgcggcaaaaatcagttcatttgtgtcaatgttggcggcaggaattaagcaaatgatcttatttggtaaacgcttggtcattctggcggctcaagcagcggcaaatgcggcgcgcatggcagcatcatgggtcatcgcaatggggcctatcgggtggattacggcggcggttatagccttagttgttctcattattgccaattgggataaggtcaagcagtacacccttcaagtttggggtgtcatatctcagtggctccaatctgtatgggaaggcattaaaacagcggcaacatcaacatggaacgcaataacgtcgttcttctccactgtttggaatggaattgtttcggctgctaaaaccatttggaacgggctatctgctttttttaagtgggaattcaatctgtacaaaaccattttcacaacagtttggaatgctataaaatcgtttgcctcttctgtctggaatgggattaaaaagactgcgacttcaatatggaacggcattaagaacaccgttacatcaatttggtcaggtctcaaatcggcggctgtcacagcctttacgtatatgcgggcccagatcgttaacaggatcattgcgacgagagataaaatgatcagcatctggaatgcaattaagagtaaagtctcgtccatatggaatgctctgaaaagtgctgcagtgactgctttcacctatatgcgcgcacaaattgtgaatcggattattgcaaccagagacaaaatggtcagtttgtggaacgcgataaaaagcaaagtgacatctgtctggaatgctttaaaaagtgcagctgtaacagccttcaactacatgcgggcgcaaatcgtcaatagaattgtagcgacgagagacagagtaataagcctctggaatacagtgaaaagcaaagtgatgtccatttggaacggcattaaaggcgcggcttctacagcatttagttacatgaaagcgcaaatcgtaaaccgtatccaagcaacaaaagaacgtatcgtcagcatttggaatagtgtcatgaaattttttagaggcatcaacctcaagtccattggccgcaacatcatacaaggcttaataaatggtatcagcggcatggcgggtgcattagcgagcaaagttaaatcaatggcaaacgcaattcctaacggcatgaaaaagcttctgggaatccattcaccgtcaagggtaatgcgtgaccaggtcggttatcacgtcggcaccggtatggcggcaggtattgataaatcacagggaaaagtaaaagcggctgcggcaaaagcagcgaaagcggctcagaaggcggctgaggtaaaggtatccaacaaaattaagaacgctgaagtgaagtatgacaccaagaaaatgggcgccgatacgtatatcaaaacattgcagaagattcagaagcaaaacaagctgaccagtgagcaaaaccgaaaaatccagcgcgagatatatcaggcatccaaaagcgcctctgataaacagaagaagctactgaaagagcagcagcgcaaggaagcgaaggcgaaactggcgtataccaagaaagtatcagatcagattaagaaagctgaggcaaaatacgatacaggaaaaatcagcgggaatacctatatcaaaacgcttgagaaaatcaagaagaagaacaagctgaattctgaccagcaaataaaggttcaacgggaaatctatcagactcaaaaagctatgactgataaggccagaaagcagaaggaagccgaaaagaaagcggctgacaaacttaacaagggcattctttctgcaaacaatacttatctctcaaaattcaaaaaagtgaatgataaactgactgccgatattaaggcggccaacgatgcctataaaaaggagctgcaagaccgaactgacgcgatttataacgccatcggtctatttgacgatgtctcaagtcaaaatgtgaacggctccaagctgacttcaaatcttaaaaagcagctggacaagatcaaaacgttcaacactgacattacaaaaatagcaagccgggcaccaaaggcattcacagacgaattgaaagaaatgggtgtcgggtcagctgatcagattaatgcaatagcccgcatgacagattcagagctaaatgagtatgtcagtctgtggaaagaaaagcacaagctggccagtgaccaggctgctcaagaattaaccgggttgaagaacgcgacgaccaagaaaataaatgaattacggtctgccgcaaataaagaactggcacttttgaaaaatgactatctccgcaaaattggggagcttacagtggatgtaaaacagcttggttctctcaagaaaagcggaaaagccatcggttcaaatacaatggccggcattatttctggaatgaagaatatgaagggcgagctggcgaaagaagcaaattccatcgcctcgacaattgaaaaaacgattaagaagaaattgaaaatccattccccatccagattgatgcgggatcaggtcggggtcatggttcctgccggtatcgctgtggggattcagaatggtatcggcactgttcagaaagctatgggcgtcgtcagtgatgccatgactattcagcaggaggatctgaattttgcatatgacacatccatttccagcagcgaactcggcacggttagaaaagaattgagcgcggacatccggaaccttgaattgcctgacaggatgattgttgttgagatggacagcaagaaggtcggtcaaggcgtagaaaaaccggtcacagacgctcagaaaaggtcgaacgcaaggaggacgagatttaattgatcaattatcaggaactgctgcctaatcaatggaaaatcacgtttgacggcattgatatatcacccttcttttatgtgaagtccacgggcggccggggagtgaccggaagagaagtgaatacagccactatcgggaatcgccccggcggtttcctgcggaacacaagaattcctgtaagagtcataaccgttgaggttctttttgctttcagcagtgaagaagagctgaagaaaaagcaggaggaactgacttttattctgcacaccgaagaacctaaaccgttaatttttcacgatgagcctgacagagtctataatgctgtctttgaaagcatttcagaaggcgaagaacagggaggctttcagactgcaacattgacttttatctgtcctgatccaaaaaaatacggcccggcgaaggattttgaatttaattcaggtattcagactatcactaatccgggctatgcggccgtagacccgacaatcgaatgcgtctttgaagagaaagccacttcatatgaagtggctcttcttaatggtgatgggtctgtatcgaaaacgatcaagctgctgtacgatttcatcgctggtgacacacttgtaattgattctgcaaaaagaaaagtcacttgcagcggtaatttaatcatgacagcacttcaaattcaatcagattggtttctgctgccgcctaggacgccagttaaaatcaagttcagtcataagagcagcatcaaatttaatgaggcatatttgtaaggaggtccggtcatggctgacatttatatactttcaccagatgataaattattgacagtgctgtccagccacggacgagaaacctgtacgttctgggatgcgaaatacaaagaagagctcaacaagggctcttctttttcttttgtagccgatgcctcccaccctgatgcgcgcttcctattcgaagagaatcaagtggtattcaaggataaggacggtgtaatgcgtctgtttgtcatcaaggaactggatgatgcagacgaagaaggagaggttaacacccaggttacctgtgaggctgccatgatggagcttgccgaaacatttgtaaaagatttccgcccaactaacaaaactgctcagtttgtactggacaacgtcctttctcggtcaagatgggtggcggaagtaacggcggagcttggagtgaattcgactaccttctataaaaaaacagcgttggattgtattgctgacgtgatcaatatatggggcggagagcttcaggacactatagaatttgatggaaataaggtcgtcaaacgaatcataaaaatacttccccgtcgcggtaaagacagcgggaagcgctttgagagtgataaggatacaacgaatatccggcggactgttatcagttacccggtgacagccctttggggttacggggcatccatagcatctacggatgaggaaggagaggaaacgggcggctattctcgttttattgatttctctgaagtagaatggaaaaaatcaaaaggcgacccggtcgataagcctttaggccaggaatgggttggcgatccggatttattagaacgattggggcgccttaaagatggaaagttgatccatagggaaggccaatacaatgatgaagacataacggagccggaagagcttttaaaggccacatataatcatttgataacgactgcatgtaagacagaaatcaattatgagttgtctgtgcagctgcttgagagcgtgccgggacacgaacacgaacatgtggaattgggagatacaacgatcgcaattgatcgaaacttcgctatcccaatcgagacatcgcagcgcattatttcaatggaatacgatattaccgaccctgaaaatacttgcgttgttgagatcggccaatttttatcagcattacaaaaagacggccggattgatcaaattgaaagcgtgatagaaaaaaaccgcggtacttgggaaagcaaaccggatgccggggaggttacggatggaagtttccctgacaaagccccgccagttccgtcgaatgtagtgatcaaggcaatgtttcagaatgtggccctgacatgggattatgatccgtccagttatattgcagcctatgaggtatatgcttcacaagtaaatggattcactccattaaaagagaatcgtattttcagaggcaaaacaggcggatatgagcattttacgggagtaaatgaagtttggtattatcgcttgcgctcaatcaacacacgaggcacagcgagcgaattcacggatcagttttccgcgaccactcagcgcattttgactgatgacattgttttcggagcgatcacaaaggaaaaactggcccagctggccgttgatgctgataaactttcaagaaactttgatgatgctaatatcttacctggctctcttttaaaatctaaatggttctatgattatacggacaccagccacagtgttgaggaaaaagaatttaatgaaatgactgtttctcagatcatcaatggaacaactagaatagctttcggaatatgcgggaacaggtcatcgcctgttaatattcaaagaatggcattgatcaaagatcaacaatatacactgtcatttgaaataaaacggaataataccaccgacataagttatattcatttgaaaaaaggcagcactttcatacagattagcagcgatgaacagaaagatatttctgcttttccgtctgaccaatttataagggttaatatcaaatttactgctccggaaaccggctctgattacacaattggaatcggcggatataatcgaaacggaaacactgagccctgtagctttgttattcgtaaggtacaggtgcgcaaaggcgatgtcatttctgattatggttatagcccgtttgatactcagctggttgatggtgttattgatggcgaccacctccaaaaggcggtaatagaaacagctcatataaaaaatgcagccataacaagtgcgaaagtagctgaagcggctatcgggacagcggctattcaaaatgcggctatcgcaaaggcgcatctaaaagaagcaataattgattcggtacacatcattgacggttcaataacaaacgccaagatcaaagacctttcagcggacaaaataaatgtcgggacgttaaaaggtatcacgattgagggggtgaccataaaaggggcccgtttcgaggcgctgacacaatcagaagatgccgaatactatatcgaaggcgataagatttaccagtacaccagagactctcattatgtttacaacaaattgattgttagttctgggaaaataacgcaggaacaaggaaagttttttgatcctggtgattcctataatgaaatctacagaacagtttcaattggtgatggcaaaatagagctccgtggcgcaggcaagcaaaccgcatatgaaacggttccaactatttcaatgtattcagaaataggagatgttggacaagttataagccattttaatatgaaaatggaaagacaggcagctgttgaagaagacgcttttcttcttactgctactaccaatcctaaaaatataggagagccgttcacatataaccgttatcaggccctttttgaaggatcagctactatttatcgctttaaaccgaataatttagatattgatgtccccggggtcattcgactgaaatcaggccaaaaaacgattgttgatgcatcagatttaacgctgccattgggaaccaaagttgtagcagggaatgcaaaaaattgcgaattcaaattgatgggtggcaatgtttctacagaattagaagacgagcatggaggcctacaatacggtttgatggtttactgctttacttgggacattaaactgccgcctgacggaggggcaactgcgtacgcgcgctacaatcgcattccttttgttgatagttttgattatgcgcctgagaacgtttttgcggcggtaggtacagcgattggcgcatattctaatgcggttacggtaggattagaaaatataagcgccagttctgttgatattggagtgagagggaccgggactactgccggagttgcgggaaaaacaataaaggttcaaattgttattttttacgaatcacaataagggagtaatttttatggttgaaaaaagggattttaacatgagtctttattatgcggacggcatcgaaatagaagaaaccggcgcgggaattgaaataactgccggctctataaaaaaaggagacaagacatatcccatggaggctgtttcgttcgatctgcagccggacgatacaacaaaagtagcgtatcaattatatgtccttcatgatataaaggctgatgaaataagttatttgctcacaaaaacttatgtagagcctgacggttattatcaagggtacagtgggagcaaaaagcttattatgattccagttcaaattgtcgttgatccacaaggcaaccgagaagggcttataacaatctatgttcaaaataaggaggatggcaaagatgaagcttgagcccgtggtattaaatattgaagcaaaagatagagagaaggaaaagactacagaggaaaagttgcaggaacaagttcttgaccttcagcgggtttgcaatctcttaatgaatcaataaaaggaaacggggggagcccattggagaaccgaagtgctcttttcgggttttttgaggattgctggaaaaacggaactgttttgaccgttgaaatgagaaaagccgttgagaaaggccgcatcacacaagcggaatatgatgaaattacagaaagcgaacgcggtaatgcgtatcccgatcaagagtaaggagtgaaaggcatgcaagaaatgacaaaagagcaacttcaggaccagttacaaatagcagcatataaagctgcttccctacagcaggaattgaatctgaagaacaatgagctggccgaatataaagcgctatacacgtttacagataataaacgcgaggaactcgaaaagcaattaaatgcggcagtagcggcgaaagaaaataatagtgaaccagcacctgtaactgaataggtgtttttattttgcctcgaaggaggtgatcaaaatggagggaatacatgtgtggatgaattttgaaagcttacagatcgcaagaacatatcttttcggggaggtgaagtaccttgacttgcttctaatcctcagcatcttggatgtcatcaccggcattatcaaagcgtggaaaatgaagcagctccggagccgcagcgcgtggtttgggtatgtgcggaagatgctcagttttatggtggtcatcgtcgccaacattattgatacgataacaaatttgaacggcgtcctgacctttggaaccgttcttttttatatcgcaaatgagggcctgtccatcacggagaatttggcgcagatcggcgttaaaattccggccgtcatcactgaccggcttcacgtaattgaaagcgacaacgatcagacaaaagaaaaagatgatcaggcggctggttaatccggctgcttttttgaatccaaaaacagaataggagagattttatgtcagcatacagaaaccaatatattgatattaataaatggacgcggccgggaatcaaaaacaacggcgtgaagaaacttgtggtgcattacacggccaaccccggcgcgcctgctgccaatcattatagatattttggccaaacgctccccgcacagaacagaaatctatctgagaaaaaacagacgtttgcatctgcacatatctttgtcgatcgtacagaggctatttgtatcattccgttgaatgaggttgcctatcatgcgaatgacattcagcaattcgtcaacgggcagccttaccggggtgtcgcggcgctgaaaccgaatgcaaatttcttatctatcggcgtggagctttgcattgaaaagaacggcactttccatccggatacgattgcccgtgcaggacaagtttgtgccgagctgtgcaaaatgtacaaacttgatccaaccaatgatattgttcgacattatgacattacacataaaatttgcccggcgccgtgggtaagcaactctcaagggtttgccgattttaagagccgtgttgaaaagcgaatggatggtgtggttgtaacggcgcctgtatcaaatccggatgttacccatacagacacaggaagattcatcaaaaacacggtggtttcaagcgatggccttgttttacgtacacaacggagcgcctcttcttccatggtgcttaacctgccgaatggcacggttgtaaaatatcagcttggatcaactgtcaacggatggggatatgttgaatacaccaattctaaaggccagacattccacggatatgtgaatgtctcatatatcaaaagcgataacgagctgaaaagcggcggccaaaagaaggtaaaagcctcaaagcctaaaaccactcaaaaatcaaaattcagtctgcctgcgggtgtttttaaagtgacaagcccattgacccgaggggaggccgtaaaacagattcaaaccgcgctggcggctcttcattattaccccgataagagcgcaaagaacttcggaattgacggctcatatggcgcgaaaacagcaaatgcagtcaaacggttccagtctatgtacgggctgcctgctgatggcatttatgggccgaaaacaaaagcgaaacttgaaaaattattgaagtgatatagcctcgtccaatggacgaggctttttttgttgtaaatgggagaaatacataacttttaagctagtatgaagtcaaaaaatatacttttattggtgaatatatggtaaattcttttatgtgtgttatttctaatgaaatgagggaatttaattggacgaattaaaagaaaaaagaacagggacggttgcccagccattaccacaaccagcagttgacgaacagcttaaatcagcattccaaatcatgacatctgtggtgaacgattcgaatcgaacgtttaattctgaaagaaaacttgataatgtagctatttttgttgattatgataacgtttactggtctctaatgaataattatagccatgatccagattatcaatctgaagataaaaatttattttcaaggttatgggaacgatacggtcaagacaatgtacgttcatttagagtgtatgcggattttaacaaattaagaagtaatatgacaagtcttcaaaaaaagcgtgttcaaataaggcatgtttattcaaatggaaaagatggggatcatcgtaaaaatgcatcagatattgaactttgtattgatgctattgaaaatacatacaaggatccttcgattagttgttatgtttttgtaacagctgatagtgacatgattcctattatgagtagattaatgtacaagggaaaaagagttgagctttattattcagctaaaaacgctcctaaacatattgaatttaagaattatgctcatcatgctgaagatttggcgagtttacttggtattgaagaaaagcagtatgaccgagataaacttatgaatcaaattcttgttgagataaagaaatggcacgatagctttggtacacaaggagatctgttcttaggcttgagttggttcaaaagatatctaataaatacattatcgaccccagcagagattattagtgagattttagaggaacttaaacaaaagagctttattgttgaagagacaaaagtgttaagcaaaggtaaattaaagggcagttccaaaaatcaaatcttatgttctgaattagggttagctaaaataactgaatcagaagatcaagcacaagttgtaaaataattgcttttttgcttgacaggaaatatatattggatgtattatgaatacacattagaaaacacatacgctattattactattcgctacatattcgctaaagaaagcagggagataccctgctttcttttttatttaaaattccacctgtttttatgcttatcccacttcaaaatgcgctgcctcatcaaattcttcacagcagcacggatcgtctgctcatctttcccggttttccttttcaattgttccatggagggatttttcccgaagcgggtcatattaaaaataatccgatacactttacgctcaaaatcggtcattgtgtttcatctccttggagacgattataaagaacgtgtgttcgcgatgcaaacaaacctgttattttttaaaaaataacacaaaaataacgaaagttgcgtcagggtctgaaacaatgcggtttttgtttcttttccattcatgatcacactaaaaaaataacaccgattgaaagggtgcgaaagcgagcgaaaaccgtggtaattatgggcggcatgatgtaatctcccttgggtataccaagggattgactgttgagttcacttgaaatgctcatagcgttctatcagaaaggtcttatcagttactcaactagataagaccttttttgtttataaaaaagagaaggtatgagatcgtttgtctaagattgacctcacactttcctaactacaatgtgatttcctcatttccttcaagcaccattctcagctgctccacctcaccccgaatcccaatcccaggctcccacgaatcaatcagacgaatggccttctgattcgattccatcgctttcgtattttctcctttacgatacaacagctgtgccattccgtaatagtaatagatcaactcaacttgattggcgttgtgtttgtcatagagcatttgttcaaaggctttttccgctttttcgagttgatcacacttgacgtaagccatgcccaggttgaaataggcttctatcgttttttcgccgccgtatgcggcgctggttgtgtttgccgcttcgtataatgtgatggcttcttcgtagtgagagcgggcgaaactcaggtcgccgcggaccagaagaaccctgtgccggataatgggggagacgggctgatctttgatgccgtccagcattgctgccgctttgtccggttctccggtttttaacagcagcctcgattgcagggcgattccccatactttcaagtcgtcgtgatccggcgcgcctgattgttcgagtatcttcaggccggcttctatttgcctgagggcttcgtccgcatcattaacttccatcagcgcccagcctgccgtgtcgatcctgaagtaggcttcccgcgtgtgttcgcctgattgacgggcggcatcggcggcttttaatccgtattcgattcgcaggggcaggttgattctgcttagaaaatggctgatgcggatgatgagtttgatcaggatgtcatgttgtccggtttcactcgaccattcgatgacctttaggatgttcggccattcctttttcatttgctctaaattccgtcccagcagatagctccaatagacagaattgggctgttcccgctttatatgggtttccgcataatcgatataataatgcgcccagcggctgcgggctcctttttcaaattcgtgattttcggataagtgctgttctccgtaagcgacaacggtttgatgggctgcgtattgaattcttccttcgcttcgttccggctgtattaaagcatatgaccgcatttgctcaatcgcgtaatgaaaccgccggacgtctaatccggccgcttgagccaagcttttttcatcagggggcttagcgaaaaagcaaagcgtctgccatagtttccgtgtgtcttcatgacatctgtcccatgtgcggccaaagagaacctcaaacaattccaataatgagtagcccgcttgtttaagttcttgaatgagctggggagcggggatgtcgtcgtctgacatgtatgcaatgctcagtgccatggccttcgggttgccggcggctgccgagacgaattcattcttaaggtcaggcgatagccgccgcagctgctccagcttttcccgtttttgcgggaggttgcatgtttgcagacagcggtgcacttcttgatggaaaaattcaagggcatccgtttgttcaaggccgctcagctggatggccgccagttccccgaggccgtcccggtatgtctgttttacgttttcccgtgccgtaaggagaacttttacgccttccggaagaccgatgataaattcgtgaatgtcacgttccgctgtatcgatgctgtcaacgatcagcagcacgggtttttcgtttgaatgagcggctaatgcattacggacgacgaaccgtttttcgttgatggatttgtctatttgttctgcgcgtccgagctgataggcgatcgtgtttaaaaaatcgctgaagctcaatcctttccagtcagcgctgatccaaatgatgctgttgaatgcaggccaatctggtgaaccgccggcacaaaggtaggctgcttcaagagcgattgtggtttttcccatgccggcccagcctgtgattaaacagaccggtgacggagacagcatccattgccggatcgcctctatatcaaagccgcgtccgataaagttcccggtccggcgtgacggtaagttatgcgtgacgggctgttctgtaagcgcattcgtttcatggccgggtctgtcatgaaacagccgctttactgctttttcaacatcttcatcactcggcgctccgaatgatccgtctttccggtgtatttttgctttttttagacaagacgccgtccaaacgggcaatgcgggtttgatgacgggaatggtggtggtttccagaaggccggtcagccattcagtatccatgtcagtcttttcgataatgatccagatcatgccgaacagctttccgtcgtcaattcgtccgggaatgtagtttgcgcccatctgtccgatccagcttttgatcgtgttagaggaaacgcctaatcggagtgcgatttgatcgatataagactgtcctgttttttcgttctttttccttctgactttataatcaggatgaagtttcagcgatttgacggcaggtgccagcagttctgcaaattgtgtccggttttctagttcagccattagcctgcacctcctattagtactattttatcaattcagtgttttttgtatatgaaaaaataaaaagtacagtgcggctgtccttttatacagcaggaaaggctgttgaacgtatggaaaagcagataaaataggggcagtaacagagaaaacaaaaatgtatgcacttacatttcaaagcagagaaaggattttgccaaatgactcacacagtgcctcaaaacatgaaagcggcggttatgcacagcacgagagaaatcaaaatcgaaacattgcccgtgcctgacatcaatcatgatgaagtgttgattaaggtgatggctgtcggaatttgcggatctgatctgcattactatacaaatggcagaatcggcaattatgtagtggaaaaaccatttatcctcggtcatgaatgcgcgggagaaattgccgccgtcggatcgtctgtcgatcaatttaaaataggagaccgggtcgccgtcgaacccggtgtcacatgcgggcgctgtgaagcgtgcaaagaagggcgttataatctttgcccggatgtacagtttttggcgacaccgccggttgacggcgcgtttgtccaatatatcaaaatgcgccaggactttgttttttcgattccggattcactttcctatgaagatgcggctttgatcgaaccgttttctgtcggcattcatgcggccgcgagaacgaagcttcagcccggttccacggttgcgatcatgggcatgggtcctgtggggctgatggccgttgcggcagcgaaagcatacggggcaggcacaatcattgtgaccgacttggagccgctgcggttagatgccgcgaaaaaaatgggcgcgacgcatgtcatcaatgtccgggaacaggatgccggtgaagaaatcaaaacgatcacgaatggcagaggcgttgatgctgcctgggaaacagcggggaatccggcagcattgcaatccgcactggcttccgtgcgccggggcggaaaactggcgattgtcggtttgccttctcagaacgagattccgctcaatgtgccgtttattgcagataacgagattgatatatacggaatcttccgttatgcgaatacgtatccgaagggaattgaatttctcgcttccggcatagtggacacgaagcatcttgtaacggaccaatatccgctggagaagacgcaagaggcgatggaacgcgcctttcaatacaaaaatgaatgcctaaaagtgatggtgtatccaaatcgctgagtgaacggggaggatctttgcattctccctcttgcttatcaaaaatgaaaacggattcttggggtgggaaatgatgattgaaacagaaaaagcatcggcagtaaagacgaaacatcgcggcctgtcctggatggaacggatcggctacggattcggcgatatgtcgtacaatattatctttcagtttgtaaacgcatacttattattctactatacagatgtcggcggcattaagcctgcggtcatcgcagctttgtttcttatcgtaagggtgctggacgctatttttgacccgattatgggcgtgattctagacaagacgaatacaagatggggaaaggcaaggccgtatcttttgtgggtggcgtttccttttgcgttatttacgttcttatgctttacgactcctcatttcggcgagacagggaacatggtttatgcgtacatcacttatattctgcttgggatgtccttcagcatgcagacgattccggtcaacagcttaacgggtcggatgacgaattctgtggaggaacggacggttctgacgacgacccggatgattttggtttatatcggaattctgttatcgatttcctgtgcgacaccgcttgcggacgccatcggcgggaaagatcaggcgttcggattccagatgacggcgcttatctatgcggcggtgagcatcgcattgaatctgttcagcttctttaccgtgcgggaacggattcagcctgaaaaaagaaaaaaacaaggaatgaaaaagacgttgtctgttttgttccgaaacaagcctttgctcattttggtttcttcatttttagcttttgcgatcgggtttaacattaagctcagcacgatggtgtactattttacgtataacgtcagccataaggaatttgtgtttttaggaaccgtgctgtttttcggcgcagcgctgatcagcaatctgtttattcctttcttttctaagaagcggggccggaagcaggtcatgatcatcacggcggcgttatcgctgatttcttatgcgggccttcagtttacatcgtattcctcgattccccttattttcttttggcttttcgtttcgggatttttcacgacgcctttaaatacgcttgcttggggaatggttgccgattgtgtcgattatgcggaatggaaaaccggagtccgggctgatggcgtggtgatttcgagcatgagtttcatcaataagctcggagttgcgttagcggggtcattttcggccgtttatctcggaatcgccggatatgccgcgaataccgatcagaccgcctcgtcattgaatgcgattaaaaatatgaatgcgctcattccgggattgttcattctgctgtctattattcttatttctttttatcctttaactgaaaaaaaatatcagcagatgatgtctgatctggagcaaagggctgccagataagtatacgtaaaatttaaaatattctatgtaaacggttgtatttatgacagaaagcactatactgaaactataatcgagaattgataaatgagtgtgataatgtgggaaggcaatctgttatttgtattggagaattgttaattgatttcttttgtaccgatgtggatgttgatttgacggaagggcgcaatttcttaaaaagtgccggcggcgcaccggcgaatgtgtcggcagccattgctaagctgggcggagacgcggctttcagcgggaaaacaggcaaagatccgttcgggtactttctgaagcagacattggacgccgtacatgtcgatacgtctatgctcgtcatggatgagaaagcgcctacaacgcttgcgtttgtttcattaaaacaaaacggggagcgcgactttgtgtttaacagaggagcggacgctttgtttacgcttgatgatattgatctggaaaaggtaaacgatgcgaaaatccttcatttcggatcagcgacggcattgttatctgatccgttttgctcggcctatttacggctgatgtcgattgcgaaagacaatggacagtttatttccttcgatcctaactaccgtgaggatttatggaaaggaagagtttcagagtttataaacaccgcaaaaaaagccattgccgtaagtgattttgtgaaagtcagtgacgaagagcttgagatcatcagcggtgcgaaggatcataaagaaggcgttgcggttcttcatgagcttggggccggtattgtggcggtgacactagggaaaagcgggacccttctttcaaatgggaaggatattgacatcattccgagcattccggtgacatcaatagactcaacgggagcgggcgatgcgtttgtcggcgcggcgctgtatcagctggcgcgcacggatgaggttcagacggcagccgaagattttgcgaagctgcgtgatattgtctcatttgccaataaagcgggggcgctcgtgtgcaccaaaatcggtgcgattgatgctttgccgagcttaaaagaggttgaagtatcactgtaaagtatggaggatgtttcttgaaagtcatcggacttcgggaagcatcctctttatttaggtctgaaacccttttcgatatacggtatactttagaaaggcatccagtaaattgaaccgctgtgaagtacatacaataatgtttttatcagttctgagtaaaaccaagtttctgctgctgccgtcatgtacagtgtgacggcctgtgatattgaaccgcggaggaatttttttatgaaacatgtttttcttattgtgcaatgcgcgttttctgttttttgttttctttgtctcgccgctgtcaattggtatcaggggagtgagcttgtttctgactcgtttgattggaatgatacggctaaattctcaaagcttttgaatgggacggatacgattacaagtccggaacagatttcgcagctggatttctttgtgtatgcggcgaagcattatccgttagtgagcgggttgatgatcgggctgtttgtttattctttgttctcactgtatctgctcgtgaagaatttccgccggcacaaatgggctgaatgagactattttcatataaaaatacataaattcaagagaaaatgaaacctttttcgaaaaaaacagtatatataactgtgaacttgttactatttaattttgggaggaaaatgaaaaatgagtattttaggaagatttaaagacattatgtcaagcaatatcaatgcgctgctggataaagctgaaaaccctgaaaaaatggttgatcaatatttacggaatctgaacagtgatttaggaaaagtgaaagcggagacggcttctgtcatggctgaggaacagcgggcgaaaagagcattaacagaatgccaggctgatgccgaaaagatggaaagttacgcgatgaaagcgttgcaggccggcaatgaagccgatgcgcggacatttttggaaaggaaaacggctgttgaatcaagactgactgagctgcaaacggcttatcagctcgcttcttccaacgcgtctcaaatgcgcaaaatgcatgacaagcttgtcgctgatatcggagagcttgagtcgcgaagaaatgccatcaaagcgaagtggtctgtggcaaaaacgcaggagagaatgaacaaattggggtcctctgtgtcaaatgcgggccaatcgctgacagctttcggcagaatggaagacaaggtcaaccgggcgcttgatcacgccaatgcgatggctgagctcaacgcgtctccgaaagacgatattgacgagctgacggctaaatatgacagcaatcaaagcagtgtcgacgatgagttggcggcgcttaagcagaaaatgcttttcagtaaagatcaatagacagcgggctgcagctttgtccgatataaagagaaagtgagagaaacagaatgatcatttcttataaatgcccgaactgcggcgatgatatggtctttgacagttcatccggcatgctgacatgtcacagctgcgggcggcaggatcagattgaaagcctgccaaaagagtatataacaacgagattttccgaaaatgaggcgaacgagtaccgctgtgagaactgcggcgcggtattaatgactgaggcggaaacgacggccacgacgtgcgggttttgcggaggagccgccgttctcgccgaccgattatcgggaaatctcgcgccttcgatggtgattccttttacgatcagtaaagaagaagccatgagcgcttttaaaaagtggtgccgaaacggccgtctgacaccgaaaggatttatgactgccgatcgggtgaagagcataaccggcatgtacgtgccgttttggatgtttgacttaaacagcaaggttcaggtcaatgccgtttgtacgagagtgcatcactatgaagatggagaataccgggtgacggagaccgagtattacaacgcgtaccgcgatatcaatcttgattatctcaaaattccggtcgacgcttcagaaaaaatgaatgatgaattaatggacaaattggagccttactcatacagtgagctgaaggagtttaatacggcctatttagcgggatatatagcggaaaagtacaattataccgatgacgatctctttccgcgggcgaaggataaaatcagccattatattgattcttatatcagatccaccttctccgggtatacgacggctgacattacggatgagcagattcagaccgataaaatcagcagcttttacgtactgcttccggtctggatggtcagctacgactatgagcgggctgagcacatttttgcgatgaacgggcagacgggcaaggttgtcggcaaaccgccgatcagtgccggaaaagtggccgcgtggttcggcggcataaccgccggtgcgtttttagcattaagactcgtctcacttatgataggaggcggtttttgatgaaagtatcgataaaaaaagcgtgtctcttctgcttcgtcctttttctgatgctgtctttttctttacatacatcggcgtctgccgcggaacagaagcaatatgtttatgacaatgctcatttattaacgaaggatgaaacgaagaaacttgaggaattggccgggaagctgggagaaaagcgccataccgattttatcattcttaccgcaaacggaacgggcggtaaggagatcgaacagtatgccggtgatttttatgacagtcattttagcggaagcacggcgatattgactattgatatgaaggatcgggaagtatttctctccggatataaaaaggcggagacgtatttgaacagcagccggctgaatacgatcagaaatacgatctcgtcagatatttccgcaggccattatgaaaaggcgtttcagacttacatcaagatggcttataaagatatggggaaaagcccggacgacaggtctgacaatctgctgctcacatggtggtttcagctgattatcgctgcagcagcggccggaatcgccgtcaccgtgatggtgtacaattccggcggcaaggtcaccgtcaccggcagcacgtatatggatcacgatacgtctgaagtgctgagccagcacgacacatatatccgaaccgacattacaagagaaaaaaagccagataaagataatgacaatgacggcggagtcacgaggggcggcacgagttacagcggaagcaagggaagtttttaaattatatgtaaaggatttgagcatacatgggttttttcagaaatcagttagcaaatgtggtggaatgggaagaattcagagacgacatggttttctataaatggaacaaccgtgaaattaaaaaaggcagccgtctgatcatccggccgggacaggatgccatctttttatacaacgggaagattgaagggattttccgtgatgacggcgattatgatatcgaatcagaaatcattccgtttctatcgacactaaaagggtttaagtttggctttaacagcggcatgcgggcggaagtgctgtttgtgaatacgaaggagttcaccgtgaagtggggcacaaaaaacgccatcaacattccggcggcaggtatgccgggcggtatgccgatccgcgcaaacggcacatttaacttcaaggtcattgactacatcggattgattgataagattgcgggtgtcagagacagctatttagtagaggacattaaaatccggattacgtctattctcgatcagcttttgatgaaatggatcaccagagaaggaaaagacatgttcaatctgcagtcgaattcatttgaaatcggaaaagggattcaagaagatcttgatatgcagctgatcggagacggcatgtcgattacgggcttcaatattatgagctttaactatccgcaggaagttcaggatatgattacgaaaaacgcttcttacggcatggtgggcgatgtgaaccgctatcagcagatttccatgacggacggcatgtcatccggcaaaatgagcggaagcggcgccgcctcagacatggcgggcatgatgatgggaatgaatgtggcaaatcaaatgatgaaccaaatgaatcaaaatcagcagaaccagccgcagcaaaatcaaagtcagcagaatcaggggaccgaacaggcaaacggctcggaaggagcggctaagccgaaattctgtccgaactgcggaacgaaaacggaaggcgcgaatttttgcccgaattgcggacagaaacttgcctgatgatatacgaaaaagaggcctttttggggcctctttttttgtcatgatttcattgtttgaacgatgagggatgtcagcgcttttgatccctcaggtatgagatggacgccgtccggtgtgaagtattcagggtgctgcaatgcttttgcgtgccaatcgacaagcgtcacatttttgcgtgactcggcctgccggcgcaatgattcgtttactttgctttcccactgccgcggtacacgcgtgttgacaagatagatatcggcttttgaaaaggagctgatcagtgattcaatttggctgtttgtgaaatagccattcgtccctaactcgatgatgaccgctttgttcggctgattaaatgacgcatattccgaagtgagctggagtgcttgagagacttgtcttcctacctttccgtcgatggtgacatgagggagggactgccgcaggtatgacgcaatgtccagcatcaccgagtcaccgatggccagcacgtcttgctgaggctgtgtttgttttggatcagccgttttttgagatgaccgttcctttttctcgtcgtttttcttcgtatctgatttgtctgctggttctttcttgtttttgtctgacgcggtatccgttttttcgccgccgtgttttttcttgctgtcttcttcttttgcaggctgatcgtgatcggccgttttgtgcgaagaggcggcggtttcttgctgatcattctgcgcgtacgtccattgcggctgttttttctcttcggctatccctgacagcccgcccgcaaatacgagaatggcggcaagaatgaggccgagcgacattctgctgatgacagaggacgtcttccattccagaaagcggttcagaaacacgcggcgtaaaaatggccggaagcccgcagtgcggatcggctgttcaatgaaatggtaagatagctcggcaagaatgaaagtggcgccgattctgacggcgcagtgccaataaaccggatttccgatttcctgcacgggtgtgctcagtacgaaaaccgggtaatgccaaaggtagattccgtatgatctcgttccgatccagcgaagcggcttccatgaaaggacatgtcccaaaaagctgctcggatggcataaacatgcgacaagaaccgctgcggtgatgctgatcaaaagcatgccgcccttgtacaggaagggttcatattcatccgtgtaaaagacgcaaagcagcagcgcggcaaaagcggcaagctccgtcccgtgaagcaggtgtttcatgctgctcggcagccgtttggaagataatcgtttcatcggccacactaaagctaaagcgcagccgatcagcaattcaaatgaccgggtatccgtcccgtaataaacgcggctcggatctccgccgggcacatacatcatactcattacgactgccgaacataacgcgaggaacatgaccgcggccgcaagccgggcccgtgttttacatatgtacattcccgcaagcagcaggaagggccatatgatataaaactgttcttcaatcgccagcgaccaaaggttttttaatggcgaaggggagccgaagctgtcgaaataagaaagttgatgaaagataaaccaccaattgcttatgtaaaaaagtgaggagaccgcatctccgcgtacggtatgcaggagctcgctgttaaacaatacgacccaaatgaccgtcatgataatcatcagataagccgccggcagaagccgtctgatccggcgcacccaaaaatcacgcaaatcaagggtgatggcattgccttggacaggcaatataatagatgtaattaaataccccgataaaacaaaaaagatatcaacaccaatgaaaccgccgtcggcccagttaaaattcagatgatatgcgataactgcgaggacggcaaaggcgcgaagtccatccagtccgggaatatagcggtgatgcagtgacttgtctgacatggtattcctccaataatgtgtgcggaaattctcgctgttttgcggatagctatagctgatttctgtacagtcttccatttgttccgttaattagacgcattcggaaggggattttgtttcagaaaaaatgtatgaaatgctgtgattttcttaaacttttcagtcccagtccggcgtctgttatatgaaaagggtcccttatgcatcttggctgttgcgggacgaaagaaaaaatccatgatctgcggatatcatggatttttttctttctttatctgatgtagcggtctccgacaagcagcttggagatgacggaggtcggtattgtaaactctgtaacgcccatatatccgggtgccgcttcgtattcatcaaatgaaataacaagtttgtgcttatctgtaatataaaaattctggtcggcgcggatggctttaaaaggctccgtcatatcatcttcttcgacccagtatattttattcggatcttctttcatctgttttttcatttgttctttaatattttcgctgatgactttaatataacggtcatctttaaataaactctttaacgtaagcacggcctcattctttttatcaatcgtgatgtaacggctttgcgtataagatgaagcttgcgttttttcgatatcacggcggattgagatcagatccgctgtgtcagtaacggtttcataatcgctgtaaatactgaggtggccttttttgctttttgaggtcgccttcataaattcctgatacagctctttgctttctttcatataatgccggttgatgctgtcttcgagtttatgatcggaaagtccggacagagcgggcgttttcacatcaatgcttgattggttcttttcttccttcatctccgtgaatgtgatggcttggacgactttgccgatgacggggattttagacatggcttgtgcggcatccgggttgatattgacaacggcggtaaataagacggccgcagcgactgccgcggatgtcggccacatcacgattcgttttttcttcggtttttgctgaagggctttttcgacaatgctgtccagttccttaggaatgggcacacttttatactcttctcttaattgttctaatctcttttccattaagaaagatcctccttcgtcagctgaatgcgcatgagcttcagccccctgtaaaggcgtgttttgacggtgttgatgttttcccccgtgatgtccgcgatttcttctaatttcaggtcttcaaagaaacgcagaatgataatggttttatattgatgcggcaggtcatcaagcgcttcgtgaaggtctgtgtccttgtagtgatcttcctttcctcggcttaaaaactcgatcgtttcatcatccatcactttcagttttttctgtttgcggagaaaatcaatggccgtgcgcactaaaattttataaaaccagcttttgatcacatcggggtttttgacggattcgaccgatgtcagcgctttttgaattgattcctgaacaatatctaacgcgtcatccttgttttttacgtaactgtacgcaagccggtaaaagtcttccttgcgctcagttatgcacgtcacaagcgacgctttggctgtttcgttcttcattgcttcaaagggctcctttttaaaaaatacgtatcataggctgctgcctaaggatagacgggacagggtgaaaaatagtttgcgcagaggggatcatttttaaaaggaaaaggaaggaaagacgatgagatgaaaaaaagagccggaacggctctttttcggatgtgtctgatattcagctgaacggtttagttcggtttgactaagattttcacttggtttttctctttgattaaagcgccgaagccttcttcaatcagatcgtcgagcacgatttttttcgtgacgagcttatctgctgagaagtagccctctttcatcagtgcaagaacggaagggaagatgtcacggtatccgataatcccttttacggtccgttctttgatgacgatatcgttcggatgaatttccgctcctttttcccagatgctgacgataaccgtttcaccggcaatgtttgttgactggatcgcctggcggagaacgacaggaacgcccgttacttcataagaaacatcaacgccgccgtttgtgcgtttagcgatttcttcaacgacatcgtccgtttttgacggatcaatgatgatagcgccgagttctttcgctttttcctgacgttccggtgaaagttcaaccgcgtaaatatctgtggcgccggccgctttcagggcttcaatcacaagcagcccgatcggtccgcagccaaaaactgccgccttgtcgcccgcttttaatttgctttggcggacggcgtaaagcgctaccgctgacggctcaacaagcgcgccctgttcgtaagaaagctcttcaggaagcttaaacagcaattcttcgtcaacggatacatattcagaaaatccgccgccgcctccggctaagcctaagaatcccatttgttcatcaaggttataggctccctgatgtccgtgtgtggcaaaaatcggttccacgacgacacggtcgccgacgctgtaatttttgacgccttcgcccacttccacgacttctcctgagaattcgtgacccatcgtgacgggcgccatttcgtttgttaacggatgaggttcgccgaccggaataaagatcgggcctcccaaatattcatgaaggtcgcttccgcaaatcccgcaccatttgactttaattttgactttacccggttctgctttaggttcatcaatgttttcgattcgaatgtctttttgattgtgccatcttgccgctttcattgattatcactcctagtctgattgaaacgagtataggtacatgatcaatatgaaccacggttaaaaggaataaagtgcttcctaaagcctgatttctcaaaatatatcatattatgcaactatcaataggccttataaaaagtccatattgaatgcagaaatactctatgaatattataacgctaatgaattaaattttgtagtataatttaccatggaattatatagaacaggtaattgtgccgtcgttatgtgcatgtctcatcacgttgtaatgaacatgtaaagtgattgaaatattataatcgtcttcttggtgtataattttgcctagaataaagaatcaggaggacgaaagcttgaagaagttattcttagccttattgattttagcaggaagcacgctgggagcgatcagtttctcttctgatgcaagtgctaaaaaagtgaacggaaatattacatggtataatggagtcggtaaaaaaggatcttccggtaaaaaactgggacactgggattgcgcgacaaaattaggatttgacgttccgagaaacggaacgaaaatcagagcttatgcgaaagcaaaaccaaaaaaggttatcacagtatataaaaatgatgtaggccgtctgccgaatgccgtattggatgtcagcccgaaagcgttcaaagcgctcggatatccgttaagcaaaggaagagtatccggacactacagctattaaaatagaccatcttaaaaagcaaggactctgattcttgctttttctgattgacggagagattgataatgaagaagaaacgatggatctggatgttgcttgccgccgttttggcggcggcggtcatcgcgtccgttttactgatcaaaggaaaaagcgacggcggcggaaaagccgttgtctccggcggccatgacaagctgcttgtttccattacagacaaagatctgatgacgaaatattacgaggacggccgcgtgctgtacgaggaaaagctttcggcatatccggcgtttgcgctggatgacgcccatcaggtgctctattttgtcgggaataatgacgaaaatgagatgcgtctgtataagcttgatctgaagacgaaaaagaagacggtgctttataaaggaacggcaagcgctgacagtctgtttttatcaaaggatctgacgcacatttatttccgtctcggaaaagcggatgaagatattttccgtctcgcatcttttgatttgaaaacgaaacgttatgaaaatctgtatcctgccgccgatgagaaagacgacagtgtaagcagcttcttttataaccgcagccaaaacgattttgcgcttctgcattattccgtcaaagaggattatcaaaaaacggatgaggcaaatgagaaggggattgaccctgaaccgacgaatatccggtttgcagcaggagctggcgaacaccttcaggacctgacaaaccttgaacagtttatcagcggcgtggcggtgtcaccggacggaaagaaccttgtctttacatcttatacacaaaaagggacggaacaaaaagcgtccatccgtctgatgaatgtcaaaacgaaaaaagataaaacgattatctcaaacgggaaggacttcgctccgctgattgatgcccagcctcagttttctaaagacggcagcatcatttatttcatggcggaagcaaaaggcgctaagcgtctgaaggatgaaacggggcggaatgcgaaggtccggaccatttatgcttatcatttggatacgaaaaaatgcgaaaaagtctgggaaaatgaccacggcattatcaatagtttttccgtcatccaatcatgaaaaaaacactcagcgcccgctgggtgttttttcatgaacaaagctggctgcggctgaggcgagccatttgaaaaaacggagaatcggaacggcaaaatgaagcgtttcgatgaatgactgtgcggcaaggttcattttccgccgttttgccatttccttcagatctttctgctgccgatcgtttttcatgttcattgctcctttgcatcataaaaggacatgataacgcaaaggcctctcatgagacatggaggccttctctatgttgagactcgtaaaagggaggtctaacttgatgccgtttgattattgttttggagatttaccaacgaacggacgccgtcgatcattttactgccgcaaagggggcaagtcggggtatcactgccggcaaaattctttctgctccagccgatacagtcctcttttgtgcattcccacgtactgacatcttctttaggcagcggttcctgattacgtttgttgtagtaagacataaagtcacttcttcccttatgaattttcgtgcactccttcattgtctcatacttttccctaatctcctaattcctttttctatccagatttccaatgagggtgcatcgtcttcctgttattacagtatatgcaaaaaagcgccttcttattttttctttttggataaataaaaaaagccccttctggagaaagggggggatgtttgtttactgcttatccgtgacgtccatcggtctcatcatgtcgtaatcttcgtgctctaaaatatgacagtgccatacgtagcgtccgctgtaaggagcgaaagtcgccgcgattctgatgacttcccccgagtgcgcctgcacggtgtctttccagcctttttcacttggaggaggcgggacggcggggcctgtatacacaatgtcgccgaatttgttataacgctctaagtcaaagggacgccggtcaaggatttggaaggaaacaaggtgcaggtgtatcggatgggttccccccatcggattgataatcgaccagatttccgttgcgccgagcttcggcgcttctgtcacaggatcatgccatcgcttgttattcagcgtcaaaacgggccggccgtatttgtcttgcgtatttgtgagtttcagtgtcctgatgttgtgtattctttttgatgttacattaggcattgttgaaagatatttaggcttccggcttgtgtcttctcccttcagcggttttgtgacgcggaattgcatcacattggcgtctgtatccggatcgacgtcgcccccgcagccggtgccgttcgttaaaatgatatgttctccgtcaaaggcggagaaatcgatgagcacatcataccgctcggccggggctaagctgatagattgtgttttgacagagcggggaagcagtccgccgtcagaaccgatttggataaacttcccgccgttattgagcgagagagaaaatgttctcgtattggaggcattaaggatgcggaaacgatatgtccgcggttcaacttccatatacggccacgctttaccattgacgagaatggtatttccgcaaaaaaacgggacgatggaagggtcgggcagcgtttcggaaggattagcaggtccgcttggataagacaaggaaccgtcgtcatttaacgtgcggtccaaaatcataagcggtacgtcgtactctccggagggaagcttcagctgcttttcttttcgctcgcggatgatatacatcccggcaagcccggcgtacacattgagcctcgtaatcgccatggcgtgatcgtgataccataacagagccccgcgctgtttgtttggataatggtatacctctttctcaaaataaggacccgtttccttaaaatcctttgtgaaccaggcttctgggtagccgtcgctgtccggcggcgttgctcctccgtgtaaatggacgacggttttgacatcgggttcctgatggccgctttctgaatggtgaatggtatgatccacgggcagaaaatgcttatccggcaggtcattcatccatttaatatagacgttttcatctttgttcacgtcgatcgtcgggccgggaaacaaaccgttatacccccaaagccgggtcggcgggagatcgcggtgcagcttgtgaaagcattccttcatggtgacttcgtaatacgtgctgccgtctgatttcttctgcggctggagtgtttcgataatcggcagttcatctgcaaatttttctagtgccatttttcatcctgtccttatcatttattgaaatcctgtactacagttaatgctgcctggaacaggttggttaaaaaaacacccgcccttttttgagggggggtgtttgcggttattgcgcaacccggctttcggaagcgctctctttcggtttttgttttttgcggaatacatatgaggcaagtaccagcagagtaataaatcctgtcagcagaaattcagaccgcattgaactgataaacagcatagataacaagatggcgcaaatggcgatgatcgtcaggtaggttaagtacggatagaaccacattttgattttaagagattcagggtttgtccgttcgattttctttctcattctcagatgtgagacggcgatgacgagatagacgagcagtgcgatcgcccctgatgaattgaccaggaacaaaaatacggagtctggagaaaagtagttcataacaacggcaatgtaggaaaaaaaggtgccggcgataatggcttgaaccggtacgcctcttttactcagtttcataaaacgccgcggcgcttcatttcgctctgccagtgaatacagcatccgtgacgtcgtataaagcccggagttcaggcaggacagaacggctgtcaggacgatgaaattcatgatttgagcggctgcgggaaccccgatatggctcaaaacggcaacgaaggggctttccaaaatattggctgaatcccatggcagcagtgtgaccacaaccgcaatggagccgacgtaaaaaataatgatccgccaaacgactgagcgggtcgcctttgtgacggattcgaccggatttgacgtttctcccgctgcgattgcgacgatttcagatcccatgaaagaaaaaatgacaacgacgatgccgagcagaacggaacttggacctttagggaaaaatccgccgctgcccgccaaattttccagcccgaccggcttgctgccgggaacgattccgaaaatgaacgcaaatcccgcgattaagaagacaacgatcgtcgctaccttcactaaggaaagccagtattcaaattcgccgaacgatttaactgaataaatattcgtcagtgttaacagcacggtcagaagcagactcgtcagccataacggaatgcccgggaaccagtactgtatgattccggcgcctgcaatggcttcaatggcaatgacgatgacccagaaaaaccaatacagccatccgatcgtaaaaccggcccaaggaccgatggcgtcatgcgcgtactgtgaaaacgaaccgcttgtcgggttgacggaggacatttcccccagcattctcataataaaaatcactaataatcctgctaaagcgtaggagacaatcgctccgggtccggtggaatgaatgactgatccgcttccgacaaataatccggcgccgatcacgccggcaattgaaatcatggtcatatgccgggtttttaatcccttagataaagagttaggctgattcattctttgcctccttttggtttgtttatgctgaatattcagacaagtattattctatcataaatgccacagacagttgaaaatgatgtaagaaaatatgacatttttttcgcattcgtacagcagaaggcgccgggatgaaagaggaacatgccattgaccattcacacgttcatatggagcctctccagctgaaataaagcttcctttctaaagggagcttttttcctttttcggactggaaacaattcgctggaaacgtttttttatactgtttatattttgtggtaaagttaggttacgataattgaaatttgagagatgactaggaggagaagaatggcttataaagaagagctgcatccgctgctggagaaagccgttgagcatattgaaaacatcatcataggaaaacgggatatcgccatactcagtctggccgccattctcgcaaaagggcatgtgctgctggaagacgtgccgggagtcggaaaaacgatgatggtccgggctttggccaagctgatcggagctgactttaagaggattcagttcacgccggatcttctgccgtcagatgtgacgggtgtctctatttataatacgaaaacaatggaatttgaataccgcccgggaccgatcatggggaatatcgtgctggctgatgaaattaacagaacctctccgaaaactcagtcttccctgcttgaggcgatggaggaagggaatgtcacgattgacggaaagacaatgcggctggctgagccgtttttcgtcatggccacacaaaacccggttgaatatgaaggaacgtatccgcttcccgaagcccagcttgaccggtttttatttaagctgcgcatgggctacccgactgccgaggaggagcttcgggttctgtctttgcaggaagggcgcaatccgcttgaaacaatcgagcccgtcatttctaaagaacagttcatcaccctccagcaaaaactggagcaggtgcgggtggatgatggagttaaagcgtatatcgtcggcattactcagcatacccgccggcatccgtccgtacatctgggcgtcagcccgcgcggttcaatttcaataatgaaagccgcgcaggcgtacgcgctgcttcatgaccgcgattacgtcattcctgatgacgtccagtatttggctccgtatacgctgccgcacagaatgatcttgaccgccgaggcgaaatttaacgatgtgacgccggaagcggttatagaagacatcatgcaaacggaaaaagttcccgttcaaaggatgtcggtccgctaatgagaaagaagatgcattggcttctatatggctggaagctgcttatgttggccgtactgacggcggctgtcttttcttatgccatgtttcagggcggatttgtgagctggtttttattttatgcgtttttgccgtttaccgtttacgccgggctggtcgctgtgtacccgttgcgggcgtttcaggtgacgcgtgacgtgtcctccgcccagttaacctcaggcgacaggctgtctgccaccatcaggctgacgaggcgcctgccgtttccgctgacatatatggtcattgaagatgtgatgccggaaacgcttggtgagaggcgcagtgcgaaacagcttgtgtttccgtggtttcaaaggaagatgacgttacaatatgagctgccgcaggtgccgcgcggagagcatcatttacatacgatcagagttcggacgggagatgttctcgggcttttggacaagacggcgtcgttttccgtaacggatacggttctggttttcccggcgtacgggcctgttcactataagccgcaggctgcatccggagaagagggtgcgggtgccggcgctccgtttcaggtacaccgcacagcaatggctgcgagcgtcagaaattatcagccgggcgaccggttttccgcacttgactggaaaacatcggcgcgtcgaaatgagctgatgacgaaggaatttgacccgttgcagagtatgaatatgattctccttttggactgcaggccgtccccttcgtttgaagccgcggtgtcagcttcggcatccctgctttacacggcgcttgtgaagggctctcccgcaggatttatttcattggggagcgaccggactgtatttcccgtccgggagggagagcggcatttcagacagatgctgcgttacctggcatcagcttcagagtcggaagaagccgatgcaggcgggcgtttagggaaagaactgggtaaagcttccattgccgtcgtgacgggcagtcttacagaagaccttctcaaacaggctgagcccggccgtgctgacatgacggtgtttttggcgaaagaaacgaatgccgcgctttcggagaaagaacggaaactcgctctcatcttcgctcagaaaaatattaaggtgcaaatgatcagggacaaacgggtgtcccatgttgtttagaaagagaggtggcgcgccatgccgcatgacgagaaccagggaagcaggctgagtctgctgctgttttattttctcgcttttttattgttatgggaatggctcaggccgctgcacaattttacggatacaaaacataccggttttttcatcgtttttatcggtttggcatttctgctgtcattcttccggatgaggtggtacgtgaccgtgccgtcctgcattctgtttacgttgatcagtattcacatcctgttttataaaggttctatttttcagccggaatggctcgtttcttttttgcgggacgtgatgcaaaatgcccgccacatcggaaccggaagatggaatgatatgaatccgtcattccgcacgttgctgttttttgtgcttttatggctgctcgtgtatttgctgcattactgggtgatctatcagcggaaaatattattcttttttatcatgacggtggcgtatatcaccgtgcttgatacgtttactccttatgatgccgcgtacgccgtcatccggatcgtctttatcggctttttgatgatggggcttttgtatatggagcgcatccggcttacggaacacatagcgtttaaaaaaagattgatactcaaatggtttctgccgctgatgctgtttatctgcgcttccgtagtgttcggtctggcggctccgaaatcagacccgaactggccggatcccgtgccgtttctaaaaaaaatcacaaaccacaaagaagtgcccgccgccgaaagtaaaatcggctacggcaatcatgatgaaacattgggcggtccttttcaggaggatgatacgccggtttttacatggaagggaaaagaacgggcgtacttccgggtggaaacgaaagatacatacacggggaaaggctgggtggagaccgatcagggcatgtcctataaactgaacggcggcaatgtggaagatatatggtttgaccggagtgtgcagacgagacggtatacggcacaggtgtccattgatgagaattatctctataatcacgtcatgtatccgatcggcgtctccaatattaaaccgaagcactcgattcagcttgaaatgaacggaaacaccgagcaaattacgccggtcagtgaacaagtgggcaacatccgcaatatgggacggtacacggtgacttttcaggcgcccgtctttaagctgaatgatctcagaaaagtgaaagtgaaacgataccgtgagcagaatcaattcaatgaccggtatttacaggtccccgacagccttccgggaagagtgcgacagcttgcggacagattgacgcgggatcatcataatatgttcgataaagcgaaggcgatcgaggattatctcggatcttccgcattttcgtataatacacaggatgtcgcggttccggagcacaatcaggattatgtcgatcaatttctgtttgaaacgaaaagaggatattgtgataacttttcatcggcaatggccgtgctgctccgctctgcgggaattcccgcccgctgggtgaagggctatacatccggtgaatataaaggggcaggcgaccataacggccacatttatgaagtcacaaacaacaacgcccattcgtgggtagaagtgtattttcccgatcagggctgggtgacgtttgagccgacaaaaggcttcaccaatccgacggagtttacgtcagagcaaaatcataccgcggcaaaagacagcggaggctcagcggggaattcggattcaccgtctgacaagcagcgtcaggaaacaaagccggaaaaagaagaaacaccgaaaaagcgggatcacagcgcggcaccgcagcctgtgatccgcaacaaaaccgcggcacacctgtggccgtatgcagccatcgtcatcgtaatttcagccgcggcggcactcgcctggctgttccgggtgcgctggattccgcacgttacagcagccggattgaagcggcgaacggatgaagacgtctttttcgacgcatatgccgcgctgctccgccagctgaaacgaaaagggttcagcaggggagacggagaaacgctccgcgattttgccgcaagggttgatgaggcgcaccatacaaacgacatgtccgagctgacgctgcgctatgagcgtgctttataccgcagcgataatgccgcaaagctttggaatgaatcgggacagttgtgggaaaatataattaaaagaagatagtcttgaccgcatatcgtcctgttgttagaatatatgaatgttaaatgggagcccgggagcgttaaaaagccgggcttccggacaagtcttgccgacagagggctgaacgtgtgtcctccgttttttctgtgtcaaaaacttagaggagattaggtgacaaccatgacgaagttagtgaatgaaatgattcttgttcttgatttcggcagtcagtataaccagctgattacccgccggatccgtgaatttggcgtatatagcgagctgcatccccatacgttgacagctgaggaaatcaaagaaatgaatccaaaaggaattatcctttcaggcggaccgaacagtgtatatgatgaaggatctttccgctgtgatgaaaaaatctttgaactcgatattcctgtattgggcatctgctacggcatgcagctgatgactcattacctcggagggaaagtcgaggcggcaagccagcgcgaatacggaaaagcgaacattcagattcaaggaactccagacttgttcaaggatcttccggaagaacaagttgtctggatgagccacggcgacttagtcgtacaagtgccggaaggatttacggtagacgcgacgagccatcactgcccgaactcggcgatgagcaaaaaagacaaaaaatggtacggtgtgcagttccatccggaagtccgtcattcagaatacggaaatgaccttctgaaaaactttgtcttcgggccttgtgaatgtaaaggcgaatggtcaatggaaaactttatcgaaatcgaaatgcaaaaaatccgcgaaacagtcggagacaagcaggttctttgcgcgctaagcggcggtgttgattcctctgttgtggctgctttaattcataaagcgatcggcgaccagctgacttgtattttcgtcgatcacggcctgcttcgtaaaggcgaagctgaaggcgtcatgaaaacgttcagcgaaggctttaatatgaatgtcattaaagttgatgcgaaagacagattcttaaacaagctgaaaggtgtttctgatcctgagcaaaaacgcaaaatcatcggcaacgaattcatttacgtatttgatgatgaagcggacaagctgaaaggcatcgattaccttgcgcaaggaacgctttacacggatattatcgagagcggtactgcaacggcgcaaacgatcaaatcgcatcacaatgtcggcggacttcctgaagatatgcagtttgaactgatcgagccgctgaacacccttttcaaagacgaagtgcgcgcgcttggcacagagctcggccttccggatgatatcgtatggcgtcagccgttcccgggccctggacttggcatccgcgtactcggtgaagtaacggaagaaaaacttgaaatcgttcgtgaatcagacgcgattctgcgtgaagaagtggcgaaccacggccttgagcgcgacatctggcagtacttcacggttcttcctgacatccgcagcgtcggcgtcatgggagatgcgagaacgtatgattacacaatcggtatccgtgccgtaacatcaattgacggcatgacatctgactgggcgcgtatcccttgggatgtgcttgaagtgatttcaacacggatcgtcaacgaagtgaaacacatcaaccgcgtcgtgtatgacattacgagcaagccgcctgcaacgattgagtgggaataaatgaagataaaaaacgtctcttttaaaaaagaggcgttttttttcatctttttgaaaccgttttgccccgattcatatctaacagcataggaggtggataaggtgaaggaagaacgattgatcaaaaaggcgaaaaaaggtgatgccgcagcctttgaaaaactgatcacaacccatcaggagactttatataaaacagcttatctttatttgcatcacaaggaagatacactggacgctgttcaggaaacggcttacaaggcttttcttcatatcgcacagctgaaggagccgaaatattttaaaacgtggctgatccggattctgcttcatacgatttttgcgatgaggaaaaagcacggagacgtcattccgtttgagccgcagcacgatacgcgcgcggagaataagaatattgaagaatacatagatcttcggaatgctctggaaacgcttgacgaacatatacagctgaccattcagctttattattttcaagatttctcgattggtatgatcgctgaacagaccggtatggcggaaggcactgtaaaaacgcatctctacagggcgagaaaagcattgaagcaggaactggaaaaggaggataaacacatatggaaaagcatcaaatgaagcaattgtatcaggacattgacgtgccgaaagctgagttgaaaaacgtgatacacagcgctgctgtccgtgccggaaaagaaggcgccgtcagacggagatggggacgaaaagtgataaacggcctcgcggttgctgctgctctgtttattctgtatctgtcctcaggcttgttcatgccctccgttaacaccgctatgggaaacattcctgttgccggacaaatttacagtctgtttcaggataaggcaggttctgcgctgtttaaaagcaatttggtgacaaaactgaacgaaaaagcggaatcacgcggaatcacggtgacagtgaaaagtgtgtattacgacagcggacagctcgtttataactttatcgttgataatttgaaatcagatgaggagagcatctcttttcaagtcgattataaagatccacggaatatgttagcagaggattatgacagcagtgatatgaaaaaaatgaaagacgggcggtacgcggggcagcttcgcctgttcacggacggctcaaagctgaaagacggtgataagcttccgcttgtcattacacaaatcaaggatatccccggaaactggcgctttacactccctattaaaaaacaaaagtccgtttctcttgaaggaacgaaagctgtgaatgtaaatcacggattataccgctttttcgatatccgggcggaaaacggaacgatgggatcggctctcctgtattctatcgacttctatgatgcagccaaaaatgatgccatctcgattgacgaagcaacggatgatgctggaaaccattatgaaatgacgatgtcgaatattgaacttggcggcaggaagaatcttcccggcggcgggaaaagaatacgcggccaaactcaattcagcaaaccgatagacccgaaagcgaaaacacttttcataacgggtgatataaaaacagaatcagagccgggagaaatcgtgcctctgaaaacaaaactgcccgtcagttataaaacgaaacatcatcatgtcggcattaccatcaaaaagatcaaacagcaagacagacgggtgatcgtcgattatcaattcacaggaattaattacagcaaagcggataaagatcagctgatgaatgtcggtgaatcaatcggtctcggcaatacgaaaaaaatgaaaacttggccatcgcttaatgagtatgaaaaaggctattatctgaaagggaataaggcgaaagtcacgaatcttaaaaagggtgaaatggaatccgtttttgaattagatgattcatccgataaagactattcattgcgcgatttctcattcgattcatatgctttgtacgtcaatcaaacggttatgaacttgctggcggatgacaaggggatcacattcgcggtgccggttcggcctgcgaacggaaaatgatgccgggaaggcggcccttgccgtcttccatttttggtcaattaacgaataaaccaattttttttaactggattgttcgtttttttattgagttttcaaaattgaattgatacaatagactcagaaatcaaatatgcagatatcgtataatggcggggatatggcccgcaagtttctaccaagctaccgtaaatggcttgactacggatcaatctcaatcgtttgatataaataatccattcttatttattcagactgaacgtatgtagtcaagcgtcccaaatgtatttggggcgttttttatttggcggataacgggcagaataaatgggagagaatgaaggaggcaattggcttgaagcaattttttcagtttgatgagctggggacaagctatcgtaatgaaatcatcggcggtttaacgacctttttgtcaatggcgtacattctgttcgtcaatccgctgacattgtctttaaacggtgtgaaaggatttcccgaagcattaaaaattgatcagggcgcggtgttcaccgctacagccttggcatctgcggccggctgtattttaatggggcttattgcaaagtatccgatcgcgattgcgccgggtatgggattaaatgcgttttttgccttctctgtcgtactcggcatggggatttcatggcaggctgcgctttccggcgtcttgatttccggaattatcttcgtggcgctttcactgacgggattgcgggaaaaaatcattaatgcgattccgcctgagctgaaattggcggtcggcgcgggtatcggtttgtttatcacatttgtcggtttgcagggttcgggcattattgaagcgaactcatcgactttggtgtctatcggcaatattcacagcggccctgtgctgctgacggttttcggtgttattgtgacggtcattctgatggtgcttcgcgtaaacggcggcgtgtttatcggaatgcttttgacggcggttgccggtatgatctgcgggctgattccggttccgacacacattgtcggcagcgtgccgagtcttgcgccgactttcggacaggcgtggatgcaccttccggatatcttctccgtacaaatgctgattgtcattttaactttcctgttcgtcggatttttcgatacggccggtacgctggtagctgtagcgacacaggccgggctgatgaaggaaaacaaacttccgcgtgcgggaagagcgcttttggcggattcaacatcaatcgttatcggagccgtgctcggtacgtctacaacgacttcttatgttgaatccagctcaggcgttgcggcgggggcgcgctccggcttcgcggctgttgtgacgggcattctctttttgctggcgatgtttttctcgccgcttctgtcagttgtcaccacgaatgtgacggctccggctttaattatcgtcggcgcgctgatggtggcgccgctcggtaagatcgcctgggataaattcgaggtggctgttccggcatttttaacgatgattatgatgccgctgacgtacagtattgcgacggggattgcgatcggttttattttctacccgattacaatgatctgcaaaggaaaaggaaaaagcgttcacccgattatgtacgggctgttcgtcatctttatcctgtatttcatcttcttgaaataacggaaaaaccggctggggaaagccggttttttgtttttgtcctattccgtaaaaccaatacataatataaaacgtcatgtgggtgtccgggtgaagaaaaccgcttgactgtttaaggccgcttcggtaccttatataagtgttttattttcttgctaaacaaattccgccgtatttttttgataggagttgctgacatgacggaagaaagaaaagaaacgttggaagaagaaaaacagcatcagggaactgatgaagaaccgctgtcgagaatgtccagaaatgcgggacgttatcaaaagcaaaagaaaaaagaaaaggaacggcgcccggctccggcttttacggaaaaactcgcttctgcatgggccgcggtcaaacgttattgccgtttcgcgctgcgcattttgacatcaccggtgaaggtcgttggggaagacggcttttcccgctttaaatatgctcttatttcaatgcttgtattcagtatctttttctcaatcggaaattggtttcagctgagggcaagccagcaaaggcctctcggatacggggagcggcatcatacgttttttgacggctttaccgtcgttctcgtgtatacgctcgtcttttttgccgctgcggccggcgcggtctggcttgtatcacgttatatgatgaagcagaaaattacgatgcgggatgcggccgcgggggtcggatcgcttttggttccggctgtcgcctgctctatcgtgtggatgattttcgcgatattgaatctgccggtcatcaccgtggtgtttacggcgctgaccttgtttctggccgcctcggcgatggtgcagtttgtgcagattctatacaaatcggctgaaaagcctgcggctgacgtgatgtactgtatttccgcggcggtcatcatcatgctcgtttttacggctgtgacatggccgctcatttccgagtactttactgcttcgctgattcctttataagtcgaaatttgtctttcacaatgtttacaaatttttctaatgaagcgtgttgttttgaggacccggccgagatatgatgagagcaacagcaattcgaaagcggcactactctttatgattcggaaagggatgatgaagatggccccgttgttgcgagaagccattaatcggaaaaaacagcacctgaggacaaaactgatccgctcagggttttatcaagaccatgttcaggaactgtccgggtacacgctgagtgaacttgagaaggaatatgaagccgtcaaacgattgaaaaaagccgagcttcactgataagagcttgagagtctgccttgcggggcgggcttttttttcttttgaaaatgatgaaaagagggtaaactatccttaattgaaagattggcttttcaaagtcagaggaggggaatcagtgatgcagacaattttatccaacagtataggtatggttctcattattctcatcattaacattatatatgtctctttctttacgatcaggatgattctgacattaaagggacagcgctatttcgccgcaggcatcagtacaattgaaatccttgtgtatgtgaccggcctgagtcttgtgctcgacaatctgaatcaaattcaaaacgtcattgcctatgcgctcggctacggcctcggcgtcatagtgggaatgaaaattgaagaaaaactggcgctcggctacataacagtcaacgtcattacgaaggagctcgatctggacctgccgaaacagctccgggaaaaaggatacggtgttacaagctgggttgcgggcggacttgaaggagaccggaccgccatgcagattctgacgccgcgcaaatatgagcttcagctgtatgatacgattaaaacgcttgatgaaaaagcgtttatcatcgcctttgagccgaaaacgatccacggcggattctgggtgaaagcagtgaagaagaggagaattaaggaatgacaaagccaaaaaagaaacggtttgaagtaacggaacatgaaacgattgacaccattctcactttaatgaaggaagagggttatatgcccgtccggcggatggaagagccgatctttacagaaaagaaagaaaatggatcaattcaagtcgttccttgcgggaaaaaaatcgtatttgaagggaaattgatctaaacacgaacattaaaagaaagaatttttatatcgttcgataatgtcgttgacattatccaagtccgttgttaagataaacatgaaatcaaaacacgacctcatataatcttgggaatatggcccataagtttctacccggctgccgtaaacggccggactatgcaggaaagtgataaacagctgacatggatatcgcagaagcgaacgactgacgatacgcgcgccatgcccggtttgtattgcttcctcatagttgcaatataagccgggcttttttttctgaaaaacaaagcatgagaaggtgggaacagaatgcagccgctagcaggaatcatcatgggaagcacctccgattgggagacaatgaaacatgcatgcgacatacttgacgaacttcacattccttatgaaaaacaggtagtatccgcgcatcggacgcctgatttgatgtttgaatatgcagaaagcgccagagacagaggcttaaaagtcattattgccggagccggtggagcggcgcatctgccgggtatgacggcggccaaaacgacactgccggtgatcggcgtaccggttcagacaaaatcgcttaacgggcttgattctcttctgtctatcgtacagatgcccggcggcgtgccggtcgcgacaacggcgatcggaaaagcgggcgcagtgaacgcgggtctgttagccgcgcagattttgtcggcatttgacggtgacattgcggataaactagaggcgagaagaaatgcgacaaaacaaacggtgctggaaagcagtgatcagcttgtctgataaaaaaacgatttatcccggcgccgtcatcggcattatcggaggcggacagctcggaaaaatgatggctgtcgccgcaaaacagatgggctataaagtcgcagtcgtcgatcccgtgaaagactcgccatgcggacagatcgccgatattgagattaccgcccagtacaatgaccgtgaagcgattcaaaaattggccggagtcagtgacatcattacgtacgaatttgaaaatatcgattacgaggcgctcaactggctcaaagaacatgcatatcttccccagggaagcgagctgctgcttatcacccaaaacagggaaacggaaaaaaaggcgatccagtcagcaggctgtcaagtcgctccttatcggatcgtaaacagcggacgggagcttgaggaagctgttcaggcactggggctcccggcggtgctgaaaacatgccgcggcggatatgacggcaaaggccaatttgtcattaaggaagaaggacagacagacgaagcggccgcgctgctagaaaacggcacgtgcatactggaaagctgggtatcgttccggatggagctttccgttatcgtgacgagatcggtgcacggtgagatttcaacctttccggctgctgaaaatatccacaaaaataatattctgttccaaagcatcgtgcccgcgagagcggaggaaacggttcaaaagcgggcagaggcgcttgccgtccagctcgcggagaaattggagcttgtcgggccgcttgcggtggaaatgttcgtcacagaagacggagaccttttgatcaatgaactggcgccgcgtcctcacaactccgggcattatacgctcgacctttgtgaaacgagccaattcgaacagcacatcagagcggtctgcggacttcctctcggcagaaccgatcttctcaaaccgggaatgatggtgaatctgctcggtgaggaagtgaagcttgcggaggagcatacggagcttttaaaagaagccaaactgtacctgtacggaaaacatgagattaaaaaagggcgcaaaatggggcatatgacatttttgcggaagcctgatgaaacatggattcaggacatcacgaacatatggatgaaaagagacggaggacgagcataatgatcgaacgttattcaagacctgaaatgtccgcgatctggacggacgaaaacagataccaggcatggctggaagtcgagattttagcctgtgaagcctgggctgagcttggcgtcattccgaaagaagacgtcaaggtcatgcgcgaaaacgcgtcttttgacatcaaccggattttggaaatcgagcaggatacgcgccatgacgtcgttgcatttacccgcgcggtttcagaatcattaggcgaagaaagaaaatgggtccactacggcctgacgtcaacagatgtcgtggataccgctctttcctatctattaaaacaggcgaatgagatcttgctcaaggacattgagagatttgttgacattataaaagaaaaagcgaaagaacataaatacacggtcatgatgggccgcacgcacggcgtacacgcggaaccgacgactttcggcctgaagctcgcgctttggcacgaagaaatgaaacgcaaccttgaacgtttcaagcaggcaaaagaagggatcgaagtcggcaagctttccggcgcggtcggcacatatgcaaatattgatccgttcgtagagcagtatgtctgtgaaaaactcgggctgaaagcggcgccgatttccactcagacattacagcgcgaccgtcatgcggattacatggcggcactggctttgatcgcgacgagcattgaaaaattcgcagtggaaatccgcggtctccaaaagagtgaaacacgtgaagtggaagagttttttgctaaaggacaaaaaggctcatcggctatgcctcataaacggaatccgatcgggtcggaaaatatgacgggcatggcgcgcgtgatccgcgggtacatgctgacggcatacgaaaatgtaccgttatggcatgagcgtgatatttctcattcatcagctgagcgcatcattcttcctgacgcgacaatcgcgctgaattacatgctgaaccgattcagcaacatcgtcaaaaacttaacggtattcccggaaaatatgaaacgcaacatggaccgcacactcggtttaatctattctcagcgcgtgctgcttgctttaatcgacacgggtctgcctcgtgaagaagcatatgacacggttcagccgaaagcgatggaagcgtgggaaaaacaagtgccgttccgccagcttgtcgaagcggaggaaaaaatcacgtcccgcctcacaccggaacagattgccgattgctttgactacaattatcatctgaaaaacgtcgacttgatctttgagcgtttaggtttatagaagaagccagccggaggcggcttcttcagccgccgtagattgaatattcccaacattcgggttaggaggccttccgtgaatattgtgaacaataatcttctttatgaaggaaaagcgaagcgaatttatcaaactgaagacgaacagattctccgcgtggtctacaaggattccgcaacagcctttaacggtgagaaaaaagcggagatcagcggaaagggccgtctgaacaatgaaatttcaagcctgattttcaaacatctgcacgccaaaggaattgacaaccactttgtggagcgtgtttcagaatcagagcagctcatcaaaaaagtgagcatcattccgcttgaagtcgtggtcagaaacattgccgccggaagcatgtcgaaacgtctcggcatcccggaaggaacagagctcccgcagccgattatcgaattttactacaaggatgacgcactcggcgatccgctcatcacagaagatcatatccggctcttaaaagcggcggctcctgagcatgtcgaaacgatcaaatcgattacaaaccaggtgaatcaagaacttcagcatatttttgaagactgcggggtcagattaatagattttaagctggaattcggcttagacgcagagggacgggtgcttttagcggatgaaatttctcctgacacgtgccgtctgtgggacaaagacacaaacgaaaagctcgataaagatttgttcagacggaacctggggagcttaaccgacgcatacgaagagattttcaaaagactgggaggcatttcataatgtataaagtgaaagtttatgtcagcttaaaagaaagtgtgctcgatcctcaaggaagcgcagtgcagcatgcattgcacagcatgacctacaatgaagtgcaggatgtgcgcatcggaaaatacatggagctgacgatcgaaaaatctgaccgcgatcttgacgcgctcgtgaaagaaatgtgtgaaaagctccttgccaatacagtcattgaagactaccgatatgaagttgaggaggttgtcgcacagtgaaatttgcggtgattgtgttacccggctccaactgtgatattgatatgtttcacgccgtaaaggacgaactcggcgaagaagtcgagtatgtctggcacgaggaaacaagccttgacggatttgacggcgtgctcatccccggcgggttttcatacggcgactacttgagatgcggcgccatcgccagattcgcaaacatcatgccggccgtgaaaaaagcggctgccgaaggaaaaccggttctcggcgtctgcaacggattccagattctgcaggagctcggacttctgcccggcgccatgagacgcaacaaagatttaaagttcatctgccgcccggttgaattaatcgtacagaacggcgatacgttattcacatcttcctatgaaaaaggacaatcgattacgattccggttgcccacggcgaaggcaatttctactgtgatgacgaaacgcttgaaagattaaaagaaaacaatcaaatcgtcttcacatacggcggcgatattaacggaagcgtcagcggcattgccggcgtcgtgaatgagaaaggcaacgtattaggcatgatgcctcaccctgagcgcgcagtcgatgaactgctcggcagcgcagacggtcttacattgttccggtctatcgtgaaaaattggagggaaactcatgtcgctactgcttgaaccaagtaaagaacaaataaaagaagagaaactctatcagcaaatgggtgtcagtgatgacgagttcgcactcattgaatctattatcggaagattgccgaactacacggaaatcgggattttttccgtgatgtggtcagagcactgcagctataaaaactcaaaaccggttttacgcaaattcccgactagcggcgaacgcgtgctgcagggtcccggagaaggcgcgggaatcgttgacatcggtgacaatcaggcggtcgtgttcaaaattgaatctcataaccacccgtcagcgcttgagccataccaaggtgctgcgacgggagtgggcggcattatccgtgacgttttctcaatgggcgcccgtccgatagctgtattaaactctcttcgatttggtgaactcacttcacctcgtgtgaagtacttgtttgaagaagtagtggcgggaatcgcgggatacggaaactgtatcggcatcccgacggtcggcggagaagtgcagtttgacgcaagctatgagggcaatccgcttgtcaatgcaatgtgcgtcggcttgattgatcataaagatattaaaaaaggccaggcgaaaggtgtcggcaacacggtcatgtacgtcggcgctaaaacgggccgcgacggcatacacggcgctactttcgcatcagaagaaatgtcagattcatctgaagaaaaacgttccgcggtgcaggtcggcgatcctttcatggaaaaacttctcctggaagcatgccttgaagtcatccaatgcgacgccttagtcggcattcaggatatgggggcggccggtctgacaagttcgagtgctgaaatggcaagcaaagccggctccggcattgaaatgaaccttgatctcattccgcagcgggaaacgggtatgaccgcttacgaaatgatgctttccgagtctcaggaacgcatgcttctcgtcattgaacgcggacgtgaacaggaaattgtcgatatttttgataaatatgaccttgaagcggtttccgtaggtcatgtgacggatgataaaatgctccgcctccgccataacggagaggttgtttgcgaacttccggtcgacgcactggcggaagaagcgcctgtataccacaaaccgtcagcagaacccgcgtactaccgcgagtttcaggaaacagaagttcccgcgcctgaagtaaaagatgggacagagacgctttttgccctgctgcagcagccgacaattgccagcaaagagtgggtgtatgatcaatatgactacatggtgcgcacaaatacggtggtcgctccgggctctgacgcgggagtgctcagaatccgcggcacgaaaaaagcgctggcgatgacgacggattgcaacgcccgttatttatatcttgatccagaagaaggcggaaaaatcgccgttgccgaagcggcgcgcaacatcgtatgctccggcgccgaaccgcttgcggtcacggataatctgaatttcggaaacccggaaaaacctgaaattttctggcagatcgaaaaagcggccgacggcatcagcgaggcgtgcaatgttctcagcacacccgtcatcggcggtaacgtatcactttataatgaatcgaacggaacggctatctacccgacgcctgttatcggcatggtcggcttaattgaagataccgctcatattacgacacagcatttcaaacaagcgggggatcttgtatacgtgatcggcgaaacaaaacctgagtttgccggaagcgaactgcaaaaaatgacagaaggccgcatttacggcaaagcgccgcaaatcgatcttgatatagagctgtcacgccaaaaagcattgcttgacgcgattaaaaaaggcttcgttcaatccgcgcatgacgtatctgaaggcggcttaggcgtagcgattgcagaaagtgtcatgacgacggaaaaccttggcgccaacgtgactgttgaaggggaagcggcattattattctctgaatctcaatcccgcttcgtcgtttcggtcaaaaaagaacaccaagcggcgtttgaagcggctgcggctgatgcggttcatatcggtgaggtaacggctgacggacttctggcgattcaaaaccaggacggacaacaattggttcacgcgcaaacgaaagaacttgagcgcgcgtggaaaggagctattccatgcttgctgaaatcaaaggcctgaatgaagaatgcggtgtgtttggcatctggggacatgaagaagccccgcaaattacgtattacggtctccacagcctccagcacagaggacaggaaggcgcgggaattgtcgcgactgacggcgaaaaactgacggcgcacaaaggccaagggctgatcactgaagtatttcaaaacggcgagctcagcaaagtaaagggaaaaggcgcgatcgggcatgttcgttacgcaacggctggaggaggcggatatgaaaatgttcagccgctcctgttccgttcgcaaaacaacggcagcctcgcgctcgcccataacggaaacctggtcaacgccacacagctgaagcagcagcttgaaaaccaagggagcatttttcagacttcctccgatacggaagtgctggctcatctgattaaacgcagcggacacttttcgctgaaggatcaaatcaaaaattcgctatctatgctgaaaggcgcttatgcctttttaatcatgactgaaacagagatgatcgtagcgcttgacccgaacggactcagaccgctgtcaatcggcatcatgggcgatgcttatgtggtcgcttcagaaacgtgcgcatttgatgttgtcggcgcaacgtaccttcgtgaggtagagccgggcgaaatgctgatcatcaacgatgaaggcttgaaatcagagcgtttttccatgaatatcaaccgttccatctgcagcatggagtacatttatttctcaagacctgacagcaatatcgacggcattaacgtgcacagcgcccggaaaaacctcgggaaaatgcttgcccgggagtccgcggttgaagcggatgtcgtcacaggcgtgcctgattccagtatttctgcggccatcggctatgccgaggcgacgggcatcccgtatgaactcggtctcattaaaaaccgttatgtcggcagaacgtttatccagccgtcacaggctctccgtgagcaaggcgtcagaatgaagctgtccgccgtccgcggtgttgtcgaaggaaaacgggtcgtcatggttgatgattccatcgtgcgcgggacgacaagccgccggattgtcacaatgctcagagaagcgggggcgacagaggtgcacgtcaagatcagttcaccgccgatcgctcatccgtgcttctacggtatcgacacatcaacccatgaggagctgatcgcttcttctcattccgtggaagaaatccgtcagatcatcggtgccgacacgctttctttcttaagtgtagacggattgttaaaaggagtcggccgaaaatttgaagacaccaattgcggacaatgcctcgcttgttttacgggcaaatatccgacggaaatttatcaggatacagtgcttcctcacgtaaaagaagcggtgctgacaaaataaaatgtgaaaatgacataaaggcagcgggaattcaggctgcctttctctttctgcctttttaggagaaacgaattgacaaggagtgatagggatgtctgatgcttataaaaatgccggagttgacatcgaagccggatacgaagccgtcaaacgaatgaaaaaacacgtggagcgcacgaaaaggctcggcgttatgggaagcctgggcggttttggcggaatgtttgatctgtcagagcttccgtatcaaaagcctgttttaatttccggaacagacggtgtcggcaccaaactgaaactcgcattttcaatggataagcatgacacgatcggcgtcgatgcggtcgcgatgtgtgtaaacgatgtgcttgcccagggagcggagccgctgtttttccttgattatttggcggtcggcaaggctgatccggtgaaaattgagcagatcgttcagggtgtggcggacggatgcgagcagtcaggatcagcgcttatcggcggtgagacggcggaaatgccggggctgtatacgtctgatgaatacgatattgcgggcttttcagtcggcgtcgcggaaaaagacgaaatcgtcaccggtgaacatatcgaagaggggcatctcttaatcggacttacttcaagcggccttcacagcaacggattttccctggtgagaaaagtgcttcttgatgacggcggacttgatttggatactgtctatgaaccgtttgcgcgtcctctcggcgaagaattgctggaaccgacgagaatatatgtgaagccggtgctcaaggcggtgaaaagcggtaaggtggacggcatggcgcatgtgacaggcggaggattcatcgagaatatcccgcggatgctgccggacggattgagcgcggaaattgatcacggatcatggccgatcccgccgatttttccgtttctgcaggagcacggcaagctgaaagaagaagaaatgttcaatgtctttaatatgggcatcggttttgtccttgccgttaaagaagaaaacctgacagacgtcatcggcacgcttgaagctcagggcgagaaggcttatctgatcggccgggtcaagcggggcgaaggcatttctttcggcggtgcggctctttcatgaaaaagtttgcggtatttgcttcaggaaacggatcgaacttcgaggccattgccaaacgcatgagagaagagaagtgggatgcggagctctcgcttctcgtgacggataagcctcaggcaaaggcggcggaaagggcggaggctttacatatcccgtcattcgcctttgaaccgtcatcttttgaaaacaaagcggcctttgaacgggccattattgaacagctgcgcctgcacggggcggaattaatcgttctcgccggctatatgagactgattggagatacgctgcttgaagcatacggaggacgcattattaatatacatccctcgcttcttccggcattccctgggattgacgctgtcggacaggcgtatcgggccggtgtgaaagtggcgggcattaccgttcattacgtcgacgaaggcatggacaccggaccgattatcgcgcaaaaagcattcgaaatacaggaaaacgatacgcttgaagacatagagcatacaatacacgagcttgagcacaaatggtatccgagcgttgtgaaacggctgctgggactaaataacagaggtgaaaaggcatgacaatcaaacgcgcactaatcagtgtttctgataaaacaaatctcgtacctttcgtaaaggaactgacagagctcggcgtcgaagtcatttcgaccggaggaacaaaaaaacttcttcaggaaaacggtgtggatgtcatcggcatttcagaagtgaccggatttcctgaaattatggacggacggttaaaaacactccatcctaatattcacggcggtctgcttgccgtaagagacaataaagagcatatggcgcagatcaatgaacacggcattgcaccgattgaccttgtggtcgtcaacctttatccgtttaaagaaacgatttcaaaagaagacgtaacatacgatgaagcgatagaaaacattgatatcggcggtcccggcatgctgcgcgccgcatcgaaaaaccatcaggatgtgacggtcatcacagatccggccgattacagctccgtgctcaatgagatgaaagaacacggcggcgtttcgctcaaaagaaaacgcgagcttgcggccaaagtattccgccataccgcggcatacgacgcattaatcgctgattacttaacacgcgaggccggtgagaaagaccctgagcaattcactgttacttttgagaaaaaacagtcgctccgctacggtgaaaaccctcaccaagaggcggttttctaccaaagcgcacttcctgtctccggttccatcgcagcggcaaaacagcttcacggcaaagagctttcttataacaatattaaggacgcggatgcggctgttcaaatcgtccgggaatttacagaacccgcagctgttgccgttaaacatatgaatccatgcggagtcggtacgggagcttcaattgaggaagcattcaataaagcgtatgaagctgataaaacctccattttcggcggcatcatcgcgctgaaccgtgaagttgatcaggcaacggctgaagcccttcacggcatctttttagaaatcattatcgccccttctttcagtgaagaagcgctgaacgtgctgacggcgaagaaaaaccttcgtctgctcacgcttgacgtgaccgcatcaggaaagaaagaaaaacagctgacttccgtacagggcggtcttttgattcaagatttagacgtccatggatttgatgacgccgacatcaccatcccgacaaaaagagagccgagcgagcaggaatgggaagatttgaagctggcctggaaagtcgtcaaacatgtgaaatccaacgcgatcgtccttgcaaaagaccatatgacggtcggtgtgggcgcaggacagatgaatcgcgtcggttcagccaaaatcgccattgagcaggccggagaaaaagcaaaaggcagcgcgctcggatcagacgcgtttttcccgatgccggatacagtcgaagaagccgcaaaagccggtgtcacggcgattatccagcccggcggatcggtccgcgatgaagattcgattaagaaagcggatgaatacggaatcgccatggtattcaccggcatcagacatttcaaacattaaggggggaacgaagcgtgaatgtattgattatcggaaaaggcggcagagagcatacattggcttggaaagcggcgcaaagcccgcttgttgacacggtgtacgccgcgcccggaaatgacggtatgacagactgcgcgacgctggtcaacattggagaaagcgatcatgccgcactcattgcgtttgcgaaagaacatcatgtcggcctgacgattatcggccccgaagttcctctgattgaagggatagccgacgagtttgaaaaagccggactgcttgttttcggaccgtctgaaaaagcggctattattgaaggaagcaaacagtttgccaaggatttaatgaaaaaatacggcattccgacggcggagtacgagacgtttacttcatttgaagaggcgaaagcatatgtacagcaaaaaggcgcgccgattgtcattaaagcggacgggcttgccgccggaaaaggtgtcacagtcgcgatgacggaagaagaagcgattgaatgcctgcacgattttcttgaggatgagaaattcggggaggcgagcgcatctgttgtcattgaagagtttctcgccggcgaagaattttctttaatggcgtttgtaaaaggggagaccgtctatccgatggtcatcgctcaagatcataaacgcgccttcgatggagacaaagggccgaatacgggcggaatgggagcctactcaccggtgccgcacatttccgatgatatcgtcagaagcgcagtcgaaacgattgtgaagccggcggcaaaagcaatggtgaaagaggggcgctccttcacgggcgtgctgtacgcggggctgattctgacggaagacggatcaaaggtcattgaattcaacgcgcgcttcggagatccggaaacacaggccgtcgtgccgagaatggaatcggacctcattcaggtgctcttagatcttctgcatgagaaagatgttgacctaagatggaaggatacggccgcggtcagcgttgtcctggcttctgaaggctatccggaaggctatgcgaaagggacgccgatcggcagtttgacgtccgctgaagacgggatcgccgtttttcatgccggaacgaaaaaagacggcggacaatttgttacgaacggcggccgggtcgccaatgtcacggcatttgctgagacatttgaagcggcgagggataaagtgtacagcgccgtttcggggctgacaaaacccggactgttttacagaagcgatatcggcgcccgtgcgctgaaagcatcgcagcgataaagaggaaacccccgcgtcttaaaagatgcgggttttcttctgaatgacgactaagattgtcatgcagtcttgaattctgtcccggcttttgtgatgccgggatcgccggcagattcttctcatactcgcgggacaggagaaaaaaataacaagccgaaacggcttgttatttttcttgctgatggctgtcatcctgattcattccggcttggaacatatatgtcaccggacagaagcggaggatgccggacgccgctttcatcgcgcccatcatcatacagaagagatgcatcttgcaccaaggttttctcgtgtattttgctgaagcggcagacaaaatggtgaggccgcaagtgatgcgcataacggcgtttaataaactgatattcggtttcatcatttcagctcccttagaaaaagtttttcattcatcttcaataatttgtaacgttttagccgtgcgataattgtgcggatgtgatacgatgggtctaatataagcgaaggagagtatgtgaatgtccgaacgtacctttaactggaaaaataaagacatcagatcacaggcggatgttgtagactcaaagctgcttccaacgctacttttacgggatgctctcgtattaaatccttttttaaaacaatggctgaaaaagaacgtctggatttacggagaccgaattgtatatgttggtcatgagcttcctgatgcagcagagcacattcataccataaattgtgaaggaaaatacattgtgccaggttacattgaaccgcatacacatccttttcaaatatataatccccaaacgctcgccgaatatgtgtctcaattcggaacaacgacgtttgttaatgataacttgttttttcttttgcacagcggtaaaaagaaagcgcttactatattggaagaactaaaaaaacagccggtgcaatatttctggtggtccagatatgatctgcagactgaagtgctgaatgaggaccagctcctttcttttgatgtccgcaagcaatggattgagcatccggatgtcattcaaggcggagaattgaccggatggccgcgcctcatggacggcgatgacttgatgcttcattgcatgcaggcgacaaagaaactgcgcaagcggatagaagggcattttcccggagcttctgaaaaaacactgacgaagatgaaactgttcggggctgattctgaccacgaggcgatgaatggcgacgaggtgatgagacggcttgaattgggttactatgtttcgctcagacattcatccatccgccctgatttgagaacgattttgcaggatctccatcaaaaaggcttccggcattatgatcatttcttttacacgacggatggagcgacgccgcatttttataaaggcggcatgacgaatgaattaatcaaaatcgctttggaggaaggggttccggcgattgacgcctacaatatggcctcctttaatatcgcgaaatattatcagatggatgactttctcggtgtgatcggtccgggccggcttgcttcattgaacattctcgatgacccgatgaatccggacccggtcacggtgatctccaaaggcatcctgctgagggaagacggccgaaatatgaatgcgtttacagaaacggattggaaaaagggcggtcttgtccctcttgagctttcatatgatatgacgatggatgatttacagttttcaatgccgatgggtgtgataatgcgcaacgccgtcattatggagccgtatatgattgcgattgataattctgttgaccagctttcttttgatcatgatgaatgctatctcacgcttctcgataagcatggaaaatggcgggtcaatacaatgctgaaaggttttgccgatcgggtgcagggctttgtcagttcctacacgacaaccggagatattatcgctgccggaaaaaataaagaagatatcctgctcgctttctcacggatgaaagaaatcggcggcggaatcgtgcttgccgaaaacgggaaggttcttcatgagattcccctcgctttaaacggttctgcatccgcggagaattatgaagaagtgcttgagaaagagcaaaaactgaggacgctgctggaggagcggggctaccgattctgcgatccgatctatacgctgctctttttgcagagcacacacctgccttatatccgcattacgccgagaggaatattcgacgtgatgaaaaaaactgtactctttccatcgataatgcgttaaaatataaaagcagggagccgacatatgaaaagatggaaaaccgtttgtatgctttgttttgcgtttttgctgcttgccgcctgccggcagaacaatgccgatcaggtgcagccgaaagaagcggaagctcctttaacggggctgaaaactgagcagaagcttgcagaacgccgtccgattgcagtcgcagtgaacaatcatccgaaggcgaggccccaatccgggctgtcaaaggcggatgttgtcatcgaagcgctcgcggagggccggattacgcggtttctcgcgatttttcaaagtgagatgccggaaacggtcgggcctgtgcggagcgcgagggaatattttgtcacgctcagcagcgggtttaacagcatatttgtccatcatggctggagtcccggcgctaaaaagcagctggagtccggaacttacgattatataaacggtttggattttgacggcagcctgttttggagagccgatttcagcaagccgccccacaattcctacacgtcgtatgacaatatcaggaaggcggcggaacaaaaaggatacaagctgaacggaaaaacagaaccgctcccatttcagacatcagatgcaaaacccggaaacgaaacctacaatattcggatagattatggaacacaaaacgttacaaatcttgtcgaatacgattatgataaaaaagctgatgcttatacaagaagctctgatggtgtgaaagcgacagaccgggagaccggaaagcctttagccatgcacaacatttttattgttgaagccggccatcgcatgacagacaaagatggaaggcgggccatcgatattcagtcagggggaagggcctcctgcttcagcacggcgatgttatggagtcagactgggaatataaagacggccgtattctgcccgtaaaaggcggtgagattcttccgtttgtgccaggaaagacatggattaatatcgtgcctgatctcgatgcagcttccattagtaaaggagaaggtgtttgacgatgcaaatcgataaattacgcggaaaagaactggaccagttatttttatctattttatcgctgaaagatctggaggaatgctatcgtttctttgacgatctttgtacgattaatgaaatccaatcgctggcgcagcgtttggaagtggcgagaatgctccgcgaaggaaatacgtatcacaaaattgaaagcgaaacgggtgcttccacagcgacgatttcccgggtgaagcgctgcttaaattacgggaacgacgcctatgaaatggcgcttgaccgcgtaaacaaaggagaatcctcctcagctacgtaaaaaaccgctctgccgatgacggcaggcggtttttttatgcgtgctgattcaaaaggccgggaagttccctcaggcttccgtcttcctcccggtatacgatgtgttcagctgagaaatgaatcggcgagctgatacccgccgccgcggcaagatgaaacagcccttcacgcaacgagagcacgtagttgcagacgcgatgctgtttatcctcgatactgagcgcgcgctgaagttttggatcggttgtcgccactccgacaggacaatgattggtgtggcatacttgagcgcggatacagccgactgaaaacatcattccccgggcaatattgacaaaatccgcgcctaacgcgagggcaacggcaatcttatcgggagtgagcagctttccggatgcgaaaattttcagcctatctcttataccgtatgtcttcaaaaggccgtcaacaagggggaggccggtcagaatcggcaggccgacggaatccgccagctcatggaaagaagctcccgttcccccttcactgccgtcaatcgtaataaagtcgggaagtttgcctgatgaactcatacaggaaataaggtcttcaaggtctttgcggctgcccgggacaattttgatgccgaccggtttttcaccgacagttcttaatttctcaatgaaatcaagcatgtccggaacatttgagaactcgttgaagcggtttggactgtcaatggattgtccgggctgcacatttctgatggcggcaatttcttcggtcacctttgaaccgtcaatatgaccgcctctagctttcgccccttgcgcaagctttaattcaaaggctttaatctgctcgaggcggctttttttcttaaattcttcccatgaaaattctccatcttcagtgcgcacgccgaacagcccggggccgatttggcagataatatccgcgccgcctttcaagtgatactcagacaggccgccttcgcctgtattcatccatgtgccgccggcctggtgcagcccttttgacagggcggtgattgcccggtcgccaagtgagccgtagctcatcgctgattgtccgattaacccttttacataaaacggtttcttgcatgtgtcgcggccgatcacttgcacatcgtccggatgcaggtaataagggtccgcttttgctttttcgcggtgttcgctgcgtttcagcaggttgtctttgtcaatcttgtataccatcgtgtcgatcttcggcgtctgatctgtgcgcagctcctccctttgtttcgggaagagggcgttacggatataatagcccggctgatcgaaatcccgttctgagccgaagcccatcattctgcttttatactttcccgacatgaccgtctgttcatattctctccgggaaaacggctgttcttcgttatcattgctgaataaatactgccgcagctcaggtccgattttttcaaatatatagcgcagttttcccgctgcgggataattgcgcagcactgaatgttcttcctgcttttcgtctcttatgtaaatccagagaaacaatgcggcgggaactaaaataataaaaatcaatatacaaatcagtacgataatggcttgttccattgagatcagactccttgccttttttctctttgacattccacattttgtctgttttcaaacatagccgtttcccgtccggcggagcgcaatctttttttgtgaatcaggtgaatgacgtctttttccgtttttccgggccaaacgaatttgttataatgtttaaatggcaagaaacgaatggaggaacgaaaacgcatgtacgatgttaacgagtggaagcatgtttttaaactcgatccgaataaagatttaccggatgaacagctggaacggctttgtgaatcagggactgacgccattgtgatcggaggaagcgacaatatcaccgaggacaatgtgctgagactgatgtcaaaggtgcggcggtttttagtgccgtgcgtacttgaggtgtcgacgattgattccattgtgcccgggtttgatctttatttcattccgagtgtgctcaacagcaaaaaggcggactggattgtcggcatgcatcatcaggcgatgaaagaatacggagagctcatgtcaatggaggaaatcgtgacggagggctactgcatcgtcaaccctgattgtaaggcggccgctttgacggaggcggatacacatatagaaacagaagatattctcgcctatgcgcgggtcgcggaacatttgcttcatctcccgattttttatctggaatacagcgggatgctggcggacatagaaacggtggagaaaacgaaggctgtgctggacaagtccgtcctgttttacggaggcggcattaaagacgcggaaacggcggaacggttcggccgtcatgccgatgtcatcgttgtcggaaatgccgtatatgaagattttgatcaggcgctcaaaacggtggcggctgtaaagacaaagtagccaagcggacgaaattgatttatgatagaacatatgtttgataggcggtgaacggatatgaattacattagcaatcaattattaagcggattaaatcccgttcagcaggaagcggtcaagacgacggacggtccgctgcttctgatggcgggcgcgggaagcggaaaaacacgtgtgctgacgcacagaatcgcatacttaatggcggaaaaacacgtggcgccatggaacattctggcgattacctttacaaataaagccgccagagaaatgaaggagcgggtggagagcattctcggacccggcgcggatgaaatctggatttccaccttccacagcatgtgcgtgcggattctgcgcagggatattgacagaatcggcatcaaccgaaacttctccattcttgatacggctgatcagctttccgttattaaagggattttgaaagagcggaatatcgatccgaaaaagtttgatccgagaagtattttaggctccatcagcagcgccaaaaacgagctgatcgaacctgaggaattcgcaaaaacggccggcggctactacgatcaggtcacgagtgacgtgtataccgattatcagaaaaaactgctgaaaaaccaatcgctcgattttgatgatttaatcatgacgacgattaagctttttgagcgtgtgccggaagtgcttgagttttatcagcgcaaattccagtacattcacgtagacgagtatcaggatacgaacagggcgcaatacctccttgtgaagcagcttgcggcccgtcttgaaaatatctgcgtcgtcggtgactccgaccagtccatttacagatggcgcggggcggatatcgcgaatatcctttcctttgaaaaagattacccgagcgcaaacgtgattctgctcgagcaaaactaccgctcaacaaagcggattctgcaggcggctaacgaagtgatcaaaaacaactcaaaccgcaagccgaaaaacctgtggacggaaaatgacgaaggcatcaagctttcttattacagcggcgacaatgaattcggcgaaggccaattcgtcgcgggcaaaatttatgagctgcacagctcgggccggcggaagctttccgatatcgcgattttataccggacaaacgcccagtcgcgcgtcatcgaggaaacccttttaaaatccggtctgaactacaatatcgtcggcggaaccaagttctacgacaggaaagaaattaaagacattcttgcatacctgcgccttgtgtcaaacccggacgacgacatcagttttacgcggatcgtcaatgtgccgaagcgtggcgtcggcgccacttcgctagaaaaaatcgcttcatatgcggcgatgaacggaatgtcaatgttccaggcgatcaaacaggttgatttcatcggtgtcagcgcgaaagcggcaaacgcgcttgacggctttggcgcgatgattgaaaatctgacgaacatgcaggattacctgtccattacggaactcacggaagaaattctcgaaaaaacggaatacagagaaatgctgaaggccgaaaaatcaatcgaagcccaaagccgccttgaaaatatcgacgagtttctttccgtgacgaaaaacttcgaacaaaaaagcgaagacaagtctctcgtcgcgtttctgaccgatctggcgctgatcgcggatattgaccagctcgaccagaaggaagaagaagcaggcggaaaggatgccgtcactttaatgacactgcacgccgctaaggggcttgaatttccagtcgtgttcttaatgggcatggaagaaggcgtgttcccgcacagccgctccctgatggaagaagccgagatggaagaagaacgcaggctcgcatatgtaggcattacgagggcggaagaagaactgtatttaacgaatgccaaaatgcgaaccttattcggccgcaccaatatgaatccggaatcccgctttatcagggaaatacctggcgatttattggagaacctaaatgagaagaaaacacctcgcatgcagccgggaagaaaagtgcagccgaaacgcgggcccgtatcccgtcccgtttcctatgcgaacaaaacaggcggcgactcgctcagctgggcggtcggcgataaagcgggccataaaaaatggggcaccggaacggttgtcagcgtaaaaggagaaggcgaaagcaccgagcttgatatcgcattcccgagcccagtcggcgtgaagcgtctgcttgccgcttttgcgccgattgaaaagcagtaacctgaagaggaaaggaagaacatgatggacaaagaaacagcgaaacaccgggcagaagaattgcgccgcaccatcgatcagtacagttatgaatattacaccttagatgaaccgagcgtgccggattccgagtacgacagactgatgcaggagctgattgccatagaggaagagcacccggaactcagaacgcctgattcgcccacacagcgggtcgggggagcggtgcttgaatcttttcaaaaggtgcagcacggcacgccgatgctcagtctcggcaacgcatttaacgatgatgatctccgcgattttgaccgccgcgtccgtcaggctgtcggtgacggcgtcgcttacaatgtggagctgaaaatagacggtcttgctgtttctctccgttatgaagacggctatttcgtcagaggcgcgacaagaggagacggaacgacgggcgaagatatcaccgaaaacttaaaaacgatccgcaacattccgctgaaaatgaaacgtaatctttccatagaagtgcgcggagaggcgtacatgccgaaacagtcatttgaagcgctcaatgaggaaaggctgaaacatgaagaggagccgttcgccaatccccggaacgcggctgcgggctcactcagacagctcgatccgaaaattgcagcgaaacgaaatcttgacatcttcgtctacagtatagcggagcttgacgagatgggtgtggaaacacagagtcagggcctggattttctggatgagctcggttttaaaacaaaccaggaacggaaaaaatgcgacacgatagatgaagtcattgaaatgatcgaagagctgcaggcgaagcgggccgatctcccttatgaaattgacggaatcgtcatcaaagtcgattcgctcgaccagcaggaagaactcgggtatacggcaaaaagcccgcgctgggcgattgcttacaaattcccggctgaagaggtcgtgacaaaactgctcgatatcgaactgaatgttggaagaacgggcgttattacgccgaccgccgttctggaaccggtaaaagtcgcgggaacgacggtctcaagagcatcccttcataacgaagatttaattaaagagaaggatatccgcattctcgataaagtggtcgtcaaaaaagcgggcgacatcatccctgaggtcgtcaatgtcttaattgaacagcggaccggggaagaaaaagaattcaatatgccgaccagctgccctgagtgcgaaagcgaacttgtccgcattgaaggggaagtcgcgctgcgctgcatcaatccggaatgtccggcgcagatcagagaaggcctgattcactttgtctcacgcaacgcgatgaatattgacggactcggagaacgtgtcatcacacagcttttccgtgaacatctcgtccgtaatgtcgctgatttgtataagctgacgaaagaacaggtcatccggcttgagcggatgggggaaaaatcaactgacaatctgatcagctccatccaaaagtcgaaagagaattcgctggaacgcctgctgttcggtctcggcatccgttttatcggctcaaaagcggccaaaacactggccatgcattttgaaagcctggaaaatctgaaacaagccacggaagaagagctgcttgcggtagatgaaatcggcgaaaagatggccgatgccgttatcacctatttccgcaaagaggaaatgcttgagcttttgaatgaacttgaggaactcggtgtgaacacactctacaaaggcccgaaaaaagtaaaagcagaggacagcgactcttattttgccggcaaaaccatcgtgttaaccggaaagcttgaagagctgtccagaaatgaagccaaggcgcagattgaagcgctcggcggaaagctgacgggatctgtcagcaaaaaaacagacttgctgattgccggagaagcggccggaagcaagctgacaaaagcgcaggaattaaacattgaagtatggaatgaagcacagctattgggagagctaaagaaataagaggagtgttttctattgaaaaagatgttggcattggcggcgacggcaacggcggcagtactcatgctgtcggcctgttcgccgagtttcgggggaaaaaaagaggaagagatcacgcagaaaacggcaaagtcttctgaaaaagcgatcataccgaaatataatatctctgattcctactataaaatggtgctcccgtttaaggccggaaaagcgcgcggcctgaccgcggaccggctgaacacgaggctggacatcgatgaattcgagactgggctgatgcggctcgctcaagacacgttcccgacggatgactatttgtatcaggaaggccagtatttagatgaggacacggttctcagctggcttgaccgcaaaaaagagggcagtgatctgaaaaaggcgaaaaaggcagacgccaatttccagaatctcggcttaaacccggtgctgccaagctcgggatcagcaaaagagaaaaacgaaaacagcccgatttacttagcgtccatgcttgagcaggattacttagtaagaaaagataaaaattccatccagcttggcggtgtcatgatcggtctcgctctcaactctgtatactattaccgcgaaaacacaggtgatccgcagcaggaagtggagctcagcgacaaaacgatccgcagccacggcgaagaaatcgcacaggaagtcgttaaccgccttcggaaaatggataacctgaaaaatgtgccgattaccgtcgccctttataaacaagcgccgaaaacatcaatcgtaccggggaattacattgcgaaaacagaagtcaaggccggctcatccaccatttcaaactgggatgatgtcaaagaaaagtacgtcttctatccggcggatacagacacggcaaagaaataccctgatgattccgaagtgtttaaacgcttcaaaaacgccatcgacagctacttcccgaattacaccggagttgtcggaacggcaatgtacgaaaacgatgaaatgagaaaaatgaagattgaaatcccgatgcaattttacgggaaaagtgaagtcatcgccttcacccaatacttaacaggtgagctgatggattattattcaaaaggctcagttgatgtcgaaattaacattacctcgtctgacgggcaggaagcgctgatcgtccgcaatgcgggtgacaaagaaccgaccgtccatatttacgattaaccaagatgcccttgttcatttctgtatgagcaagggttttttagtgtgaatatcgttggagagaggaatgaggtatgttaagatatttgtataattaggaattaacaggaaaacacatatcatttctaagcggatgttacgaatctgctgtgaaaaaagaagggcaggaatgttgatgaatgacatttgctgagtacacacaccgcctacaaatgttatgaaaagggtgaatcagcatgcataaagatattaaagcgatttttgaggaagataaggtgctggctgaagccggtgaaatatacggatttaccaagtttcaatttattgcggacgcagagaactacgtatatgaaattgtgaaagataacgaaccgtatatcttaaaaattacgcatacgatcagaagaacgccggaatatattctcggagaaatggaatggcttcatcatctggcaaaggaagggctttcagtagcaaagccgattccttcattaaatggcaaagatgtcgaagaagtgccggacggaaaaggcggagcgtttttattaagagtctatgaaaaagcgcccggacgcaaagtggaggaatcagactggaacggaactctgttttaccagcttggaaagtacacggggaacatgcaccggctgacgaaaagctaccgtctgagcgatccggcatataaaaggcaggaatgggatgaagaggagcagctgaagctgagaaaatacgtgcccgcagatcagcatctcgtatttgagcgggcggatgctctaatggaaaaactgcgccgtttgccgaagaatcctgaaaactacggccttgtgcacgccgatctgcatcatggcaattttaattgggacaacggaaaaatcactgcatttgattttgatgatatcggctacaattggtttgtgaatgatatcagtattctgctgtacaacatgttgtggtatccggtcatcccgtatgaagacaaggccgcgtttacgggtgaattcatgactcactttatgaaaggctacagggaagaaaatgaccttgattccgcatggtttgaacacatcccggatttcctccggctgcgccatatgctgatctacggattattgcatcaggcgtttgacctcaattcactcggggacgaggaactcgggatgctgaaagccttcaggcgcgatatcgaaaatgaaacaccgattacggagtatcaattttctgcattcgtataaatagaaaaacgccggctgaatccagcccggcgttttttataacgtatcacattttactccgacgacgccctgaatttctttaatatcataatagacgtcagtggtgtagcggtttttatgaacactgactttcacttccataatcggaaattctttttcacccaggtcatcaatccggacggagtgaatgcggagctgtttgcttttcatttcctttaaaatctcggtcattttgtctttatcggaaagagacattctcacgcggatatccttttccttcaagcgattgggaccgatttttctgatcagccacggaagaaattcgacactgatcaggataaacaagaggcttgcgaacgcctctttataaaagccggcgcctgtagccagacccagcccggccgcgccccagatgatagccgatgtcgtcaggccggatatgacgtcattgcttttacgcaggatcacgcccgcgccgataaaaccgacgccggaaatgatttgggcgggaaggcggagcggatccatcatgatacggtaatatttcgggaaatgatatgctgcattaatgctgacgatcgtcagcatacaggagctgacggcgatgacaatacaggttttcagtccgagcggtttgtttttcagttcgcgttcaagaccgatgatcatgccgatcagcgtggcaatgcccagctttaataaaatgtctggttcgataggccagctcaatttgcacagcacctccgcaatttttcttataataaattgatatgattttctcacagtatttatagcaggacaagtgcggaagaaaaaagccgtcagggataaaatctgacggctttttgtctatttcttgtttttcaaaagagcttccatccggctgaacagctgataagaagcatcggccggttttttggtcagcaggctgacggcaataccggcaatcagactgaggaagaaccccggaatgatttcgtatacgccggttgaagcggcaagccctgtcgtaatccagattaaaacggccgcggccccggtaatcatcgccgcaagcgctccccattcattcatccgtttccagtacagactgagcaagagcgcggggccgatagccgaaccgaagccagcccacgcatatccgaccagatcaagaatggtgctgttcggattcatggaaagcaggatggcgataacggccacgatcaataccgacaggcgtccggtcatgaccaattctttatcgctcgcttcccgtctgaaaaaggcgcggtataaatcttccgtaatggcgcttgccgttacgagaagctgtgaggaaatggaactcatgatcgccgctaaaatcgcggacagcaagaagcccgtaatcagcggatggaacaagattttagaaaaaataatgaaaatcgtttccggatcttttacggagaccccgaagtgatgagaatacgcaaccccgataatcccggtcagcaatgagccgacaactgaaataaacatccagctcatcccgattctgcgggcgggttttaaatctttcacttctttaatcgccataaatcgtacgatgatatgaggctggccgtaatagccgagtccccatgccaaataagaaataatgctaatgacgctcgcgcctttaaagatatccaatagtttcgggttaacggcgttgatcgaatcaatcgtcgttgaaacgctcccgagctgggtaaaagcaacgatcggcacaagcactaatgccgcaaacatgatcgctccctgtacaaagtcagtcagactgacagcgaggaaaccgccaaacagcgtataaagcacaactacacccgccgttaaaaacaaaccgaatttgtagtcggcgccgaatgccgattcaaataacctgcctccggataccatcccggacgatgtgtacagtgtgaaaaagatcataataatcacggcggaaacaattttcagcaatgatgacgagtggcggaatcgtttatcgaaaaaatcgggaatcgtaatcgcatcatccgcaacttccgtgtaagcgcgcagcctcggagcaagcagcagataatttgaatacgcgccgatcgtcaaaccgagcgccagccataaggtcgataaccccgttgcgaacattgcgccgggaactcccatcagcatccatgcgctcatatccgccgcacctgcggacagcgccgttacgaacggaccgagtcctcttccgcccagcatgtaatcattaatattcgttgtctttctgaatgcgtaccagccgattaacagcatggcggcaaagtaaatgccaagagatataattaattcaatactcacgtttttggaccctctcttctttcatgtaaatgttgcatcacctctgtagattagtagtgccggcgatccagcctgcctttagtcatctttcgatggggatcgcatgatttagtgccggctatggttactaaacctaacaaagtatccccgatcaatcaactctcgaaacctggcccgctcaaggaaaaaatccccgccaacctagaacagcttaaagaagaaagcgctaccaataaattataaaagtaaaaattttctgacatataattcgtttctctttctccccgatttaggataaaatagagagggtttcatcatgcctcagaaggcggcgttttgttgctttagagggctcgtttttgatatgatcagtattatatgacgaaacggagaattatgcggaggtggatcttatgtcacgaatttctatagaagaagtaaagcatgtcgctcatttggcgagactcgccattacggatgaagaagctgaaatgttcacagaacagcttgacagcatcatctcgtttgccgaggagcttaatgaagtggacacggataacgtggaaccgacaacacacgtgctgaaaatgaaaaacgtaatgagagaagatgaagcgggtaaaggccttccggtcgaggatgtcatgaaaaatgctcccgatcataaagacggctatgtccgtgtgccatctattctggattaaaggagggagacagtatgtcattatttgatcacaaaatcacagaactgaaacaaatgatacataaaaaagaaatcaagatttccgatcttgttgatgaatcttacaaacggatcgcatccgtggatgataaggtgcaggcgtttttacagcttgatgaagaaagagcccgcgcttacgcgaaagaacttgacgaagcggttgacggacggtctgaacacggtcttctcttcggaatgccgatcggcgtcaaagacaacatcgtgaccaaagggcttcgcacaacatgctcaagcaaaatcctcgaaaacttcgatccgatttacgatgcgacggttgtggaacgccttcaagccgctgaagccgtcacaatcgggaagctgaatatggacgagttcgcgatgggttcttctactgaaaactccgcgtacaaagcgacgaaaaacccttggaatctcgatacggttcccggcggatcaagcggcggttccgcagctgcggttgcagccggagaagtgccgttttcactcggatctgatacgggcggctccatccgtcagccggcttctttctgcggcgtcgtcggattaaagcctacatacggacgcgtgtcacgttacggtttggtcgcttttgcgtcttcacttgaccagatcggaccgatcacaagaaacgtagaagataacgcattcctgcttcaggcgatttcaggcccggacaaaatggactctacgagcgccaatgtcgaagtgccggactttctttcttcattaactggcgatattaaaggcttaaaaatcgccgtgccgaaagaatatctcggagaaggcgtcggcaaagaagcgaaagaatcggttttagccgctttaaaagtgcttgaagacctcggagcgacatgggaagaagtatctctgccgcacagcaaatacgcgcttgcaacgtattatctgctttcttcttccgaagcgtctgcaaaccttgcgcgctttgacggcatccgctacggctaccgctcagacaatgcggacaacctgatcgacctttataaacagacacgctcagaaggcttcggcaacgaagtaaagcgccgcatcatgctcggcaccttcgcgctcagctccggctactatgacgcgtattacaaaaaagcgcaaaaagtgcgcacgcttattaaaaaagattttgaagacgtatttgagaaatacgatgtcatcgtcggaccgacaacgccgacaccggcattcaaaatcggcgaaaaaaccagcgatccgctcacaatgtacgccaacgatattttaacgatccctgtcaacctcgcgggtgtgccgggaatcagcgtgccatgcggatttgcggacggactgccgctcggactgcaaatcatcggaaaacacttcgatgagagcactgtataccgcgtcgctcatgcttttgagcaggcaacagatcatcataaagcgaaacctgaactgtaaggggtgaaatgaagtgaactttgaaacggtaatcggacttgaagtccatgtggaattaaaaacaaaatctaaaattttctcaagctcaccgacgccattcggcgcggaagcgaatacccaaacaagcgtcatcgacctcggctatcccggcgtgctgcccgttttgaacaaagaagcggtcgaattcgcgatgaaagccgcaatggctttgaactgtgaaatcgcaacggatacgaagtttgaccgaaaaaactatttctacccggacaacccgaaggcatatcaaatatctcaatttgacaagccgatcggcgaaaacggctggattgaaatcgaagtcggcggaaaaacgaaaaaaatcggcattacccgtcttcaccttgaagaagatgcgggaaaactgacgcatacgggcgacggctattccctcgttgacttcaaccgccagggcacgccgcttgtcgagattgtatctgagccggatatccgcacacctgaggaagcttacgcatatctcgaaaagctgaaatcaattatccaatacacaggtgtttccgactgtaaaatggaagaaggttcactgcgctgtgacgccaacatttccctccgtccgatcggccaggagaaattcggcacaaaaacggagctgaaaaacctgaattccttcgcgttcgtgcaaaaaggacttgagcatgaagagaaacgccaagagcaggtgcttctgtcaggcggagtcattcagcaggagacgcgccgctacgatgaagcgacgaaaaaaaccattttgatgcgtgtcaaagaaggttcggacgactatcgttatttccctgagcctgaccttgtcgagctctacattgatgacgaatggaaagaacgcgtaagagcaaccattcctgagcttccggacgagcgccgcaagcgttatatcgaagagctcggtctgccggcctatgacgcaatggttctgacgctgacgaaagaaatggctgatttcttcgaagaaacggtcaataaaggcgcggaagccaagcaggcatcaaactggctgatgggtgaagtgtcagcttacctgaatgccgaacaaaaagagcttgaggatgtcgcactgactcctgaaggccttgccggcatgattaagctgattgaaaaaggaaccatctcgtccaaaatcgcgaagaaagtctttaaagaattaattgaaaaaggcggcgacgcagaaaaaatcgttaaagaaaaaggcctcgtgcagatttctgacgaaagcgtgcttctgaagctggtaacagatgcgcttgacagcaacccgcagtcaattgaagacttcaaaaacggaaaagaccgcgcgatcggcttccttgtcgggcagattatgaaagcctcaaaaggacaggccaacccgccgatggtcaacaagatcttacttgaagaaatcaaaaaacgataaaaaaagcagccgcctctaagggcgctgctgacacggagaccggtaagcgccggtctcttttttataagctgaaataggtttcaatggaagcccgcagcgtttcaatctgctcatttccgctgcctgccaagttggacagcattcctttaataatcggttttcgcggctcttcctttgcgtattcctcttcaatgacttcaagcgatacgaggacgtcctcaggcagcccctgctgtgcttttatcttttgaatatccgcaagcagtctttctctgtccgccgccggctgagtgaagatatcctgcggcagcagcggatcgggattgtctcttatcagtcccgtaatcaggtcatcgattctggcaatcagaaaggccgccacgttttccgtccggaatgccgtatgttcattaaaaatcaagaaatgaatataggagctcactattccttgcgccataacggacgcatccgctataaacggtatgacggcatctctgtaaacggagagcaaagcatcccggtacagtatgttaaattgaatattggcctcatgaaaatactgtttgaccttttgattttcaggaatgaccttttcgctcagcaagagaatgataaagtccttgtgctccataaattcctggaattgataagcgatttgttttcggaatacgtccttaggcgatttatgctgatgttctgttttgattttctttatttcttccatagacatgccgatgtaatactcacatgctgagagcaaaaggtcttcttttgatttaaaatgaagatagaaggccccttttgaaattccgcattcaccggcgatttcctgaatggttgttgaagaaaacccttttttggcaaataaatggatgcctgtttttatgattttctcttttttttcgttcatgacgtgcttccccttaatcctgaaaaatttagaaaaatttactgccttattagttgacgatgttgagttataccgtttagtattatatagaatgaccagtcagtcaataaaaattaacggaggacatgatgaaccacattattaactttgtactgaagaacaaattcgcagtttggctgatgacgattatcgttactgtagcagggctgtatgccggtctgaatatgaagcaggaatccataccggacgtcaacatgccttacctctcagtaaatacgacttatcccggagctgctccgagtcaagttgcggatgacgtgacaaaaccgatcgagcaggcggtgcagaatttagaaggagtgagcgtcgtaacgtccacatcctctgaaaacgtctcatcggttatgattgaatatgattacaacaaggatatggacaaggcgaaaaccgaagtcgctgaagcgctggacagtgtcagccttcctgatgacgcgaaaaaacctgacatttcccgttacagtctcaactctttcccgattttgacgctcagtgtgacaagcggcaaaagctcgcttgaagatctgactaaaaatgtggaaaacactctcgttcctaagcttgaaggcattcagggcgttgcgtccgtacaagtttccggacagcaggaagagcaggtggaattctctttcaaagataaaaaaatgaaagagtacggacttgatgaagataccgtcaagaaagtgatccaaggctctgacgtcaatacgccgcttggattgtacacattcggcaacaaagaaaaatcagttgtcgttaacggaaatattacgtcaattaaagatctgaaagagatgagaattccggtcacatcttcttctgccgctcaaggtcaagcgggcggagccggtgcggcatctgcggcggacgctcaggctatgcagcaggcacagcaaagcgcgtcagcaggggtgccgacagtcaagctctctgacattgccgacattaaagatgtgaaaaaagctgaatccatttcccgcacgaacggaaaggacagcatcggaattaatatcgtaaaagccaatgacgccaacacggtagaagtggccgatgcgattaaagatgaactgaatcaatacaaaaaagaccataaagggttcaagtacagctcgactcttgatatggcagagccgattacagagtcagtggatacgatgttaagcaaagcgattttcggcgcgatttttgcggtcgtgatcattctcttattcttaagagatattaaatcaacgatgatttctatcgtttccatcccgctgtcactgctgattgcacttcttgtgctgaatcagcttgatgtcacattgaacataatgacgctcggtgcgatgacggtcgccatcggacgggtagtcgacgactcgattgtcgtgatcgaaaacatttaccgccgcatgaggctgaaagatgaacctttacgcgggaagcaattggtgcgtgaagcgacaaaagaaatgtttaaaccgatcatgtcatcaacgatcgtaaccattgccgtattcctgccgcttgccatggtcggcggacagatcggcgaactgtttatgccgtttgccttaacaatcgtcttcgcgcttgccgcatcactgttgatttcgatcacactggtgccgatgcttgcgcacagcttattcaaaaaatcgctcacaggcgcacctgttaaagcgaaagagcataagccgggcagattggccaatttctataaaaaagtgctgaattggtcattaagccataaatggattacatctatcatcgcggttctgatgcttgtcggcagtttgttcctcgtacctctgatcggcgcgagctacctgcctgcgcaagcggacaaaacgatgcagctcacatacacgcctgaaccgggcgaaacgaaaagcgaagctgaaaaagctgcgcaaaaagcggaagatatgctgcttaaacgcaaacatgtcgatactgttcagtattctttaggatcgcaaagtccgctcggcggaagctcaaacggcgcattgttctacgtgaaatacgaggatgacacgcctgattttgacaaagaaaaagacaatgtcttaaaagaaatcaaaaaaacatcgagccgcggcgaatggaaatcacaaaatttcagttcgtcaggcaacaacaacgaattaacgtactatgtgtacggagattcagagtctgatattaaaggcacggtcaaagacatcgaaggcatcatgaaaaaggagaaggatctgaaagacgtcaactcaggcctttccagcacatatgatgagtacacgttcgtcgctgaccaggagaaactcagcaagcagggcctgacggcttcgcaaatctcccaagccctgatgtcccaaacgtcacagtctcctttgacaacggtgaaaaaagacggcaaagagcttgacgtcaacatcaaaacagaaaaagaccagtataagagtgtaaaagaattagaggataaaaccatcacatcacctgcaggccaagaagtgaaaatcggcgatgtggcgaaagtgaaaaacggcacgacatccgataccatttccaaacgcgacggcaaagtgtacgctgacgtaacggcaaccgtcacttctgacaacgtcacgaaggtgtcatcagccgttcaaaagaaagttgacaaactggataagccggacaatgtatcgattgataccggcggtgtatcagcggatattgcagattcctttacgaaactcgggttagcgatgcttgccgcaatcgccatcgtatacctcgttcttgtgatcacgttcggcggagcattagcgccgtttgcgattctgttctcgcttccgtttacagtcatcggcgcattagtcggactgtatgtatccggagagacggtcagtctgaatgccatgatcggtatgctgatgctgatcggaatcgtcgtcacaaacgcgattgtcttaattgaccgcgtcatccataaagaagcggaaggcctatcgacgagagaagcgctcctggaagccggctctacgagattgcgtccgattctgatgacggcgatcgcgacaatcggcgccctgcttccattggcattgggctttgaaggcggaagccaggtcatttctaaaggactcggtgtcaccgttatcggcggtttaatcagttcgactctgctgactcttctgattgtgccgatcgtatatgaagtattagcgaaattccgtaagaaaaaacctggaacggaagaagagtaagacagcgggccttggctccttaaacggagccggggccttttttcttctggcaattcctgtacatattgttgcgattttctcaagtcatagtataattaaaggttgttagtgttaataatggatcggatactcttaagtaggatgatgagataatgaaacgtgcacgcataatatacaatccgacttcaggacgggagcttttcaagaaaaatcttgcccaggtcctgcaaaaatttgaacaagccggttatgaaacctccacccatgccaccacatgcgcgggggatgccacccacgccgcaacagaagccgctttgcgggagtttgacctgattgtcgcagccggcggagacggaacgattaatgaagtcgtcaacggtcttgcgccgttagacaaacgcccgacactcggcatcattccggtcggcacgacaaatgatttcgccagagcgctgggcattccgagagagaatatactgaatgccgctgataccgtcattaacggcgtggcccgcccgatcgacatcggacaggtgaatggtcagtattttatcaacatcgccggcggaggccgtctgacggagctgacgtacgatgtgccaagcaaactgaaaacgatgctcggccagcttgcttattatttaaagggaatggaaatgttgccttcacttcgaccgacagaagtcgagattgaatatgacggcaagctgtttcaaggcgaaattatgctgtttttagtgacgctgaccaactcggtcggcggattcgagaagctggcccctgattccagcctgaatgacggcatgtttgatttaattattttgaaaaaagccaatctcgcggagtttatcagagtcgcgagcatggcgctcagaggcgatcatattaacgatcagcacattatttacacaaaagcgaaccgtgtgaaagtcaatgtatcagaaaagatgcagctgaacctggacggcgaatacggcggcatgctgccgggcgaattcgtgaatctgtaccggcatattcacgtcatcatgccgaaggagaaagcggaacagctggatgactaatacgcggacaaaatcctaaaacagtattcgttttaggattttgtcatcttttcagcgtgatcggaaacctttgaaggctgacattgaatttgaaggtttgccagcacgctgaaacaaggcttttggtaaaacgagaggtgattatagatgaaaatgaaacccccgatagaaaaaaatgaatactatgacgtgacatttgaggatttgacgcatgaaggagcgggcgtcgcaaaggttcagggcttcccgatcttcgtgccgaacgccctgcctgaggaaaaagcgcaaattaaagtgacacgcgtcaaaaaaggcttcgctttcggccgtttgatcgagctgaaggaagaaagcccgcacagaacggatgccccgtgcccgatctacaagcaatgcggcggctgccagcttcagcacatgacctatgaaggccagctcttgtttaaacagaaacaagtcaaagacgtcttagaacggatcggcaagctggacctctcaaacgtcaccgtgcacccgacgctcggcatggaagacccgtggaactacagaaacaaagcgcaggtgccggtaggagaaagagaaggcggactcgtcgccggattctatcagcaaagaagccatgacatcatcgacatgagcgcctgcctgattcagcaatccaaaaacgatgaagccgtccaagccgtcaaagacatctgtgcagcatacggtgtcaaagcctataacgaagaacgccacaaaggctggcttcgccacatcatggtcagatacggcgtcgtcacgggcgaaatgatgatcgtcttcatcacaagaacaagcgattttccgcacaaagcgaagatcatcaaagacattacggcgcaattcccgcacgtcaaatcgatcgtgcaaaacatcaacccaaataaaacaaacgtcatttttggggacgaaacaaacgtcatctggggcgaagaatacatctacgacctcatcggagacgtcaaattcgccatctccgccagatcgttctatcaggtcaacccggaacagacaaaagtgctctacgacaaagcgcttgagtacgcagagctgcaaggagaagaaaccgtcatcgacgcctactgcggcatcggtaccatttctctatttctggcgaagcaggcgaaaaaagtgtacggcgtcgaaatcgtgccggaagccatcgaggatgcgaaacgcaacgctgagctgaacggcatcacaaacgcggaattcgcagtcggagaagcggaaaccgtcattccgaaatggtatgaagaaggcatcacggccgatacgctcgtcgtcgacccgccaagaaaaggctgcgacgaagccctcctgcggacaatcatcgacatgaaaccgaagcgggtggtgtatgtgtcctgcaatccaggcacgcttgcaagagacctgcgggtgcttgaggatggcgggtatcagacgctcgaagtgcagccggtggatatgttcccgcatacgaatcatgtggagtgtgtggcaaagctagtattgaaataaagcagtgttctcttttggagaacgctgctttttatattaatatgtgaaggatcctttttaattattaagtacaaaggtcatattaaaacagattaatttgaagaaaaatggtattctcaatatagctcaatttagttattttgagcggcgaatttatagagataacgcaaaaagttaatgaaaaggtgaaacaatgatagtctatgaagctacaaaagaagagtttctgagtgatgtgtttgacgacaatttggtgacgaatatctgtaaaaactataatgataagattggcaaaatcaatgagaaagaggttagatcttgggataactctatgcagtatatgtatagggtattaagtgatagagaaattcctaaggacgcaggaattgctattgagttcaaaataccccatacttcaaagcgtattgattttcttatatctggatcagataaggatgatcgttcatctgttgtgattgtggaacttaaacaatgggagaaagtagagaaaattgatagtaaagaggccatcgttaaaacgtttataaataaaggaattcgcgaaacaacccacccatcctatcaagcctggtcatacgcttcgttaataaaggattacaatgaaaatgcgcaaaaagaagatatcaagctatatccttgtgcatacttacataactacttgaatcagggtacagacgatccattaactgattcaatatatgaatattatataaaagaagctcctgtttttatcaaaggtgattcaggtaagcttcgtgatttcattaaaaagtatattaagtatggagacaacaaagaaatcctatatacaatagataaaggaagaataaggccttcaaagtctcttcaagattcgttaaacagtatgcttcaaggtaatcgagaatttatgatgattgataatcaaaaagttgtgtatgagacggctttacatttggcgaatgaggcattacgtacaaacactaaaaaagtattaattgtagaaggcggaccaggtacaggaaaatctgttcttgctataaatttattagtagaagcaacaaaccgaagtcttgtggcacaatatgtaacaaaaaatgcagctcccagaaatatatatgctactaagttaaaacaaaactttcggaaagggcacattgataatttatttaaaggatcgggcagttatgtcaatgctccatcaggtgaatttgacgttttaattgttgatgaggcgcatcgattaaatgagaaatccggtttatttaataaccttggggaaaatcaaattaaggaaataataaatgcttccaaactttctgtttttttcatagacgaacatcaaagagtaacattaaaagatattggtagcactgatacaatccttaaattctcaaaagaattagatgctcaggttacaaatatgaaactggattcacagtttcgttgcaatggttcagatggttatataagctggttagatgatgttcttcaaattcgggaaactgcgaattctaattatattggaatgaactacgattttcgtatatatagaaatccaaatgaattgcgtaaacagatagaagatctgaataaagttaataataaagctcgaatagttgctggttactgttgggattgggtgaaggaaggcaaagctaaaacagaatttcatgatatcgagattcctgaatatcaattcggaatgagttggaatttaaataactcagacacgtgggcaattgatgaagattctattaatgaaataggttgtatacacacatgccaaggtttggaatttgattatgtaggtgtaattataggaaatgatctagtgtgcagggacggagtagtattgactgatcattcaaagcgggcgaaaacagatacctccttacgtggtttgaagaaaatgctaaagcaaaattcagaagaagctgagaagcttgcagacgaaattattcgcaacacatacagaactttgatgacccggggacaaaaaggctgttttatttattgtatagacaaacaattagaaaattacttttttaaaaggctgaaacatatgcaaatgaattacaaagagaatgagttctttaagtcttcatcagttgctgaagaaaaagccacatataagcacaaatgaaaccttttttaattatttattaaaacggaattgggaaaaaatcacgctatgatcttgtacctttaaaaagcagggaggcaagattttgcgacaactgttaaaggctttttaacgaatgcgactaggatttctaccgttgttgcaggaaaagaaaaatctatttgtgtaggagatccttacaaagcttcttaacaaagtggcgattgttaatgacttggggaatgaaagcataatattaacgtaaagcgataaaaggcttcttttaagaagcctttttatgtacgtatatcttcataatcaagataattatttataaaaagataataaatttggataaaaatgagaaaatcctggcgggaatgacgatataaagttagtgaacaacggtatagaatcttatttttcgaggtgaacagaatgggagaagaacaagacattattacagtaaccgatctgcgcaaaaaatatggatcatttgaagcagtgaaaggggtatccttttctgtcaaacgcggcgagctgtttgcatttctgggaacgaacggtgcagggaaatcgaccactatcgatattctctgtacgctgattaaaaagacatccggaaaagtggtaatagatggttatactcttggtgaggggaaagagaataatcatatccgcaaaaagatcggagttgttttccaagagagcattttggatgaacgattgaccgtttatgaaaatatcatgaaccgcggacaatattatcatttaagcaaggcacaagtgcaagagaactatcagtttgtaacagactatttaaaattggatgatattaaggagaaaaaatacagcgatttgtcaggaggacaaagaagaagagcggatattgcccgtgccatcatccataaaccgactatattatttttagatgagcctactacaggtcttgatccgcaaacgagagtatttgtttggaatgcgattaaaaggctgcaggaagaaacaaacatgacgatctttttaacgacccattacatggaggaggccgctgtggctgataacgttgtggtcatcaaagaaggacgcctgatcgcagagggtacaccgagtcagctcaaagatcaatatgcgtttgacagtctgcatatgatgtttaagcaaggcgttgatccgacggcatggtttgaaaataaacaactggattttacggttaaaaactctatttattcccttcgtgtagagtccactctccaagcgtttgacattttgaaaggtcttgaaggaaaaattgaatctttcgaagtgattaaaggaaatatggatgatgtgtttatccatattatcgaagaacaaggaagcagtttgccagtaaaggggagcattgcataaatgaagtctttatccagtttaatcagcagaaatataaaaatatacttccgtgatcgaacgcttttgcttctctctttgctgtcagtatttatcgtcattctgttatatgccgtgttcttacagcagacacagctggacgccattaaggccctggtcggttcgacagatgattccaaagcaatggtgaacgaatggatggtggcgggattgctgtccattacagctgtgacaacgactttaggcgctttcggaattatggtgaaagataaagaaagcaagagaacgtatgactttttaacagctcctttatcaagggcgaccatccaattgagctatgtcattcattcatttgtcatcggcttgatcttttctttcatcgcctttttaggctgtgaaatttttctcgtttcaacaggcagcaagcttttaagcggtacagatatacttgaagtattggggatcattattctttcagttgcactctcgagttccataaatttatttttaacgctgtttattcacacacaaaatgcattttcgacgttaagtacgattgtcggaacagccatcggttttttatgcggagtatatgtaccgatcggcggcgtaccggtgtttgtgcagaagattattatgtatttccctatcagccacaccgccgttctgttcagaaaagcgtttatgacagactcagttgataaagtgtttaaacatgcttctgcggaccaaatacaggaatatgaaaagcattacgggatcgtctacaagttaaacggccattttatcagtacggctgcgagcttgtgggtcattgtcattacagccatcatatttaccgtcatatctattttcatatttaaaaaacaaaataaatgacttcttcagacgatacataacgatgtaacaggcagcatccgtttactggatgctgcctgttttgtttatcattattctttttgtgctcaattcttaattcctcaaaaagttctcggatttctcttgaaaagtgttgaagatatctttatttacactgtatcaggctggtagatcttgcgaataaatcagttgacgtttttttggtgtcttgaagtgaaagagaaccatgggagagtcatctaatacttctgcataaagatatatttttgcccattcataaggtatgatgtagttataaaaaatagcccagcaaggaagtgctgagccattattgacttatagaccgacgtagtttattacaaattctttatcgtcctcatcttcaggcaaaatccccaagttttgatattcccataccacttgccgttgtgttccgtttaagtctgaggcgatgacatcggtgtaatcgtagtcaattgagaagaatttaccgcttcgttcgagatgcaaagtgaggtttgtccataagtcctcgttgtttgttttaaattgatcccgtaactcttcaaagtaatcttgcaattcatatagaagttcgtcatatatatcttcatcaacattaaaatgttcaggaatatcgtgtgaatatatatattcctgattttgtggagtactaaagaagaagtaaacttctgaagaatcatctaaaatttcggcataaagagcaaccttctcccactcagaggggataatttcatttatttgctcagcgattttttgatatagttcgcccattttttcagtttccacaatatcagaatcctttttaattttttttagccgtttgaaagcttattatatgtttagatactcttctatgaattttctatcgtcctcatctttaggcaaaatccctaaattttgatatttccaaacatctcgtctttgaaggtcatcaagttcagacaataaaacatcctcatcgttataatcaattgaaaactttccggtgttttctaattttaaagtgagattagtccaaatatcttggttgcctagtttaaattcttcttttagttcttcaaatagctcttgaagttcaatcagcagttgatcgtaaatctcttcgcttactttaaattgttcaggtatataatgagaatataagtaatcaccattagttggtgttgtaaaataaaagtatatatccgctgagtcatcaagtatttcagcatataaaacgatcttttcccattgagatggaatcatttcatttagatgttcagcaatcttttgatatagttgttccattttttcagctaccattgatgatcctctacctttgttgatagcattatttaatatttagataatccttaacaaattctttgtcctcttcgtcttcagggaaaatccccaagttattgaactcccaaatcatttgtctttcgtattcgtccaaatcagattcaataacatcttcataatcataatcaattgagaacgttccatcgctttcaagattcagtgtcaaatttgtccatgctttagggttattttctttaaattcagtgtgtaactgcataaacaactcttggaggtctagtagtagtccggtataaatttttttactgacctgaaattgttctggtatgtcatgagagtatatatattcatcgttttcgggtgtttgaaagaaaaaataaacttctctggaaccgtctagtatttctgcatacagaacaactttgctccattcagaaggaattatttttcctaagacatcagttatttttagataagctttttctaacatcattatcccaactttattaaattggattttcaggatattcatctaaatattttttattaatttttgtaatgatggatccttaggttcttcccttaagtatttgaatttccagatgataagctgatcactgaaactataatctgtcttaaaccaatctgtataatcaaagttgacagttaattttccggatctttctaggctaagagtgaaagaataaaataattcttgatcatgatctttgaaaacatctctcattttttcgcttagtttaaataattccatctcatactgatcgaattcattttcgtcaatatcaaattcaaacggaatttcaagactgtacttaaaataattaggttcattttgagaattgtaaaaaaagtaagtgcctccgcctgtctctgaatctgagcatagaacaaaaatttctcccatggttctggtatcatttcgttaacgatttcagctatgtttctatataatgcatttaattcattttccaacaaggatcagcctccagcattataattggtaatttgtaaggatcatttgtatcaaaaaaacccccaataaaggagggggaattttaattttgagaatttaaatactgttctaaaaaggattttaaaggtttactcttaggataaattcctacatttttataagtccagattgtttgtctttgagagatggtatatggagattgaataacgtcttcataattatagtctatcgaaaattctccgcttatccccagattaagtgttagattagtccatatatcttgattgttttctttaaattcatctcgtaattcctcgaataagtcatgcaagtcaaataacagctcctcataaatctcctcactgacatgatagtgttcagggatattatgagaatatataaaatcttcactatgtggagtattgaaataaaagaaaacttcagatgaatcgtcaagtatttctgcataaagaataactctttcccattcagatggaatgatctcattaatgctttctgctatcttttgatataattgccccattttttttgtctccatattaacctccggcctgatttttgattctcataagtttagcttcttgatcaccaattttatatttcaccctaaaagcagtaggtcttaatgaatcacctttatacaatgcattaatttcaactgatactttttggggagggtctgcttgcaaagccgatgcccaatcttgctccattttgtaccatttcccgccgctcctattaatctgagaattcatcggcacgatgttgtcgaattggcctgagcctttgaattgggtggcgattaggtggcctccgtcgtcatctgtcagacggtctggtttacctgcttttgattgcgcatattggttgcgttttgcttctcccagctgcaagtctgctttgacacttgtaattctaccatagttgtcagtggtgtacgtgtagccttcttttgttttatagatgacattcggcttcaatactttctttctggtccatttcgcaaaatgctcgccgtatttgaccgttaccggcggtacatgcggtgccggtgtccgtctgccgcttgcggaggttccgtacggtttcggcaggatgaccttggcgaatttctgaagtccttctttaagtgtgaccccgttgactgcgttgtaaggaacgcccgccggcactacgtcgtgacgcggatgatacgggagaatatcagccagggtgagatctccgatttgatgtaacttggttttgacacgtttttttgatacttctatgcctgtgtttactttttgtttgatgtgatcaacggtttgttttgagaccgttatcgctttttgtgctgcggcggatttgcgtgctgctgttttgactttggttgtcactttggcggctgttcctgtttttgagacggcgccgacgccttttgtgccgacaactgatgtcacaacggtgcccactgcatatgacacccatcttgctcttgagtaggtgtcgccattcaccatgtctttttggtacgattcttcgattgccgctgaaatggcttcatacgtcttgatcgggtgagccgccgctcctgtaatggcttcaaccgttccgcccggatctgtgacaatatcccacaggcctgtgaccgcgtcttttccggaatcataaaggccgacggcaacgcctttgaaaccgtctgtaagttcacgcgtgttttcaatttgagtgaagtagcgctgctgttcttttgtcaggtttttatagccgattgttttggccattgagtagaattcatcagcattcgcataatcgtagtttttcagtctttctttcagtttttcaatctctcgttccttcgcttcctctttcttcatcttcaaataagcatccgaatgtcttgcaatctcgccttttttcttatggatgtcgctttcacggtacgccttggcgttgtagtgaagcggcgtggcgctttttcctttgcccgtggcattttgaagctgctggaagtcagcttggatgaactgttcgttcgcttcggtttctgcgtattctttcgttagatcgtgatcaagcttgccgagcttatgtatcgtttcgcttctttttttgtcagctgaagaaagcttctgatctgtgctttccgttgaaaacagatcaagcgagatgatgtcatcgatctcaccgaggatggagcgcatgtcctttttctgctcttccataatcgcctttgatttactgagggcgtgggtgagctcatgctccagaaatgattcctccacatgcgaattggaaagtccggcatcttcgaccttaccgggaaggcttgtgagaaatgcgattttcatgtcgatcagatcaagccagctgtctgtgacgccggcgtggtcctggaaaaaggctttgatgttatctgcgccccgaccagagaaatcgccgtcaccgagatcagccacgccttgaaatgcttttttcagattaaccatctgaccgcgcagttttttgtattcacccgcgcgctgtttggcagcggccagcagggtggttgcttcgaaaactttcatgaccatatcctttcttttgttcgatatcaaaattttaccacgggagtcaggatatacagtgtaggaaataggtaataagaataaaatgaatcttttgacttgcgacttccttcctgtatgaagggaggcttttttatgttttgtacaataatcctcaaattcggcttactgcgctccggtgattttaagcgtgcctgttttttctaatgtcttacactcgaaacaacccaaccgctgaggtataatagaagcagagtatttatcatacagattcaattcgtgaaagagagtggaacaaaatgggccgtaagtggaacaatatcaaagaaaagaaagcatcaaaggacgcaaatacgagccggatttacgcgaagttcggccgtgagatttatgtggcggcaaaacaaggcgagccagatccggaatcgaaccaggcgttaaaagtggtgcttgagcgcgcgaagacgtacagtgtgccgaaaaatattattgagcgtgcgattgaaaaggcgaaaggcggcgcggaggagaactttgacgagctgcgttacgaaggtttcgggccgaacggttcaatgatcatcgttgatgcgttaacgaataatgtaaaccgcacggcgcctgaagtgcgcgccgcattcgggaaaaacggcggaaatatgggtgtgagcgggtctgtcgcttacatgtttgatgcgaccgccgttatcggcgttgaaggcaagacggcggatgaagcgctggaattgctgatggaagctgatgtggacgtgcgcgatattttagaagaggatgacagtgttatcgtgtatgctgagcctgatcaattccatgccgtgcaggaggcattcaaaaatgccggcgttgaagagttcacggttgcggagctgacgatgcttgcgcaaaatgaagtcgagcttccggaagatgcgaaagctcaattcgaaaagctgatcgatgtgctggaagacctcgaagacgtacagcaggtttatcacaatgtagatttaggcgaataaagacaaaaaggccggggcggcataagttccggcctttttattttgcttatgcggccggcctgtatcgtatttctccgtaagcaattattgattatttcgccaaaactgggcggatgcccatacgtttccttccgcatgtcataaactggactgtaacctatgtgaaggagcgataaatcatgaatgaaagaagaccgatttacggcggaggctatggcggctacggaggctacccggggtacggttttggcggctacggtggctacggcggcttcggaggatatccgggatacggtttcggcggaggctacggctacccggggtacggttttggcggttacggcggttacggcggttacggcggttacggcggttttggcggctacggcggcttcggaggatatccggggtacggttttggcggctatggcggaggctacggcggctacccgttccatcaccatcatcatcgggacagccaatatatctgaccattcgggaaaagcactcttggaacagcaagagtgctcttctcatgttcttgcagctgtggtacgattggagcaaaatcatcaagtacatatgacatttctgtaaatcatgagcaagttgtttataaactgaaaagcatgatctgtaaaaatctctttatcgggaggttttacatgtgagaagtgaagacgaaatgatgaaattgattcttgatattgcgatgaaggacgagagaatccgtcttgtcactttagagggatcaagaaccaataaaaatgtaccgcgagacaaatttcaagactatgatatttcttattttgtgaccgatatggactcttttatatctgatgaaagctggctggatcagtttggcgaaagaatgatgatgcaaaaacctgaagatatggaacttttccctccggaactcggagactggttctcctatctcatgctttttaaagatcatcataaaatcgacttaactttgatccctctgagtcaaacagaggattattttacacagagtgatggtttggcggaaatattattagacaaggatgaccgaatcaacagtaagatgattgcgagtgatgaacaatatcatataaagaaaccgacccccggagagtttgatgattgctgcaatgaattttggatggtttcaacctatgtgattaaaggattaatgcgcaaagaaatactgtttgcgctggaccatatgaatgacattttaaggcctaatgttttgcgtatgattgcgtggaatattgggatagagcatcagttttcattaagtgtagggaagaattataagtatattcaacattacatgaatgcgaaagattgggaaattctgctgaatacttatgtcggcaatacttatgaaagcgtgtggaaggcattgtttgactgccaaggtctcttcagagcatattcaaagtcagtggctgttttattgagatacgaatatcctgaatatgatcagcaaattacggaatatacattgaaacattatcagtgctttcaatcagatttttcattatgatttttttacttcaaattccagatgagctgcatggagtccgtttttaacgggcttttttattttcttacagggcataaatgctgatacggattcatacctattaaggtcatgtgtttaggaaaggaggatcgtaatgaaagaaaatcagccgtttacaccggtcaaatcctataaacccttccacagccggtttgatccctgcccgccgatcgggagaaaatactacagaacgccgccgcatctttatatgcggtttcagccttatcacttggagcagttttctccgatggaggcattaagaaaagggaccctttggaaggatctttacgatttctatgataatccttatcgggggggaatcgaatatggcgaaaaagattgatgatgaatactatcggctgctggagcaaattcaggcggcggactttgtcttggtggagctgacgctttatctggatacgcatccccatgaccgtctcgcgcttcagcagtttcatgaatattcccggtactcaaggcagctgagaaaacggtttgagcctgagtacggaccgcttctgcaattcggcgtgagtcaggccggcgctcaatgggactggggccgcggtccttggccatggcaagtataaggagggatctgtaaatgtgggtatatgaaaaaaagctgcagtatccggttaaagtgagtacgtgcaacccgatgctggctaagtttctcattgaacaatacggcggggcggacggcgaattggccgcagcgctccggtacttaaaccagcgctacacgattcctgacaaggtgatcggcctgctgacggatatcggcacggaggagtttgcgcatttagaaatgattgcgacgatgatttataagctgacaaaagatgcgacaccggagcagctgcgtgatgcagggctcagtgatcattacgtcaaccatgacagcgcgctgttttatcacaatgcggccggcgttccgttcacagcgtcttacatacaggcgaagggagatccgattgctgatttatatgaggatattgcggctgaagaaaaggcgagagcgacgtatcaatggattattgatatttccgatgatcctgacctgaatgattcactccgttttctgcgtgagcgtgaaatcgttcactctatgcgtttcagggaagcggttgagattttaaaagaagaacgtgataagaagaaaattttttaaacggccctcaaacatgacggctgtttttttcctttctgcgtttggtctataataaaggtgtcgaatattctgattacaggaggattttatgacaccatttacgattacggaggagaaggcgggggcattccgggtcacctccgcccggaaggatgatgaagaagaagtcatggatctgctcgtgcaggcggcagaatggcttcgcgataaagggtcgaaccagtggagcggccttctgcaaggggaagatacccacaatatgcgggaggcgatcgccaaagggtatgtttttttattcaggcagaatgaagagctggccggcgtcgtcatgctgcttcccgaagcaagcgggtgggacagacgtctatggggcgatgaaggacatgaggagtccgtatatctccaccggctggcgattaacaggcggtttgcaggggcggggctcggccggacgatcatgacttgggcggagacgggggtgtcttgtcctggaaaaacgaaaatccggctcgactgcgtgtccggaaacaaggcgcttcagtcgttttacagcggaatgggttacgaatcaaaaggactcgcgccgggttatcatttgtttgaaaaaaaggtgagcaaataaaaagctcctcatgacggaggtgcaaaagacatggggtttttttatctgatctgtctggccgcattttgtcttaactttgccgtatcggctgtgctccgtaagaaatggccgaaaaagatgtggcctgagtggcttttggcggtgctgggcctgactgctttcggtacggttgtttacagcattttcggtgtcggcggctgggaaggcatgggcttggggcttgccgcgatgtttacgggttccggagcggccgccggttatgccgctgaggtatgcttacgggtcgtcagatcgaatcaaaaacagtaagcagaagtgaaaaaacgcagcctcgtctgcgtttttttgtgtattgccggccgctgtatagaaaacaggcgaatgtccataatggtaatgacttttaagaagaaggtgcgaatatgggacatttacttacagtggcttgggagttagtatgcggcttgggtattttatttgtgattttaaaattgcttggaaaaactcaattctcacaaattacgccgtttgattttatttccgcgctcatcctcggcgaactggtcggaaatgcggtgtatgataaaggcgtcaggattattgaaatcatttttgcttctctgttatggggggttttaatttatctcatcgaactgattacgcagaaagtaaaaagctccagaaagctgttggagggcgagccgagtattatcatacataaaggaaaactgaaatatgatgtgctgaaaaagaataagctggacattaatcaattgcaaagccttctcagacaggcgaattgcttttctatacaggaagcggagtacgcaattttagaaacaaacgggatggtcagcgtcctgccgaaatttcaatatgacacgacgaaaaacggcgacatgcaaataaagccgaagcaagtctctttgccggtcacgctgattattgacggcgaagtgctgtatgaaaatctgaaagaagccgggctggaagaaaagcagctgaatcaggagctgaaaaagctgaacatcaaaaaaacggaggacgtgctgtatgcggaatggaagcccgataaaccgctgtttgtcctgccgtttgaggagaaaaaataaaaagagcattgccctggggcaaatgctctttattatttttcgtgtacgcctgttttaacggctctgacatgatacataccgacatccgtcccaagcatataatcaggtttcggcttgccttggtttgctttgtgggccgcgatgtggtcttcgcttttttcccattgtttccaatggtcttctgactcccagcggattaacacgacgacttcttcatcaccgcggcggacttttttttccaggaccgttacgtctatcaaaccttcctgcttttcaatcacgccttctgaactgaagcgttcgattactttgtcggcatgtccttcttttacggtcatgtttctgatttgcacaaacatctggcagctctccaatcctttttacgttttatccaacattttaaatgaaaatgattctcaaagtcaattaagatgcctgacggattacgatttcaggagaaagacatgaccatcctcatctttaaattgcacgaagctgccccattccatttgtttcggttcatctaaaaaggtgatgccgttccttttcatctgttcatatgcggcaaagacatcttcacactcaaatacgatagaagccttcatatgctcggcgcctttcatcatcgatttcggataaataaccaaatgagtggcggcccctttgggcgctacctcaagccagaaggcgcccggtcccatcggatgctcggcgacggtttcaaaccccgctttttccgtccagaatgttttcgctttttgctgatcatcagtgtatacggcgactgtcgcgatttttttgatcatcatactgacctcctgtttcatttcttttatagtgtatcctcctgccgaaaaaagcaatcaaaagcttaatgtgcaggtttttttaatttctctagtgcgatcggtgattccgatttataatttagacaaaagtacatattcttgaaagaggagacggcagtgaacaaagaccaattacttcatgattatattattacacattcggcagagctgacggaaaaatggctcaagctgagacggaagctgagagggcgtttttattctgcggatcaattaagtgaggaaatgaaacggctgctgatcgagcagcatacctttacaaacacggtcatcgcaagcgcttttttggaagatccggccgtttttcagcataacaaagaaaaatgggccgctcaggtagcgaaaagcagagtggagcaagacgcggaggttcatgaggtcgttgaggcgatcggcaattcaagaaccgtcttttgggaggcggtcacccgttttatggatgagcatcaggacattgtaacaaatgaggatgcccgccgctggaattaccttgtcaacggctcgtttgatcagctgatgacggattttactgaacagtttcagaaattaatgatcgcgaggctgtcatctcagcaggagcttatttccgaattgagctgtccggttattttgatcgcggatacgatcggcactctgccgctcatcggcgcgattgatacgagacgggcgcgtgtgattttggagtcggtgccggaaaactgtgtcgccaaacggatcacaaaccttgtaattgatctgtccggtgtgcccattgtcgatacgatggtggcgcagcaattgtatatgctgtcgaaaacgttatttctcctcggcatcagaaccgtgttttccggcattcggcctgatgtggcacagacttctatccaattgggacttgatttttcagagtatcaaacttacggctctctggagcaggcgctcgccagcatgggtgtcacatgtgtgatcgaggaagcaaaagcatagaaaaaaggtgctccgtccagaggcggggcgctttttttgtcagcggaaaacaatttaaatatgtcggaacgtgaagattgcgttcttaaaaacagcaatatgacgccttgggggcgggcgtcggcgacacggtttatgtcaaagcaaaggaagtgaaagttttcgcaaagaaaacatatccgaaaattgtgtaaatgctgttgatttctgaatgaaaacataatagtataattatatatttcttatcagaatagtatggattaaaacactcattgtcaaaagacgaacgtccagacataaagggggagcatgatgacgtccaaaggaaacgtagatccgcatgtgatcgaaaagattatcagtgcgctggaaacgctcgatttcgggactgttcagattacggttcataattcccaagtgacacaaattgataaggtggagaaatatcgattttccctgaaaagcaaagaagtaaaacaatcttaaaaaacagccaatgacaggaggcggtacatatgaagcattcaactgttcctttccgggagagccggtatctgcacctgcccgaagtgcgctttctgcattggtgcacgaagcaatacggcataaataaaggcgtgctcaatacaattgacggctggttttatgatgcgggcgtcattccgattcccgtcaggcgtctttatgtgctggcattccttgatttcgtgaaaacgccggggcagaagggaaatatccgattcgggcacggcggattgacgaaaaaactgcatgatttcatggatatgcaggagtgcgcagcgaaacgtcaggcctgacatccttaaaatcttcttaaaatcatgcaaatttctcccattttatttataatagacctatcacgatcattttttgggaggacttttgacatgcaaactgctgcttatgagagcaaacaatctattatgcagcgcattatcacggtatttgtgtttacactgttagttgcgacaatcggcctgtatacgggccagttcattccgccggcattgatgctgccgctgtcggtcttggaggtcgtcatgatcatcgccgcattttggctgcgccgaaaaaaagccgtcggatatgtgtttgtcttttcattcgcttttatttccggaatgacgctgtttccgatcatcagccattatgcgtccgcagccggagcctatgtcgtattggaggcattcggttcttcgtttgtcatttttgcggtgctcggtacgatcggcgctaaaacgaaaaaggacttgtcgtttttatggtccttcttgcttgtcgctcttatcgcgcttctcgcagtggggatatttaatattttcagcccgctgaattccgccgccatgatggcgtattccgtcatcggaacaattgtgttttcaatgtacatcttatacgatctgaaccagatcaagcaccgggacatcacggctgacctgattcctttgatggcattgacgctttatatcgactttatcaacttgtttatcaacctgcttcggtttttcgggattttaaacagtgatgattaatcgcgcgaaaaaggcgccctgctaagaggggcgccttttgttaattttaagagttttgaatttttaatctcataagccatgagattccctttgtcatacgtttgccagctagaagtgaacggagggtttgtcataataacaaacctgtttcaaaaaatttgaaaggggaaggatattatgccttgtagtacagattatgcaacatatgtattgagagtttgtaccgatgcggattcttattctgcaaaagctacttctattgattgtgtagcatcatatgggggcgggacaatcgcaacatttgattattccatgacaattgatgtttggaacggttcaaaatgggtggctaatgaaacaaagaaaggttctttcagtcactcaacacctaaaaaagtatttaaactctcaaatcaaaaatcgttaaaaaaaggatcaaatagtgtgagagtgaggttgaagactaaaaatcgatatacaaatgtaacttccagcattaaaacacctgcatttatagtgaagagaaagtaattttaaaattatttcttctgaaacagcctgaacaaactaatgtgcaggctgtttttttataaccctcatctttttacttcaatttctatctcatagaaatttgcctttgtttttacaatactactttatgttctgtctccggaaaacagcagaagcttatcaaataaaacttcaagcatttttgtcaattccgctttttctccagcggtgaagctttccatgactcctgaaatgttggagaagtggccgggaagaaacagcatcagcttttcttttccttcccttgtaagttcgatgctgatttttcgtctgtcaccggtatgccggctgcggtttacaaagccgtcccgtgcgagtccgtcgatcaatccggtgatggtcgctttggtgacattggattttttcgccagctccgtcggactcaggctgtggccgggttcgtcaaacagaaacattaaaattttgaatttcccttcggacaatccgtgacttgagaaataatgctccatgacctgattcatttttttagacatatcaaataacgtcaaaaatgttttcaatgattcagcatccatatcggcgtaaatctcagcgcgtccggcaatctgcgagtaatccggcaaatgtctcaattccattttgtaagcctccgtaccattttagtgattcaaagtataagcttgccggattcaaaaggcaacctataaagattgacagtttttcagccaatatagtaaggtggctaatagttaacaaatgataaataaattgagaaggcggtatcgtgatgaaccatgaagtgaaaaagatcatcatagcgggcggagggatcggcggcctgtccgcagcgatttctctcggcagagcgggttttgaagtaaccctttgcgaggcggcgtccgacatgcgaaaaagcggagcgggcattcttcagcctcaaaatgcgcttcgggtgcttcgggaaatcggtgtgtatgatgaatgctgtcaacacggctttcaaacggattggctgaagcagcatgatgaaaacggaacgctgcagtttaaagtgagtgaggcgtttttagatgattcattgccggggcggaataatatattgcggcaaacattaaacgatatcctcagcaagcatgctgaggcggcgggggtcacgattctgcccggtaaaaaagtcgtgtcttacgaagaaacggcagatgaaataacggtgcattgtggagacggaaccgcgatgacggctgacatcctcgccggctttgacggcatccgctccgctgtccgcaatcacatgctgcaaagggaagtgaaaacagagtatctcggcatgggagcgcacagattttacatttcttttcccgagccggtttttcatgattcgacactgatgtataaaaaggggcagacgcaggtcggggtcgtgccgctctctgaaaaaacaggatacgtatttatcatccggccgtatgacgctgacttcagggatgacgaggacacgcgttttgaacgggtgagagacttgctgcgcggaattccgggagtgaagtttgtgacagagaatatgtcaaaggaatatcccgttttgtttcataagattgagcagatggcggtcaaagaaccgtggcacagaggccgcgtcgttctgggcggggatgccgtccatgcaggagcgccgacattggcgcagggagcggcgatggcgattgaagacgcgattgtgcttagtgaagaactgcaaaaacacgaaaaccatgaaactgcatgtcaagcatacttcgaaagacgggcggagcgggcattacaggtgcagaatctctcatctgaaatcgtccgccgcgagataaagggaacgcccggcgtccaagacatcatcggtgaatgctatcgattgctcaaagagccttattaaatacagaaagtccagaacatggcgtctggacttttgtcagtcttgttcagatttattccgtatccgctcaatcacctcatgcagcccctcaggcttgtgaaactccaccggcgaactgcctttttcaaacgagatcgtctccgcctcaatgagcgcgacatagcgcccgttcacttttgcgagatggatggattcgccgaaatcagccagtaatcctttaatctctgtttctccgactttcattttcagctcggcttccggcgtgtgttcaatgatctgcgcggatgcctcgatgacttgatgggtgtcgaggcgctcctgaatttcccgcttttcactcgcttcccaaatttcaatgtcgtgctcaaactgctgaagctcttcgctgttttcttcaaaagtttcatacacgtgctcctgcaccatgttcatgacttggtttttcatgatttccggcatcgattcgccatattcgacaaatttgagaaaatcttcgaaataacgggcgtgcgaggcctggtggattttcagctcatgctcttccgtcatgccttcttccggcatatacggatattgaatgcttttcatgttttttgtcgtgatggccatttcgacctttttaatgagagacgaggcgtctgagatgcgggcgaccttcggctcgaaatcgcatttcatcataaagacgaatttgtcctcaaaatatttgcgcggaacggccgaagccacgataaaaacaccgccgcgcacggcgctcgtgtcaagataagtacggacgaactgttcgcttgcctcgataaatgcttccttcgtatccgcaagtctggcgcggttgaaaaggttgtaattcggatttgaatcaagctcatggcccggctccgtgataaaatggccgatttttgtggggacctgctcggattgcggatgccgttcagctttccgtttgacgattttcttcaattccccgtcaagaaaatccttcagctcgctttcttcaaattcgtctgtgtcaagggtctggaaatgtttgaactgtttgtttgcctgttcgtcttttccttccacttgaatgacataaaacgataaaaacttgatttcaaaatccatatgtgaactcaccttatttctgtatttaacaagcctctccagtatagaaaaaaccgttatcaatcgtcaatccggggattgatccgtaacggcggataattggccggtgaaaagggcactgtagttggaaggaacgcatcaatgtgtaagaaagggtgttattcatgaaggaaacaggtccgattccgcagccgaagacattcggtcctctcggcaatcttcctttgcttgataaagacaagcctacaatgtcgctgatcaaactggcaaacgagcaggggcctatttttcagctgcataccccggcgggcgccattatcgtcgtgtccggacatgaactggtgaaagaggtatgtgatgaagagcggttcgataaaagcattgaaggtgctttggagaaagtccgggcgtttgccggtgacgggctgtttacaagctggacgcatgagcctaactggcgaaaggcgcataatattctgatgccgaccttcagccagcgcgcgatgaaagattatcattcgatgatgactgatatcgcggtgcagctgattcaaaaatgggctaggctgaacccggatgaggccgttgatgtgcctgctgatatgacccgcctgacgctcgatacgatcgggctttgcggctttaactatcggtttaacagctattacagggaaacgcctcatccgtttatcaacagcatggtgcgcgcccttgatgaagcgatgcaccaaatgcagcgccttgatgttcaggataagctcatgatcaggacgaagcgccaatttcatcatgacattcaggcgatgttttcgttagtagacagtattatcgcagagcgccggtcaggcggacgggatgaaaaggatctgctggccagaatgctgaatgtggaagacccggaaacgggcgaaaaacttgatgatgaaaatatccggtttcaaatcatcacgtttttaattgccggccacgaaacgaccagcggcctgctttcctttgccatctattttctgctgaaacatccccgtgttttggaaaaagcctatgaagaagccgatcgggttttgaccgatcccgttccttcttataaacaagtactggagcttagttatatccgaatgattttgcaggagtcattgcgcttatggccgaccgcgcctgcgttcagcctttatgcgaaagaggatacggtgatcggcgggaaatatccgatcacgccgaaagacagaatttccgtcttaattccccagcttcaccgtgataaagacgcgtggggagacaatgcggaggaattttatccggagcggtttgaacatcctgatctagtgcctcaccatgcgtataagcctttcggaaacgggcagagggcgtgtatcggtatgcagttcgccctgcatgaagcaactcttgttctggggatgattctgcagcattttacctttatcgatcacaccgattatgagctcgatattaaacagacactgacgattaagcccggcgactttcatatccgggtgcggccgagaaacaaaggagccgttgcggcagctctcccggcggctgaaaaagcggcggaagacgtcgaaaaagaaaaacgggaaacaaaaggcgcatccattatcgggcttgataaccgaccgcttctgattttgtacggctcagatacgggaaccgcagaaggcgtggcgcgggaacttgccgatactgccgggatgcacggcgtccggactgaaacggcgcctttaaatgaccggatcggaaaactgccgaaagaaggagctctcttgatcattacgtcctcttataacggaaagcctccgagcaacgcgggacaattcgttcaatggcttgaagaagtcaaacccggggagctggaaggtgtccgatatgccgtcttcggctgcggtgatcataactgggcggcgacatatcaggctgtgccgagactgattgatgagaagcttgccgaaaaaggggcggaacgcttttctgcccgaggcgaaggggacgtcagcggggattttgaaggaaagcttgatgaatggaaaaaaagcatgtggacggacgccatgaaggcattcggtcttaagctgaatgaaaatgccgaaaaagagcgaagtgcgctgggccttcaatttgtcagcgggcttggcgggtctccgttggcacagacgtatgaagcggtttacgcatccgttgcggaaaacagggaacttcaggcgccggaaagcggccggagcacaaggcatatcgaaatcactctgccgaaagaggctgcctatcatgaaggggatcatctcggcgtgctgccggtaaacagcaaaaagcaggtcagccgtgttctccgccggttcaatctgaacgggaatgatcaagtgctgctgacggccagcggacagagcgcggctcatctcccgctcgatcggccggtcaggctgcatgatcttctgagcagctgtgtcgaattgcaggaagcggcatcaagggctcaaatccgggaaatggccgcttatacggtctgtccgccgcacaaacgggaattggaagattttcttgaggagggcgtctatcaggagcaaatcttaacatcgcgcgtctcgatgctcgatctccttgaaaaatatgaagcgtgtgaacttccgtttgagcgatttctggagcttttgcgcccgctgaagccgcggtattattcgatttcaagttcgcctcggaaacatcccgggcaggcctcaattaccgtcggcgtcgttcgcggccccgcccggagcggtttgggtgagtatcgcggagtcgcttcgaattatttagcggaccgccgccctgaggatggtatcgtgatgtttgtccgcactccggaaacacgattccggctgccggaagatccggaaaaaccgattattatggtcggtcccggcacaggagtcgccccgttccgcggatttctgcaggctcgggcagcgttaaaaaaagaaggaaaagagctgggggaggctcatctgtatttcggatgcagaaacgatcatgattttatttaccgtgacgagcttgaagcttatgaaaaagacggaatcgtgacgcttcatacggctttctcccgcaaagaaggcgtaccgaaaacgtatgtgcagcacttaatggcgaaagacgccggcgctttaatttccatcctcggccggggagggcgcctctacgtatgcggagacggcagcaaaatggcgcccgatgtagaggcaacgctgcaaaaagcgtatcagtcggtccgcgaaacagacgaacggcaagcgcaagaatggcttttggacctccagacaaaaggcatttacgcaaaagatgtttgggcggggatttgagcgatgtgatgaaaaggactggatgactccggtcctttttttacatcacccaaaaaaaaccttcaagtttttcagtccctttgcatacaataacttcagcccgcctgttgggcggctgtctttgatattcatttttcgtttttagaagtttgtgttattcttatatttggtatctcctattttcagaccgggtctgataaggtaccttttaatgccagaaaaaaatgtgaaacgaagaacggatatcctgcgtctaatggctggcgggataagatgttcaataggcatgacacgaatgataaatatatcgttttttaaaatggtgtgtttatggggctgtgtgatgctttcgttttgctcggaaagcaggaattgaagcaaaaagtaagaatacagatttaaagtgtttaggaaagtagaggttgccatgaagaaattattttcttacagacttagtttttttgtactggctattattttgttttgggccaaaacgtatttagcctatcatgctgaattcaaccttggggtgaagggtccgacgcagcagtttctgcttgtgatcaatccgttctcaagcgccattttctttttaggactggcattgtttgcgaaaggccgcaaatcagcgattatcatggtgattattgatttcatcatgacgtttattttgtatgccaatatcctattctatcgattcttcgatgatttcttgacattcccgaacttaaagcaatccggtaatgtcggaaatatgggagacggcatcttcagcattatgtccggccatgatattttatactttgttgatattattattttaatcgcgcttctggtgtggagacgtgagctgaaggaattcaagctgaaaaaacggtatacgtcattaattatcgtgacgggtattgtgttgttcttcgtgaacctggcgattgccgaagaggaccgcccggagctgctgacaagaacgtttgaccgcaattacattgtaaaatacttaggcctttataattacacgatttatgacggcgtacagacggcgcagacggaatcacagcgggcatatgccagcagtgatgacctgacgagcgttgaaaactatacatcgtcgcattatgcgaagccgaacgccgagtatttcggcaaggccaaaggcaagaacatcattaagattcacctggagagcttccaatcatttttgatcaattacaaacttgacgggaaagaagttacgccgttcctgaataaactcgcccgcggcggagaggacatgacgtactttgataactttttccaccaaacgggccaaggtaaaacatctgacgccgagctgatgatggataacagtctgttcggactgcctgaagggtcagccttcgtgacaaaaggggaaaacacgtatcaatcgcttcctgccatccttgaccaaagtgagggctatacaagcgccgttttacacggtgactacaaatcattctggaaccgtgaccagatttacaaacatatcggctacgataaattctttgacgccagcacatacgatatgtctgatgacaaccttgtcaatatgggactgaaggataaaccgttcttcaaagaatctataccgaagcttcagtcgctgaaacagccgttctacgcgcatttgctcacgctgacgaaccattatccgtttacgcttgatgaaaaagacgcaacgatcgaaaaagcgaaaacgggcgacgcgactgtggatgactatttccagacggcgcgttatcttgacgaagcgcttgaacagttctttaaagatctgaagtcatccggtttatatgacaactcggtgattatgctttacggagaccattacggaatctctgaaaaccataaccgcgcgatgaaagaaattctcggcaaagaaattacgccttatcaaaacgcgcagaatcagcgtgtgccgcttatgcttcgcatccccggcaaaaaaggcggggtgaaccatacgtacggcggtgaaatggacgttgtgccgacgatccttcacttggaaggcatcgattctaagaaatatattaatttcggcaccgatctcttctcgaaagaccatgatgatacggtgacgttccgcaacggagattacgtcacgccgaaatatacttccatctccaatgtcgtatacgatacgaagacagggaaagaactgaaaggcaatcaggaaacgaaaaacctgaaagccagagtcacagagcagctgaagctgtctgacagcgtgatgtacaaagacctgctcagattccacaaattgagcgactttacgccggttgatccgtctaaatatcattacggcaaagaaaagctgaatcaggataataaataatagaaagagccttacggaatttccgtgaggctctttttttgtgtgtatcttcaccaatctgaaaaaagagagagcttttggtcacaaagggcgccaatctctcatatcttacagtagattttgaaaccggtggtagagaatcggacaaattatcgggttggtttctcttatacgggcggtttcgaatccaatattcacagagaagaggggtagagatgaaagcagtcattctctgcggcggaaaaggaacgagaatgagcgaaatcaccaatgaacgtcccaaaccgctcgccatgataggcggcaaaccgattctatggcatattatgaaactctatcaatactatggcgtgaacgaatttatcctgcttcttggtttcaaaggagagatgattaaggaatatttcttagattatgactggaagaatcacagcatgacgctggacagctctaccggagaagtgcggatattgggaacatccgagccgtggaaaatcacttttttagacacgggggaacacacgcagacagcggggcggcttttacaggcgaaggacatcatcggtgatgaaacctttcttatgacgtacggggacggactggcgaacatcaacctgtttcatctgatcagctatcatcaatcaaaaggggctgcggcaaccgtcaccggtatagaaaagacctcgcaattcggaacgctgacggttgaagacggtatggcgaaaagcttttctgaaaaaaactcaagtgacggcatcatcaacggcggatttttcgtgctcagcccgaaggtatttgattatctgccgaaagacagggacgtcatgtttgaagaagaaccgctgaaggagctggcaaaggacggcgaattggcggtataccggcattacggtttctggacggcgatcgatacgtataaaaatctgctggaaattaacaagatgtgggaccggggacaacatgtatggaaggtatggtgatcaagtttgagtttctggaaaaataaaaatgtgtttgtgacgggatgtacaggtcttttaggaagctgcttggtgaaggaactgatcgatcagggggctaatgtgacgggacttgtccgtgacactgtgcccaagtcgaacctgtatcagggagaacaagtgaagcaaatgaatatcgtgcagggcgcgcttgaagatctggatgtgattgagcgggcgctgggcgagtatgaaattgacacggtctttcatttagccgctcaggcaatcgtcggcgtcgcaaaccgcaatccgatttccacatttgaagccaatattctcggcacatggaacatccttgaagcgtgccgcaggcatccgctcatcaagcgggtgatcgtcgcgtccagtgataaagcgtacggcgaccagccgacactgccgtacgatgaaaacatgcctcttcagggcaaacatccgtatgacgtatcaaaaagctgtgccgatttattaagccacacatattttaatacgtacggacttccggtctgtattacgcgctgcggcaacttgtacggcggcggagatttgaacttcaaccggattattccgcagacgattcagctcgtgctgaacggtgaagcgccggaaatccgcagcgacggcacatttatccgtgattatttttacatcgaggatgcggtcgaggcataccttttgctggcggaaaagatggaggagctcaatcttgcgggagaagcgttcaacttcagcaatgagattcagctgacggtgctggaacttgtagaaaaattcttaaggcgatggacagtgacctcaagccgaaagtgcttaaccagggaagccacgaaatcaagcaccaatatttatcagcggaaaaggcgaggaagcttctgaattggacgcccgcgcataccattgatgaaggattagaaaaaacgatcgaatggtataaagccttttttcaaaagtaacagaaacagaggtgagagaaagacgtgacaagcgcatattgcacagttttatcaaaaggaaggctgtatcaggctatcgctttgttcggctcattgaaagcggttcaggcggacgcccccatttttactttgtgtatggatcaagacacctatgacgtgcttcaggcaatgcgtccggataatgtcaccttgattcaggtgtccgcactggaaaatgaggagctccttgaactgaagcggacgagggatcagagcgaatactgctggacggtgaagccggtatttctcgaattcgtgctggacggacatccggaattagagcgtgtcacgtacattgatgccgatttgtttttcttcgctgatccgcgcgcgatttttgacaatcagccggattgttcggtgcttctgtcacggggcgatatcgtcattccctcatttgaaaaacaggaaatcgacatgctgcagcgtcttttaggccggtataattccggttttctcagcttcaaaaccgacagtgccggcacagattgtctcagatggtggaaagaacgctgccttgaagaatgcaaaaatgcgccgggcgaaggaaaattcggagatcaaggctacttggattacatgtccggtctgttcccgaacgtgtgtgacatcaccacgcccggcgtgaatatcggccattggaattacggccgccacacgttttcatggaaggacgggcgtcttgtgctcgaagacggaaatccgctgattttctatcatttcagcggataccggatcgtcacagccggcgacattcggcagattcatgagacggaccggaccgacctgccgtttgtccatcagctttatcaggacattctgaagcgggtgatcgggacggtcagcgccgtctgccccgagttcagcggctttgcatctgaggatgataacaaataaatgatcatatacaggaagtgaacgaaaagtgaaggcaagcgtcattgttcccgcatataattccaaggagaggctttataacagcctgctgtccctgaatgaacaggaatgcacagagccgttcgaagtgattgtggctgacaacggttcggaagacggaaccttatccatgcttgaatcattcagcgcgaattttccgctgatttttgtgagaattaaagaaaacagagggatcgcttacggccggaatcaggcggtccgcaatgccagaggcgatattttgattttccatgacagcgacatgcttgccgaaaaggatttggtggcgaagcatatcaaggctcatgagaaccgggacgatcttgtcgtatgcggtatgttctggaagcggatttacagcttttattatgaccgttttgaaaaagagcataaggaaaaactcgccgaactgtatgaagagctgccgggcgataaagagccgctccttgatgaaagtgacatcagagacggaagctttcttgaacgatgctttgatttagataccgactttatccgggtgctgaaaagcattttggaaaaatacggagatgatttgaacggctaccgtctgccatggcgttttttcattacgaacaattcatcagttaagaggcagcacgtggcagatctcggcctgtttgatgaaggcattgtcagatacggctttgaagattatgatctcggcatcaggcttcatcagtcgggaatgagatttcagctgcggcgcgatatcatgagcgtccatcaggagcatccgagcaactgcgcttccgttgatgacatcagggcgaatatcgcgtacatgtgcgacaagtacaatgacattcattcgcttgacgtgcacctcgcgtttaacggcccgtttgacgcggagttaaccaacagcataatggcagacatcgaagtgctgcttgattatgagaaatatgaaagcctgctgcacatttttctcgaactgctgcacgcggttaaagaccgcaacctcgatccggactggaagacgaaaagcccgcggatcacggcgaacagcttccagctgccggaggtcggaaagcttttggcaaaagcggaaaaaaagctgggcgtcacgcactttgcaagggcgttcaaagcgctgactgctgatttactgcatgtggatcttaaataaattggatgtgatatggtgagtaaatatcatttttcaaccattgtttccagaacgcatatctttaaactgatgccgatgattcattctctccatgagcattgccgggattttcatctgtatgtgctgtgtgtcgatcagaaagcgtacgaactgcttcagcaggtgccgtgggaacatgtcacagcggttcagctccatgaaatggaggacccggagctgcttgaagcaaagggcggccggacgtttcatgaatattgctggacgctgaagccggcttttctgttccatgtgatgacggagtatgatgaagccgaatattttgcccatttggacaccgatctctttttcttctcagatgcgggcgagctgtttgcggaaaagccggatgcttccctttttctgacggatcaccgcaattcagaacggtttgcgtcttattacaagctgacggggcagtacaacaccgggtttgtcggcgcgcggaataccggggaagcgtatcgggcggtctggcagtggagacaggattgcatctcctattgtacggtggagatgaatgaagaaaaaaagacatacggtgaccaaaggtatgttgaaaagtggcccgcgcagtttgaacacgtgcatgtcacggagtcgatcggcgcgaatgcggcgctgtggaatattgagcaatatgacgtcagcctgcgcgacggggctgtatatgtcaatgacaccccgctgattttttatcatttttcaggctttacgctcgtcacggagaacgaattcaatctctgctggtactatcacattgatgatgaggcgacagtcagtatgatttacgtcccgtacatcaaaaacgtaaaaaaatggattgatgaaattcaaaaagcgtttcctgatttcagagacgggtttattccgaaatatgcggttcctgacactcatttttatacggttgaaacataaaatccctgccttttcggcagggatttttttatgaatgccattcttttaatgttttgtcgctcggcaggacaaaggcgagcagacctaaaacgggcagaaaggcgacggctgtcatggtcggcgtcaatcccgctgaatcaataagagctccgagcgcaaccgctccgatcgcgcccattccgaaggcgagcccgaccgtaagccctgacatcgttccgattttgccgggaacaagctcctgcgcgtagacaaccgtcacggagaagctggacatcagaacaacgccgatcagcgccagtacgccataggcgatgacaggtcccgcaaacggaaggaaaatcgtcaagggagccgatgccgtcatggaaacgatgatgacgttccgctttccgaaacggtctgcaagcggcccgccgagaaacgttccgacagctccgaaaaataaaaagacgaagatgtagctctgtgcctgctgaatgctgacatgataggcattcatcgcatagaacgtatagaagttgccgatcgcgctcacataccaggagcgcgcgaaaattaagaagataatcatgataagtgcaagaataatcggttttgtaatcacggtctgcacagcggcggccggtgattttttacttgcggcgcgcaaatgaataaggcggcctttataccatttggcgatataaatgagaaacagcacagcgattgcggcgactagcgtaaaccagacagagccgaattgaccgagcggaacgagaatcagcgcggtaatcaagggcgccatcgcctggccggtattccctccgacttggtaaatcgattgcgccaatccgcgcttttcgccggcggccatgtaagcgacacgcgatccttcaggatgaaagacggcggagccaaggccgataaaaaagacacagcataaaatcgtcagaaaagacggggcgaacgcgagacctaaaatgccgagcatgcttgcggtgagtccgagcggcaaagcatacggcatcgggcgtttatccgtataccagccgatgacgggctgcatcacggaagacaccatattcagcgtaaaggcgataattccgagctgcgtaaatgtaagattcatggaacgttccaaaatcggaaacatcgccggaatcaccgcttgcagtgaatcgttcagcagatgacagatcccgataatgaacaaaatagaatacatggttgtctcgggacgatggacaggtttttctttaagcggggcggcaattgccaaagtgattctcctcctttttatgtaaacgaagcatacaccatattattcataaggtgaatgaattatcaagggcaaaaaaggctcttctttctcaaacagaaaaaagagcctccctttttatttatttaacaaactgtgttttctcgaatacatcatatataccacgatcccggcggcgatccagatgacaaaggcgagccatgtcacgcccggcaggctgcttgcgagatacaggcataagcatgcgctgatgatcggcacaaaaggcacgaaaggaacacggaaggaagatttgatctccggatgtttctttcttaaaacgatgacggcgatcgcaatgactgtaaaggccgccaaggttcccatattgacgagatgcgccaaggttcccagatcaataaaacctgcgatcccggcggcagcgatccccgtcacccatgtgttttgaaacggtgttttaaaacgcgggtgaaccttggaaaacatgcggggcaaaaggccgtctctgctcatcgcaaatgttaggcgcacctgagcgtaaagcagagcgagcatgaccgttgtaatcccgataatcgcgccgacggaaataatgcctgctattttgttctggccgacaaattggagcgcgaaagataccggatctccgacattcagcttggtgtacgaaagcattcctgtcaggacgagcgataccgtaatgtaaagaacggtgcagatggcaagcgcgccgatgattccgacaggcattgatttctgcgggtttttcacttcttccgacgcgtttgacacggcatcaaatccgagatacgcgaagaaaacggtcgcggcgctcgtgatgacgcctttcattccgaacggcataaacggcgaccagttttccggtttcacgtagccgaaaccgacgacgataaacagcagaatgatcgcaattttcatcaatacaatgacattgttaaagcgggtgctttctttcacgccccttgaaacaatcgcggtaatgaccaaaataatgataacggccggcaggttgaacacggcacccgttttgctgccgggtgcggcggtcagcgcctccggaagatgcagcccgaatcctgcaagaagcgactggaaataggatgaccagccggttgcgacggcggcgagcgcgataacatattcaagcattaagtcccatccgattaaaaacgcgagacactccccgagagtaacatatgaatacgtatatacgctgcctgaaatcggaatggatgaagaaaattccgcataacaaaacgcggcgagcgcgcaggcaaggcccgcgagcacaaacgacagaatcaaagccggtcctgcgcctgtcgcggccacagtcccggtaatcacaaaaatccccgtgccgacaacacagccgattccgagcaaaaccaagtcaaaagcgcttaacgagcgggacaggctggtctgtttgctctgggcctttaagtcggccagcggctttttccgaaatagtaaagacatatgggtcctcctgaaaattcataatattcttatcattatatacactgacgtttgtattatattgtcgaaatttctcgcagtcaattaaagaattttccactttaaaaggacaaagctaaaaagcgtcgatgcacggaaggaaagggaattttattgtgaaatagttcaattttctcaccttaagaccgatacaaaagatgactcatcaactaatttcaagtttcggtgaaagggagatgtttacatgtttcaatatgaagaactaaataagcagtttatcggcggccgatggagggatgggagcagccggaacgtattggaaaacagaaatccttatactcaaaaagtcatcacctcattccgaaaagcgacgcctgatgacgtggatgcggcatatcgcgccgcggctcttgcgaaacaagaatgggacaaagtaaacccttttaaaaagcgggccattttggaaaaagccgtttctttcattgaagagcacgaagaagcgattatttacttaatcatggaggagcttggcggaacacggctgaaggctgagtttgaaatcggacttgtcaaaaatatgataaaagaagccgcaacatttccggtgcggatggaagggaaaattctcccgtccacgattgacggaaaagaaaacaggctgtacagaatacctgccggagtcgcaggggtgatcagcccgtttaatttcccgtttttcctttcgatgaaatctgttgcgccggcactcggcgcggggaacggcgtcgtgctgaagcctcatgaagaaacgccgatctgcggcggaacgcttatcgcgaaaatttttgaagcggccggcgtaccggacgggctgctgaatgtcatcgtgacggatatcggggagatcggcgacagctttgttgagcatcccgtgccgcggataatctcatttacaggctcaaccggagtgggcagctatatcggacagcttgcggtcaaacactttaaaaaaccgctgttggagcttggcggaaacagcgcgctgatcgtgcttgaggatgctgatcttgaatacgccgtcaatgcggccgtattcagccggtttacgcatcaaggccagatctgtatgtcggcgaaccgcgtgctcgttcacacatctgtttatgacaaatttacagagctctacgaagcgaaagtgtcatcgctgaaagtcggcgatccgatggaccctgatacggttatcggtcctttaatcaatgagagacaggcggaaggcctgagacggtctgtcgaaaaagcgatagaagagggagcggttccggtgctgtccggccgattcagcggaacggtcgctgagcctgtcattttaaaagatgtgaaacctgagatgagcatcgcgaaggaggagctgttcggaccggccgtctgcatcatgccgtttgaaacggaggatgaagcggtaagcatcgcaaacgcgacaccgttcggtttaagcggagccgtgcatacggcaaacgtggagcggggcgttgagtttgctaagcggatcgaaaccggcatgattcacgtcaacgatacgaccattaatgatgaaccgaacgttgcgttcggcggcgagaaacaatcaggtctcggcaggctgaacggcgaatggagccttgaagaattcaccacgctgaaatggatttcggttcagcatgaaaaacgccaattcccatattaagaaggagtgaaagaaatgagtatacagacggagcagcaaacgcacagcctgcttgacgcttttgtcaaagttgcgccttttttaaacagcctgatccaagatgacatcaccatcggaatttatgatacagaaaaattaatcgtgaatattccggctaaaacgttttctcttaatgtaaagccgggagatccgctgcaaaaaggggacatcattacagacgcgatccgcatgaatcagaagaagacaagcatggtgccgaaagagctgttcggatttccgctgatcgccagagcgattccgcttcacgatgaaaacggaaaagtcatcggcggcgtcggtctcggcacgagccttgaaaaatcagccaagcttcatgatgtcgctgaaagcctgtccgccgtcgtggaacagaccgcttcggcgatcgcggatatctcagaatccatcagcggtttctcagcacagatgaccgggatttccgctcaggcgaaacaagtcagtgaaagcgcgggagaaatcgccgacatttccgttactgtcaagggcatctcggatcaaagcaatctgctcggtttgaatgcggccattgaagccgcgagagcaggagaatccggcaagggcttttccgtggtggcggatgagatccgcaagcttgccactcattcaaaagacaatgtcggccaaattgaccagattacgaaaaaaattcacagcctgctgaaagggctggaggactcaattgaatccatcaaccagaacacggacggtcaagcggcggcggtagaacaaatttctgccacgatgcaggagatttcgggaagcgcccagcatttagcgaaaatggctgaaaacgtgctcggagaatcataaaaaagggagcttacgggctccttttttgttttcccttatcaatcggaaactgcacttacacgtttgatccgtcatgctcaggggtacacatacgaatacatcaccaatgataaaggagagtcttgtatgtctgatgcaaatctgcacaacccgctgacgaaatatgatcatgatgaatttccaaaacaatatcaagaaccgcccggtttgcagaaagagatgaagcctgtgccggactgcggtgaaacaagctataaaggagccggcaagctgaagggaagaaaagccctcgtcaccggcggcgattcaggtatcggccgggccgccgcgattgcttatgcccgggaaggggcggatgtggccattaactatctgcctgaggaacagccggatgccgaagaagtgaaagcgttaattgaaaaagagggaagaaaagctgttctgctgccgggagatttaagcgatgaagcgttttgcggagaattggcggaaaaagcgtatcaagagcttggcggtcttgacacgctcgctcttgtcgccggcaaacagcaggcagtggatgatatcagcgatcttactacagaacaaatctatcaaacatttgaagtcaacgtattctcgctgtattggctcgtcaaagccgcgcttccgtatctgccggaaggcgcgtctattatcacgacaacgtccgtagaaggttataatccaagcccgatgctgttggattatgctgcgacgaaacatgccattatcggttttaccgtcggcctaggaaagcagctggcgaataaaggaatcagagtcaactcggtagcgccggggccgatctggacaccgctgcagatttcgggaggacagcccggagaaaacattccgaaattcggcaaggaaacaccggccgttccattaaagcgtgccggacagccggcggagctggcaggaatttatgtctttttggcctcagaagaatcaagctatgtgacatcccaaatttacagtgtaagcggaggaattccgacagcgtaatcaaaaaggagctgcccttcatacggggcagctcttttttttgatgttatgtgccgagcacgttttgattatacaggacactcggatgtgacggatgataggaggcggctttgtcgttatgaatcttcgctttttctctgtcgccgagctgccagtggcagacgcagagctgcagatgggggtaccaggtggaatattcgagctgggtaaagcctgcatcactgcttttggcggatagggcgagctcataccaaaacacgccctgccggtattgccgtttctccgcaaaatagtcgccgagcctgcagcagaactccggccgcggacaatcgatcagaaatgattttaagagagacgtcatggcggcctcttcatggccgaccgccctgtagcaatcggatagatattggcacgttctgatctcgtcttcgatccagcactgttttgtggaaagaaaatggtgataatacgtgatggcgcgctgatactggccgtgatcctttaattcattcgcgaagtaaaacaaatcgcgcggtgtcatcgattcactgttttccgccattctctcataaatcttcaagttgcggtccgagggaggcgagtgctttttttcggatttccggtgtgtgacggcaatatcggtttctatgatgtttccgtatacctcaagatactcatgcacggctccgatccagcggaaccctttttcacgcttgacgagtcggttgcggcggtatctgaagctgacctctccccgatcatcaaagccgacgtgataatacatggataccgcgtccacctcttttgaaagcgacgccttcagttcaatcagcttttcacggtcctttaccgtcagcatatcgtcggcgtccagccacagaatataatccatttccgctttcgaaaacacaaaattacgggcggcggcaaagtgatcgatccattcaaaatcataaatcttatccgtataacgggccgcgatttctttcgtccggtcggtcgagcccgtatcagcaatcacaatttcatccgcaatgtctttgacggaatcaagacagcccgcaagcacttcctcttcatttttcacgataacgcacaaactgacgctgatcatgtcatcacctcttcccctccagtgtataaaaggagaggcggaaacattcttcggacaaaatgatctcttccaagaaatttgtctgtccttttactagttttattacagcgcctgatttaaaatgaacacatgaacttacgtgaggattgataggaaccatgagcatcataaaagcggaaaacctttataaaacatacggagataagacattattcgaccatatctcctttcatattgaagagaatgaaagaatcggtttaatcggcccgaacggaacggggaagtctacgcttctgaaaaccattgccggccttgaatcaacggaggaaggcgagattacggcttcaggaaacgtgcatattgagttcttgcatcaggaccctgagcttccggccggacaaaccgttcttgaacatatttattccggcggatcagccgtcatgagaacgatgagagagtacgaaaaagcgcttcaggcgctgaatgaagaaccggaaaatgaccagcgtcagaaacacctgcttgatgcgcaggcccgaatggacgcgaatgatgcgtgggaggcgaatacgttagccaaaacggttttaaccaaacttggcgtcaccgatctgatgaaggatgtcagcgagctgtccggcggccagagaaagcgcgtcgcgattgcgaaaaacgtcatccagccggctgacctgctcattttggatgaaccgacaaaccacttggacaatgaaacgattgaatggctggaaggctacttatcgcaatatccgggcgccgttatgcttgtcacgcacgacagatattttctgaacagggtgacgaacagaatttacgagcttgagagaggcagcctttatacgtataaaggaaactatgaagtattcctggaaaaacgggccgaacgggaggcgctggcagagcagaaagaaacaaaacgccaaaacctcctgcgccgcgaattggcgtggctcagaagaggagcgaaagcgcgctcgacgaaacaaaaagcgagagtggacagagcggaggcgctcaaggagcaaaaagggccggcagtctccggatcactcgatttcgcgatcggttcccaccgtctcggaaaacaagtaatcgaagccgataacgtctccattacctataacggccaagcgctgatcagccagtttaatgagcttgtcatccctggggaacgaatcggcatcatcgggccgaacggaatcgggaaaacgacacttttaaacagcctcgccggcagaattcagcctgacagcggcaatatcaccatcgggcagacggtccggatcggctactacacccaggatcacagcgaaatgaacggcgatatgaaagtcattgaatatataaaagagacggccgaaatcgtcaaaacggcggaaggcgatgtcatcaccgcggaacaaatgcttgagcgttttctgttcccgcgtccgatgcagcagacatatatcagaaagctgtcaggcggggaaaaacgccgtctgtacttgctgaatgtactgatgcaggagccgaatgtgctgtttttagatgaaccgaccaatgatctggacacagaaacattaagcgtgctcgaggattatatcgaacagttcccgggcgtcgtcatcaccgtatcccatgaccgctatttccttgaccgcgtcgtggaccgcctgatcgtatttgaaggacacggtgtcatttcccgtttccaaggttcatacagtgaatacatggaacaagcaaaagagaagaagacggcggtaaaacagccggccgaagagaaaaaggcggaagaagagccgaagaaaaagcgcaaaaagctttcgtacaaggatcagatcgaatgggacggcatcgaagacaaaatcgccggccttgaagaaaagcatcagcgtctggaagcggaaatcgctgaagcgggaagtgatttcggaaagatacaagaactgatggccgaacaggcaaaaacggctgaagagcttgaagcggcgatggaacgctggaccgaattgtcactgatgattgaagaacttgagaattaagaaaagccggtacggcccccgagaagatggcgggtcataccggctttttttatcttacacagatgtctcccggcgctttaaagacaaaggttccgtccaagccaagtttatccggcataaaaagtttacgtttacgttaaggttcaaatggtgtataatagaaacagatacgacaagagggggattcaccttggaatggatgaagattgatcaagttgccaagcgaagcggattgacaaaacgaaccattcgtttttacgaggagattggtttgattcctgctcctaaacggacagaaggcggcgtccggctttactctgaagatgatatggaggagctcgaaaaagtcaccagcacaaaagaagtgctcggtttttcccttcaggaacttcagcagtttatggagatgagccgtcagctggaattaaacaaagaggggtacttgttgtcactggatccgaaggaacggaaagaaaagctggaagagattcagcacgctttgaaccaccagcttgagatgattgatgagaagatcagcacatttcagcattttaaaacgcgccttaacggaatgaaagaaaaagctgaccgcgccattcaatcaatcgaatgattttgctgtaaacgctatggatatagcgtttcttttaatggataaaacaggaggtctggtcaaatggatacatcatcacaacagaaaacaggcttattcagccagccgaaagccgtttgggcggttgcgtttgcctgtgtgatttcctttatgggaatcggtcttgtcgatccaattcttccggcaatcgccgcacaattacatgcttcacctagtgaagtatctctgttatttacaagttatttgctcgttaccggttttatgatgtttttctccggcgcgatttcaagccggatcggcgcaaaatggacgctgcttctcggacttatttttatcatcgtgtttgccgctctcggcggaagctcaagttcaatcgctcagcttgtcggctatcgcggcggctggggacttgggaatgctctctttatttcaaccgcgcttgccgtcatcgtcggtgtatctgtcggcggcagcgccaaagctattattctgtatgaggccgcgctcggactgggaatttctgtcgggccgcttgccggcggagagctaggcagcctttcatggcgcgctccgttcttcggagtgtctgtcctgatgtttatagcgctttgcgcgatttcactcatgctgccgaagctgccgaaaccggcgaaacgcgtcggtgtgtttgatgcgatgaaggcgctcaaatataaaggccttttgacaatggcagtatctgcattcttatacaactttggattttttattttgcttgcttattctccgttcgttctggatttagatgaacacggtctcggatacgtcttcttcggctggggccttctgctggcaattacgtcagtctttacggcgccgctcgtgcataaagcgctgggcacagtgcgttcgctcgtcgttctctttatcgcctttgcggccattctcgttattatgggggtctggactgaccatcagacgttgatcattacatgtatcgttgttgccggtgctgtcctcggtatggtgaatacgatcatgacaaccgctgtgatgggtgctgcgccggttgaacgttccatcgcgtcttcagcctacagctcagtccgctttatcggcggtgcgctcgctccgtggattgcgggaatgctgtcagaacacttcaccgcaagcacaccatatacagtaggcgggattgtcgtttttgtcggcatgcttgttcttcttatgggacgcaaacatcttgccggaataaaagccggacattaaaaaaaggaacttccgcacgggcgggagttcctttttgtgtttacagcactttcgtcgtccaagattcacaattccatgtttccgtcgcgatatccatgtagaactcgggttcgtgggaaatcagcagaatggagcctttgtattctttcagcgcgcgtttcagctcttctttcgcatcgacatccaggtggtttgtcggttcgtcaagcacgagcaggtttgtttctgaattgatcagcttgcacagtctgaccttcgctttttctcctccgctgagaacggagacgcggctttcaatgtgtttggtcgtcaggccgcatttggcgagggcggcgcggatttcgtattgggtaaaggaaggaaattcgctccacacttcttcgatgcacgtattgttattggtttctttcacttcctgctcgaaatagcccgtgtattgatgctcgccgcgctccaccgtgccttccagcggctggatttcaccgagcaggctttttaacagcgtcgttttcccgatgccgtttgcgccgtacagggcgactttctgtccgcgctccattctgagattgagcgggcgtgacagcggagtatcgtaaccgatgactaagtccttcgtttcaaaaatgagcttgcctgacgttctcgcaggcttgaaatggaattccggtttcggtttttcggccgccagttcgatcatatccatcttatcaagctttttctgacgggacatcgccatatttctcgtgctgacgcgggctttgttgcgggcgacgaaatctttcagctcagccacttcctgctgctgttttttgtaggcggcttcgagctgctgttttttcacttcgtagacttccataaactgatgataatcaccgacataacgcgtcagctcttggttttccacatgataaatcaaattgattacgctgtttaaaaacggaatgtcgtgagaaattaagatgaacgcattttcatattcctgcaaatagcgtttcagccattcaatatgctgttcatcaaggtagttcgtcggttcgtccaacagaagaatttccggcttttccaaaagcagtttggcgagcagcactttcgtccgctgtccgccgcttaagtcagtgacgtcgcggtctaggccgacttcctgcaggccgaggccgcgggcgatttcttcaactttgctgtcaatcacgtagaaatcattgtttgtcagggcgtcctgaatgacaccgacatcttcaagcagctgctcaagctcatcagggtccgcttcgcccattttgttgtaaatctcgttcatttcttcttccatcgcaaataagtaatggaacgcatccttcagcacgtcgcggatcgtttttcctttttcaagcacggtatgctgatcgagatagccgacacgcacgtttttcgcccattcaaccttaccctcatcaggctcaagctttccggtaataatattcataaacgttgatttaccttcgccgtttgctccgattaagccgacgtgttccccttttaaaagacggaacgatacattgttaaaaagcgcacggtcaccgaagccgtggcttaaatcttttacggataaaatactcatcattacacctctatcgttatcagacacgctttttttatcatgtgtctttctcatttatgattataaaggaggagaccgtttgttaaaaggcttggaaggaaaaagaaaattgcgtttgccgcgtgcatttgagatactatggagtagattttaagaattgaggagaacgacatgacccaaacatggccatttttacagcatacacaaccatttatcgccgaaaactgggaggcgtcaggctttcaggagccgaccgttattcaggaaaaagccgctcaggtgatcatggaagggaaagacgtcattgccgaatccccgacgggaacgggaaaaacattggcgtacacgcttccggttctggagcggatcaacccggaacagaaacatccgcaagtgatcattttagcgccgtcccgcgagcttgtgatgcagatttttcaagtgattcaggagtggaaaaaaggctccgatcttcgcgctttgtctttgatcggcggggcaaacgtgaaaaagcaggtggagaagctcaaaaataaaccgcatatcattgcaggcacaccgggcagggtgctcgaattgattcaggcgaaaaagctgaaaatgcatgaagtcaagacgatcgttcttgatgaagcggatcagctcgtgacaaaggaacaccgcgaaacgatgaaaaaaatcattaaaacgacgctgaaagaccgacagcttttaagcttttccgctacgctgcagccggagacagaagaggtgctgaatgccatcgcacatgaaccggccgttttgaaagtggcgcggaatacggcggaaaaagcgcgcgtcacgcatcaatatctcgtctgcgatcagcgggataaagtgaagctattgcaaaagctgtcacggctgaacggcatgcaggcgctcgtgtttgtcagagatatcggaaatttaagcgtctatgcggaaaaactcgcctatcatcacgtggatctcggcatcctgcacggagaagcgaaaaaaatggagcgggcaaagatattatcagcgtttgaagggggagaatttccgctgcttctggcgactgacatagcggcgcgcggacttgatatcgatgatcttccgtacgtcattcacgcagacatcccgaatgaagacggatatatccacagatccggccggacggggcgggccggtaaagaaggaaccgtactcagccttgtcacgccgatggaagaatccaaattgaaaaaaatggccaaatcactcggaattgagctgaaagaggccgtttattcaggcggaaaattatctgagaaataagaaacggagggcgggaagcccttcttttttattgtgaaataatagaaaaggttcaggcgggggcgggaagatggtttcaatagaccgatttcaaatattgaaggtacgtgagctgaaaatacttgaacactggtttaagaacgataatatcagacggagaatggatgcgatgcggccactaaatgcatggtatgcacgattgagtaaagatgaagacgatactgtcattatggcatatgacgggcagcttccggcaggaatggtctctatagagtttgtggaggaacgggcgtatatcggattgatcgtcaatcctttgtaccagcttcaagggtacggaaaacagatcttgcaaaaactgctgactgatcctgggtttaccggcgtgcgggaatgggcggcaagcatctaaaaagacaatcaaatcagtttagtctgctttcaagcagcgggattcactttggaaaatacggagcctgatgaagacggctttcttactttgattcttcgcggctgatgcgaaaaagcagaaaaggaggggacaaagccctccttttttcatcatcatgttaacctagatcactgactttgatgatctgtttgcctttgttttctcctttaaacaaaccgaggaacgcgtcaggaatatggctgaatccttccgtaatcgtttcttcataatgaagcttcccgtccttgagccattcggccaattgtttcgcgccttcggaaaagcggtcagcataatcactgacgatgaacccctgcatcagcgcttttgttttgatcagcttcggctggacgcgggggcccatgtcttcctcttcactttcggtattatatgaagagatcgctccgcataccggaatgcgggcgaattcattcagcaggtttatcaccgcatctgaaatcggtccgccgacattgtcaaaatagacatcgacgccgtcagggcatgcctgttcaagcgctttttgaatatcatccgccgttttgtaattaatggcttcatcaaattgaagctcctctttaagatacgcgattttttcgtcagaaccggcgatgccgacaacccgcgcgcctttgattttggcaatctgcccgaccgttgagccgacggcgcctgcagcccctgaaacgacgacggtttcgccttttttcggacgcccgatatcaagcaggccgaagtaagcggtcagtccggtcatccctaaaatgccgagatacgcctgggcgggtgcgatatccgtatccaacttgcggagggcggactcattgacggctgaatattcctgccatgcgagatttccgatcacaacatctccttttttcagcttatcgccgtctgtcagaacttcggcaatcactccgcctgttatggcttcatctaaagcgaacggctctacatatgattttgtatcctgcatccgtccgcgcatgtacggatcaacggacacataactcgttttcacaagcacttcgccgtctttcggttcgggaacggcaatcgtttcaaagcggaaatcgtcatggacgggaacgcctttcgggcgtcttgccaattgaatctgctgctgattattcggcatactgaatcctccttcaagataagtggttgttccaaatgtaacacgaaccatttcccgaatacaaaatcaaaccgtccgccggcaacaaaaaaagaagggccagggcccttcttttcttatatgcgtatttaaaagaataaccggtacacatcggtgtttttctcatgttccaaatattcataggcattcgtttttgaagaatgaagcatgtcagaggtaatcacgggctgaagcgcggtcagataagaacccagcttattttcaatttctgtcggcagaacggattcgatatcaccgatattgataatgatagagaaaacgaaatcgatattaatatgaaaagtatcttcagcaaaggccgtaagctcttttattccatccgggcagcgggtatgccggcggaatacctgcttcactaaatcactgacaacccaagcgttaaatcgctgttccggtgaaaagtaatgaataggaaccacctccctgcttaatcggctcatgaagatttttatttttctgataaaagttactttccctactgtaacatgtcccgccggaaaatatccaccgacaatctgcccgttttttcccggaactctctttcttttgtttgacctttggttgagcgggtaaacatccaatatacaaaaacaaaagggaggacttatcaatgaaaccggtagtaagagaatatacaaatgatcaaaaactgatgcaggacgtaaaagagcttcagcaattgggtgtcgcaaaagaagacgtatatgtgctttcacatgatgacgacagaacggaccgtctggcggataatactgatgtcaataccatcggagcgaaagaaacgggcattaaacacgcggtcggcaatatgtttaataaaaaaggcgacgagctccgcaacaaaattcacgaaatcggcttttcagaagaggaagcatcacaatttgaaaagcgcttagatgaaggaaaagttcttctgtttgtcacggataacgaaaaagtaaaatcatgggcgtaagctgaacagatcccaaggggttttcggtcccttgggatttttttgcggtttccgcaataaaaccgaaaggcacatgctgtacattttcggtgccgtttctcaactgatttgatacaatccaattgtaataaattggaacagagaatcaggaggagcacaattcatgaaaaaaatgttacttatgctggcggtttgtttatgtatgatccctgcggacgtctatgccgctgacctgggacggcagacgttaggaacaaatgacggctggggagccgcttccggcgggacaaccggcggcgcgaaagcctctttatcgaatgtctacaccgtatcaaacagacagcagctcgtttctgcattagggggaagcgccaacagcacgccgaagattatttacatacaaggcacaatcaatatgaatacggacgaccggaataaaacgctcggctttaatgattataaagatccggcatatgatctcaacgcttatctgaaggcgtacgacccggacaaatgggggaaaaaagcgccgtcaggcacccaggaagacgccagacagcgatctcaaaaaaaccagaaagcacgggtcgtgattgacattccttcaaatacgacgatcatcggttcgggttcaaatgccaaagtgacaggcggaagttttaatataaagaacggcgtcgacaatgtcatcatccgcaacattgaatttcaagacgcttacgactattttccgcaatgggacccgacggacggcagcagcggcaactggaactcggaatatgacaatatcaccattaacggcgcgacgcatatctggatcgatcattgcacctttaatgacggatcgaatcccgacagcggttttccctactattacgggagaaaatatcagcaccatgacggccagacggatatagccaacggggcgaattatattacattgtcctataataaatatcatgaccatgacaaaggctccgtcatcggaaacagcgacagcaagacgtcggatgaaggaaaactgaaggtgaccattcaccataactattaccagaacatcgtccagcgcgcaccgcgggtccggtacgggcaggttcatatttataataatttttacgcaggctctaaaagcgccgcatacccgttcagctatgcgtggggcgcaggccacgcgtcaaaaatatatgcccagaataatgtctttgaagtgccgggactggctgctgataaagtcatcagcgtcttcagcggcggaaaagcacttcatgaagacggcactcttttaaacggcgccgcaattaacgcgtcagctgccaacggattaagtcagtccgtcggctggacaccgtcattgcacggttccatcggctcatcatcaaatgtaaaatcagatgttatatctaaagccgggtcgggtatattaaaataataaacaagaagcacaaaggaaaatattcctttgtgttttttaattaacaaaaacgtttattaacttagttaagtagtaaaatgggatagggggatggaagacaacaaaataggaggagacctgtaatggcttcagaaaaagacgcaaaaaaacagcaggcagtaaaaatcattcctttgcttattactgttgctgtgggattaatcatttggtttattcccgcgccgtccggacttgaacctaaagcatggcatttgttcgctatttttgtcgcaacaattatcggctttatctccaagcccttgccaatgggcgcaattgcaatttttgcattggcagtcaccgcgttaacgggaacgctatctattgaaaatacgttaagcggatttggaaacaagacaatctggctgattgtcatcgccttttttatttcccggggatttatcaaaaccgggcttggcgccaggatttcttacgtattcgtacaacggttcgggaagaaaacactcggcctttcttattcactgctgttcagtgatttaattttatcacctgccattccgagcaacacggcacgggcgggcggcattatttttcctattatcagatcattatccgaaactttcggatcaacgccggcagacggaacagagcggaaaatcggcgctttcttattaaaaaccggttttcaaggaaacttgattacgtctgcgatgtttttgacggcaatggcggcgaatccgctgatcgccaagctggcccacgatgtcgcaggggtggacatcacatggacaagctgggcaatcgcggccattgtaccgggattggcgagcttaatcattacgccgctcgtcatttataagctgtatccgccggaaattaaagaaacaccggacgcggctaaaatcgcaacggaaaaattgaaagaaatgggtccgtttaaaaaatccgaactctccatggttatcgtctttttattggtgcttgcgctgtggattttcggaggaagcttaaatatcgacgcaacgacgacggccctgatcggattatccgttttgcttttgtcacaggtattaacatgggaggacatcaaaaaagaacaaggtgcatgggatacgctgacttggttcgcggcgcttgtgatgctggcgaatttcctgaatgagctcggcatggtgtcttggttcagcaatatgatgaaatcatctgtttccggtttttcatggattgtggcatttatgattctgattgtcgtgtattattacacgcattacttctttgcgagcgcaaccgcgcatatcagcgccatgtatgcggcatttctcgccgtcatcgtggcggcaggcgctccgccgctgttggcggcgctcagcctggcgtttttcagcaaccttttcggttcgacgacgcattacggctcaggagcggctccggtctttttcggagcgggttatatctcgcaaagcaaatggtggtccatcggctttatcctgtcaatcgtccatattgtgacatggcttgtgatcggcggattatggtggaaagtattagggttatggtagaagaaaaaaggcagactcaggtctgccttttttttatttctgtaaggaatgggaagggcctgcacacgctgacttcagtgcgaatagaatattgccggggtgatattatgagcagcggccgtaatcaatacatgatattgaaacagaaaccttacaaatatatgagcagacatatgaaacgccggtatgaacaattaccatgtgaacttgaaagtccggaaacagggacggaaaaacggtttccgtcttcaaatgaaaatcgatctgccttgtgcgtacccgggctgcgaggtcccgaaggcaaaagaggacccgccggctcccgcggtccgcaaggggaggcgggtccgccgggtccgcccggtccgcccggtcccccggggcctgaggggccgccgggagcggttcctgcggtagcttttcaaaatacagcagacctaatgacgcttccgttagaaggaacaccgataaacgtgttaagcgcagtgatagctgcgccgacagatcaattggtgaaaacggatgccgtcatacaagtaaatgtggaattagatccgcttgcgtctcatttctcattggtcttagctgtcgagctgcaaagaaatggcgtaacgatacaaacacagagacaagagcggaacctcttttcttcaggcggacaaatcataggaattccttttacgtacatcgacgaaatgaaggcggatgaaacagccgcgtatcagctctatttatccgtcctttcttcgaactacgtaacacaagtcgcagcagcaaaccgctccctcattgcgacgggattccccattcaaggatcggattaaggtgatgaaaagaaatcaccttttttatttaggttgtcaaaacacagcccgtattaatatgctgtcttaataagtaagacggtcaacaacgggaaggagagggaaaaagattgaatgaataatccgattataaacggaagctttgaaaccggcacattagcggggtggagttcggcaaatacccagattaacagtttgtttgcacattcagggagatattctgcgcaatttattggagctcagccatatgcttacctcagtcaaatcgttcccatttcagccaagtcagtgactctattcgtatcactcgcaacgctcggaaatgatccaagtccccaagtcactctccagatcatctatgtcagcgcagcaggtgaacaaatcagttccattcaagaaaatattacacccggaaatttgccgaacgtgctctttcacacatggtctgaaatctataaaacaagcagtgtgccttctggcgcggcctctgccgtcattgtattaagtaaagtttcttccggcacggttttaatagacgatgtttcattggcgcaaaccgggggtgaacctggcgtaacaggaattacaggtcccactggagtgacgggcccaacaggagtgaccggcgcaagaggagcgacgggagtaactggtgcaaccggggcaagaggagcgacgggtgtaaccggtccaaacggagtaactggtccgacaggagtaactggagcaaccggctcgactggtgtaacaggagcgaccggaaccacgggctcaaccggagtgactggagtaacgggagcaactggttcaaccggttcaaccggagcgactggggtaacgggtgtaactgggggaacgggaacaaccggcccaactggagcaacggggataacaggagcaacaggcccatccggagcaacggggataaccggcgcgaccggtataacaggtccaactggatcgacaggagaaaccggcccaaccggagtaacaggggcgacaggagaaaccggtccaaccggagcaactggttcaacgggagtaactggagcaacaggcccaacaggaacaaccggtccaactggagtaacaggagcaacaggctcgactggcataacgggaacaaccggcccaactggtgaaaccggagaaaccggggcgacgggagtaaccggatcaacaggagtaacaggattaaccggtgcaacgggatcgacaggctcgactggggtaacaggatcaaccggtgcaacgggagaaactggttcaacaggagtaactggctcaaccggtgtaacgggagtaacaggagcgaccggagtaacaggggtaacgggatcgacaggcccaaccggcccaaccggcccaacaggggcaacgggtgtaactgggggaacgggaccaacaggttcaaccggagaaactggtgtgactggcccgatcggggtcacgggatcgacaggagcaaccggggcgacggggataaccggctcaaccggagtaacaggtccaacgggggaaacaggcgcgactggctcaaccggtccaaccggctcaaccggtccaataggagttactggcgcaaccggagaaactggcccaacaggagtgactggtgcaacaggctcaaccggagaaaccggctcaactggtgtaactggttcaacaggagaaaccggtgcaactggtgtaactggttcaacaggagaaactggagcgacgggagtaaccggatcgactggcgcaacgggatcaactggagtaacaggatcaacgggagaaacgggcccaactggagtaactgggacaacgggagaaaccggagcaacaggatcgactgggttaactggtgtaaccggatcaacaggctcaactggttcaacgggagtgacaggttcaaccggatcaacaggcgcgactggctcaacaggagcaaccggcccaaccggagtaacgggatcaacaggagcaaccgggtcaactggagtaacaggtacaacaggcctaacgggtgtaacgggtccaacaggagtaactgggacaacggggataaccggatcgaccggggtaacgggaccaaccggaccgacaggatcaaccggctcaactggtgcgacgggattaactggagaaaccggcgcaaccgggggaacaggttcaactggttcaacaggagcaacgggatcaaccggtccaaccgggccaacagggtcgacaggttcaactggagttactggtgcagcaggatcaactggacccacgggagagatcggtccaacgggatcgccaggctcaaccggagaaaccggtgcaacgggagctactggagtaaccggcccaacaggggcaacgggtgtaacgggagcgaccggagtaacaggggtaacgggatctacaggctcaaccggcccaaccggcccaacaggggcaatgggtgtaactggagaaatcggcgcaactggagagaccggtccaactggatctacaggttcaaccggaataacaggggcaacgggttcaaccggaccgacgggctcaacgggagaaaccggtgcaaccggtgcaacgggagtaacaggagaaacaggcgcgactggctcatcaggctcaactggagtaacaggagcaacgggatcaaccggcccaaccggcccaaccggaataacaggtccaaccgggggaacagggtcgacaggtccaaccgggggaacagggtcgacaggtccaaccgggggaacagggtcgacaggtccaaccgggggaacagggtcgacaggagaaaccggcccaactggctcgaccggggatactggagctactggagtaactggagctactggagtaactggtgcaacaggagaaaccggagcgactggtgtaacaggcccaactggttcaaccggagaaaccggggcgacgggagtaaccggatcaacaggagtaacaggatcaaccggtgcaacgggagaaactggcccaacaggagtaactggctcaaccggcccaaccggtgtaacgggagtaacaggagcgaccggagtaacaggggcaacgggtgtaactgggggaacgggcccaaccggaccgacaggagaaaccggcgcaaccgggggaacaggttcaactggttcaacaggagcaacgggagtaacaggagcaacgggatcaaccggtccaaccggtccaaccgggtcgacaggttcaactggagttactggtgcagcaggatcaactggacccacgggagagatcggtccaactggatcgccaggctcaaccggagaaaccggtgcaacgggagcgactggggtaactggtataaccgggggaacgggaacaaccggcccaaccggagcaacgggggtaacaggcccaactggtgaaacgggtgtaacgggagtaacaggatcaaccggtgcaacgggagaaactggcccaacaggagtaactggctcaaccggcccaaccggtgtaacgggagtaacaggagcgaccggagtaacaggggtaacgggatcgaccggcccaaccggaccaagcggcccaaccggcgcaacaggggcaacgggtgtaactgggggaacgggcccaaccggaccgacaggagcagccggctcaaccggctcaactggtgcgacgggaataactggagaaacaggcgcaaccgggggaacaggttcaactggtttaacaggagcaacgggaccaaccggagtgactggagcaacaggagccaccggtgcgacggggataaccggctcaaccggagtaacaggtccaacgggagaaaccggtgcaactggagtaactggagcaaccggggaaactggctcgaccggggataccggagctactggagtaaccggcccaacaggggcaacgggggtaactggagagaccggtccaatcggagcaacgggttcaaccggagaaactggttcaacaggaacaaccggggtgacgggagtaaccggatcaacaggagtaacaggttcaaccggtgcaacgggatcgacaggagcgactggggtaactgggacaacaggagtaaccggtgcaacgggagaaacgggaccaaccggagccacgggagtaactggttcaactggaataaccggatcgaccggtccaaccggtccaaccggcccaacaggtgtaacaggagaaaccggagtaactgggacaacgggagaaaccggtgcaactggagtgactggagcaacggggataacaggagcaacaggtgcgacgagcccaaccggtgtgactggaccaacaggggttactggctcaacaggagaaaccggagccacgggctcaactggagtaactggagcgaccggtgtaactgggtcaacaggaataaccggaccgactggctcaacgggagaaaccggctcaaccggtgcaacgggaataactggagaaaccggagcaaccggatcaactggcccaaccggagcaacaggtgcaaccggagtaacgggatcaacaggagcaaccgggtcaactggagtaacaggtacaacaggcctaacgggtgtaacgggtccaacaggagtgactgggacaacggggataaccggagcgactggggtaacgggtgtaaccgggggaacgggcccaaccggaccgacaggagcagccggctcaaccggctcaactggtgcgacgggaataactggagaaacaggcgcaaccgggggaacaggttcaactggtttaacaggagcaacgggaccaaccggagtgactggagcaacaggagccaccggagtaacgggtctaactggtgtaacgggatcgacaggagcgactggggtaacgggagcaaccggccccaccggagtaacgggtctaactggtgtaacgggatcgacaggagcgactggggtaacgggagcaaccggccccaccggagtaacgggtctaactggtgtaacgggatcgacaggagcgactggggtaacgggagtaaccggctcaactggtgcgacgggattaactggagaaacaggcgccacaggatcgacaggcccaaccggcgcaacagggccaacaggtttaacaggatcaacaggagcaaccggaaccacgggctcaactggagtaacaggagcgacaggagaaaccggcgcaacaggggcaacgggggtaactggagaaatcggaccaactggctcaaccggtgcaactggctcaactggctcaactggctcaactggctcaaccggcgcaaccggagtaacgggtccaactggcgcgactggctcaaccggcgcaaccggagtaacgggtccaactggcgcgactggctcaacaggagaaaccggtgcaactggatcgactggcgcaaccggtccaacgggtgtgactggagcaacgggagaaaccggctcaactggcgcaacgggtgcatccggggcgaccggcgcaacgggaataactggagaaaccggagcaacaggatcgactggggtaactggtgtaaccggagcaacaggctcaactggttcaacgggagtgacaggagcaactggttcaacgggagtgacaggagcaactggttcaacgggagtgacaggagcaactggggcaacgggggtaactggagcgaccggtccaaccggatcaactggttcaacgggagtaactggagcaaccggatcaactggttcaataggagaaaccggagcgaccggtgtaacagggtcaacaggaataaccggtgtaactggctcaaccggcccaactggtgaaacaggagcgacgggagtaacaggcccaacaggtgtaacaggagaaaccggaaccacgggatcaaccggagtaactgggacaacgggagaaaccggtgcaactggagtgactggagcaacggggataacaggagcaacaggcgcgacgggcccaaccggtgtgactggaccaacaggagaaaccggttcaacgggtgtgactggagccacaggagcaacaggatcgactggggtaactggtgtaaccggatcaacaggctcaaccggagtaacaggggcgacaggagtaacaggggcgacaggagaaaccggagcgactggcccaaccggagcaactggcccaaccggagcaactggggcaacgggggtaactggagcgaccggtccaaccggggtaactgggacaacgggagaaaccggtgcaacaggagtgactggagcaacggggataaccggagcaacaggcgcgacgggcccaaccggtgtgactggaccaacaggagaaaccggagcaacgggctcaactggtgtaaccggtgtgactggatcaacagggttactggctcaaccggagaaaccggttcaacgggtgtgactggagcaacgggtgtgactggagccacaggagtaacgggatcaacaggagccactggagtgactggggcaacggggataaccggagcgactggcgcaacaggagtaacaggttcaaccggagaaacgggtccaacaggagtaacaggggccactggagaaactggcccaacaggaatcacgggtccaacaggagccacaggagtaacgggatcaacaggagccactggagtgactggggcaacggggataaccggagcgactggcgcaacaggagtaacaggttcaaccggagaaacgggtccaacaggtgtaacaggactaactggagcaacgggagtaacaggcccaaccggtccaacgggtgtgactggagcaacgggtgtaactggagcaacgggtgtaactggagcaacgggtgtaactggagcaacgggtgtaactggagcaacgggtgtaactggagcaacgggtgtaactggagcaacgggtgtaactggagcaacgggtgtaactggagcaacgggtgtaactggagcaacgggtgtaactggagcaacgggtgtaactggagcaacgggtgtgactggagcaacaggagccactggagcaactggagtaacaggagtaactggagtaacaggagtaacgggtgcaaccggagtaacaggcccaaccggtccaacgggtgtgactggagcaacgggtgtgacaggagcaactggagcaactggagcaacgggagtaacaggagcaaccggagtaacgggagtaacaggagcaaccggagtaacgggagtaacgggagcaaccggagtaacaggagcaacgggagtaacaggagtaacgggatcaaccggagtaaccggggtgactggcccaactggagtaacgggcccaaccggaccaaccggcgccacaggcagtacaccaaccttgctcttcacaagaaccaacgggccgctcactgtttatccgccgttaaatacagaagttcccgttgctacgctggcaatcccagttaatgctttgcagaatgtaaagctggattatgcactcagtgccgcgttaacaactgcagcgaattcaaactttgtttttgaagtgagattatataggggagcagtgcaaattcatacaagaactctgtcgcgaaccagtactctcgcagctacggatagtttttcgattgctgatacaacagtggatactgcgccgaccgcaggaacgaacacttaccagctcagggttattttcacaactgctaataatttaacgacagcaactgcactcaatatcgattttaacagcataagttttccgacaacctaatacaacagcagactgatattttaaagatgaaagacctgacttatgcacagttaggtcttttttctgtaaaatgctgtgcatgatgcagtcttaacgaacatttgaaaaattgcccaatagaagtggggttttgccacaccttttttctctgtggaaatattatgaaaatagaggtggtgtaatgagaaaaggagatacttggtataacagatacgattcttgggattacgactgccgaaattgtaatgagtgttgctgtcattttcaacataaaagaagaaatcaaaggcgcagttatcaaaatcgggcacattgctgtgaaggattctgttgcgaacccccttgctgtcatgaaagatggtgtccatgctgtcatccaaatcattttcacgtaagaggattcaccggagcaacggggtgcaccggagcaacaggactgaccggagcaacaggactgaccggagcaacaggactgaccggagcaacagggctgactggagcaacggggttcactggagcaacagggctgactggagcaacggggttcactggagcaacagggctgactggagcaacggggttcactggagcaacaggactgaccggagcaacgggctcgaccgggaataccggagcgactggggtaaccggtgccactggagtcactggagatcccggcgccacgggagtaacgggagccaccgggataacaggcgctaccggggtaaccggagcgacaggagtaacgggagcgacaggaataacaggagccaccggggtaacaggcgtaaccggagcgattggagtaacgggagccactggagtaaccggggatactggagctaccgggataacgggcacgaccggagtaacgggagcgacaggaataacaggagccaccggggtaacaggcgtaaccggagcgattggagtaacgggagccactgggatcaccggagctaccggagtaactggggtaaccggagtaacaggagccaccggggctactggagccactgggataactggagccactgggataacaggagcgacaggagtaacgggagccaccggggtaaccggagcgactggagtaacgggggcaaccggagcgactggagtaacgggggcaaccggggctactggagtaactggggtaaccggagtgaccggagtaacaggcgcaaccggagtaaccggggatactggcgctacaggagccactgggatcaccggagcgactggagtaactggggtaaccggatcgaccggagtaacgggagtaacaggagtaacaggagtaacgggagtaacgggagtaacaggagcgacaggaataacgggagctaccggggtaacaggcgctaccggagtaacaggagcgacaggaataacaggtgcaactgggatcaccggagcgactggagtaactgggatcaccggagcgactggagtaactggggtaaccggatcgaccggagtaacgggagcaaccggagcaaccggggctactggagcaacaggcgccaccgggatcaccggagtaaccggagtaacaggcgctactggagcaacaggcgccaccgggatcaccggagcaggcgcgatcattccttacgcttcaggtcttcccactgccgtgacgaccattgccggcggattaatcggaacggtgagccttgtcgggttcggcaattctgtgacgggcgtcaatgtcggagggggaggtgcaattgatcttaccggggctggaggaactctgctgaactttgctttttctgctccgagaagcggaaccattacatcaattgccgcctatttcagtacaaccgcagcattgtcgcttgtcggctcgactgttacgataaccgcacaactatacagttctactgtgccgaacaatacgttcacgccgatccccggagcatccgtcactttagctcctcccctcaccggcgtattgtcaatcggcagcatcagcaacggaatcacgacagggctgaacattgcggtaactcctcaaacccggctgttaatggtattctctgccactgcgacaggcctttcgcttattaatacagtggcgggatatgcaagcgcgggggttacgatttcttaagtgagaacggccagactggtgcggatcatctaagctaagcttggagaagatatcattttttcttcaagcttttttgtttttacgtctttctgtaaaggctgacgggaatttcccgacagtcggcagaagtatttacatgccttttgaagttaatcagtatcttaatgaagacgttttcagtgagttcgaatcatccgttgtgccgggagtgtgaatcatcatcgaaacagcggtgccctcatccggggtgctggtgatcgtcaattcgcttccgcaaaaatgcttcagccgccgattgatatttttcaggccgacactgcgattaacatcagaagacaaaatatctttctgtatgtccggcatgatgccggttccattatcctccactttgataagatacgtgttttcgccttgttttttcgctgtcagctttatccgtccgccgcctcttttcttactgatcccgtgatgaacggcgttttccaccaatggctgtatcattaaaggcggaagggggaagtcaatgtcctgttcaatatcaaaaaggatatcaagccgtttgccgaagcgtgttttttctatagaaagatatgacgtaatgatagaaagttcgtttctgaatgagctgatgtccgaagtgttttgaaaatcaaaactcatccttaaatagtttgtaaatgcagcagtggtttcccttgctttttcaatatccaaatggctgagcgcgataatcgtatttaatacattgtaaagaaaatgaggcttaatctgcgactgaagaaatgccatttctaaatttgtggcttggtgagccgtatgcttcattaaaattaaatttttaatacgcgcggtgaattcagagtaatgataaggcttttgtaaaatgtcgtttgctccggcatgaaacgccttgtatttgtcatggctgataatggctgccgtaacgataagaaccggcagatcgaccatgctgaacctttcgcggatgtttgtgcagacttcaaaacccgtcatgtcaggcatcatcaagtctaatatgaccaagtcaagcttcgaggaagagacagcttgaagcgcctcttttccgctttttactgcgattacgttataaggaacaccttccagcatatcaattaaaattttcaaactctcgatattatcgtcgacaatcagaatcgtcggagcatcgattttctctgagtgataaggcgtgaccaacgaaatatccggtattctctgtccgggctgtgatttaggaagttcggtctttgcttccggtaaagaaacaatttgagcggcgggtaacgtaaaatgaaaggctgatccttgcgccgccgctgactccgcccagatgtccccgttttggagcttgacgagctgtttcacaatacttaaacctaaacccgttccatcttcttccttccctcccgcttgctgaaaagaatcaaaaatggtttcaagatcagcctcaggaatgccgctgccggaatcggtcacggttatttgaatcattttgtcattcaggtttgcggcggaaagaataatgttcccctcggatgtgtacttgattgcattttcaataagattggttaagatttgccggaatcggttttcatctgcaagcaccaaagggagatcgtccggcacatgattaagaatcgcgagttttttatgtttggataaaagccggtagaagttcatctcactgcatatgacggcatgcacatcgacgggaaccggacgaatctgcagcatcccctgcttcattttttccaaatcaagaatatcatttacgagatcggaaagtctgtagcccatacggatgatcagctgcatattttctttctcttcctctatcgtcttcttttttctgccggctacaagggtttggcatatattaataatgctgttcagcggcgtcttgaattcgtgtgaagttttggcgataaattcatctttcagttggtccattttgactaatttccgtgagaggacttcattgtcccggaaagctccggcgaattgctgcgccatcaggagaaccaccgccaataaagcgatgactgtcggcaatgaatagatcgaattaaaagaaaaagctgttttgccgctgtaagctgaaatggtcgtaagaatcacaaaagcgctcatcgagacggatgcgagtgtaaggtacgtgcttccttttatttttcttatggcggcaatcgtaaaaatatatgtaatataaaacagagtcgtaacggccagcacagaatgtaaaatgtatgagaggtgatcaatgaaacttccggacataaaatcagtgatcaagatgatcccggataaagcggttaaaatggtgatcgtcgtttttgaaacaatttctctgtatgcataaaagagataaagaaaaaccgccatgctgacaagcacggttgagatgatacgcaaggaattcagcaatgaaaatgaaatagacggaaagaggagaaagataattctttctttcccgatcataagaataatggctgaaaaaagcagacacatcacggaaaagaacaataaatgtttatcctttgtccgttgcagaaaaaagccgagaaaatataaaccggtaatgaaaaaagccgtaatcataatggaatcattaaaaaaggaaatttgattctcgcgtataatttgttcttgagtcccaaacgttatcggttttgcgatcccccagccgggaacttttccgaaattcgaaaaatgcaggacaagttcattgtcacccttgcgaagcctgaaaaagctgctgtacggtttgttctgcgccttaaaatcagctttttctgaaggattgccgctctgtccgattacttttccattaagataaaggcggtttgaactgtagatataagatgtgctgatccccaaaacctgattgtcttcatttgatcggattgtcagtttgtacgttccgtaatccacgtcggccgtttttccgaacagcttcacattgacagggacatcaacgagtacgggattttttccttttgctgaatgaagcgcctgcggtgacagcatctgatttggatatagaatccatttcccgttcagctggacatttccatccttttgaaaatcccaattttccagattgatcacgccctgttccgcttgagggagggatgatcctgaaaaatgatccatggccataaaaatcataaagaaagcagcatagccgcaaataatcgtaatcgaaataaatttttctttcacatcattactcctttatcccattcaggggcattctattatcctatttaatgtataaatattgtaatcacaaacgttataatacaacaagagaaagaaaaagaatccaactatatagggcattgggcatggtataattgaaattattttcagatatatctatattgacgggtgggatgcggtttgaaagcgttaattgtggatgatgaggaactggcattgcttcattttaatcgtatgcttgagcggacaaacgcctttcaatctattataacgtttcaagatccggcggaagttctggagcattcggaactttcagcagctgatgcggtgtttcttgacattgaaatgcccgggataaacggtattgagcttgctgaatcgattcaggaggtcaatgaaaatatccaagttatttttatcaccgcttataatgaattcgcgatcaaagcgtttgaattgaatgctgtcgattatctattaaaaccggttgacaatgcccggctgctgacaactgttgagcggatccgaatgaataaaaaactcaggtcggcggacgggaataccgggacggattatgttatacaatgttttgggaacctggacttttatcaatcggtaaatggtgtcaaaacatacataacagtcaagtggagaacatccaaagcccgtgaactgtatgcatttttacttcttaatcaagggcgcacggtcagtaaagacatgctaatggagatgttttggcctgcttatgatatatcaaaagcaagcacccagctctactcgacaatatatcagatacggaaattaatcggtaagctgcccttcagccaatcaatagaaaatactgatataggatacattctccggctttccggggtaaagattgatacagttgaatgggaaaaaacattcaaagaggctcctccgctcagcgcagctgcactaacccggcacatgaacatggtcatgtcatatgagaaccattatctcatggagaatggctatctgtgggcagagccggaaaaagcgcgtcttgcccatctgtggctcagcaaagcgtacgaactgattggttttctcatccaagagaagaacgatcgtcaagcgatggacgtttgcctgcaggttgagaaaatagagcccggtgacgataaaattatacaatacaaactgcagttatttaataaactgggaaaggtagaagaggcgataaaggaatacgaacgatataaacaattaaaagataaaatcaattgacgattgaatgaccggaccggctgatgccggtctttttttgtgcgctatttctgaaatgatcccatgtacagaatttgtataggccgatttcatacaatgtagtttggttcggataaggagaatcccatgcttaccggcttgttcgaacgtaagtctatataaaaggggaggaataagacattgggagtgaggaacttttcgttcagcccgaaaaaaagcaaaaggctgagggcggcattgatttcatgcttcacgctgtttttcatcttcagccaagttgtcagctttactccgatcgcagccgcttccggatcacaacatagcgagagcgggttctttgattcagttgcagtcaaagacggcagacagcagaccgttgacggatcaaaagccggtgaaccggctttaacaccgggagataaagtgacactgacatacgaatggtcactaaaacacaaagaagatgcaagtgaccggaatatcaccgtaaagattccggaaagttttacattagataatgatgccgaaggtgagctgaaatcagctgatcgggtgatcggtatatataaagctgaagcaaacagaagcacgctggaagtgaaagtgaacgatgctgaagcggatgccggggatgccaaaggctccattacactgtcggcgaagtttactcccgacataacagatgagacgaaaatggcaaaagctctttttcaactggatgccggcaagacccagcaagtgttaatacctgtgaagaaagacggaacaacggattccgatacagaaaaaaacacctcttcaacacctgctgaacctcaggataagacagagaaaaaatcagcatctgcagacggcggggataaagcagaacaggcaacgaaatcaaaaccttctgctaaacgcagtcaatcaaaaatggtgattacaagcaaatctgccgctaaaagccttcaatcaggcggaaaccggattacgcaaaatattttaactgatgtgaaattgacggatgaaaaaggaaaaccatatgacaaaaacaaccctgcgaatacgaactctccggcgaatatcaccatccaatgggcgattccgaatgagctggggaaaacaataaacgacggtgatcgatatgaatttgacctgcctaaagaatttattatgcataatgacattacgaaccagccattgaccgacggcgatagtacgtacggaactttttccattaatacgagcggccatgtcatcatgacgtttaacggcgaggtaaaagaagattctaacgtcaaggggtcattgtatgtaaacacccaattcaatcagaaagaaataaaaggatcaaccacacaaaagattaagtttccggttaactctgatacgccggacgtaacggtttattttaaaccgaatgtcaataaaaccattgagaaatcagggtcattggataaaggcattaatcccggaaaggtaacgtggacggttgaccttaataaaaaggaagaagaagttaaaaatgcgaaattgactgaaagccttccggacgaattgactttccgctctgtgaaagtgtatgaacttgatgtgaatattgacggctcggtgagtcagggaaatgagataacttcaggttataccgttggcgaaaacggtaatgtcaccttcgccgggacaattgattcagcctaccggctcatatatgacacggaaattaaagatgaggcaaagccgggtaaaggcggaaacatcacgctgacaaacaaggcggcattcagcggagacaatgcggagccgatttctgcggaagcttccgtaacagcgggttacggaaaaatgatagaaaaatcttcgacaggttataaaggagaaacccaaacgttcagctgggctgttatgtacaactacggtgagaaaaagattgatcaatccaaagccggcattaaggatacgttcggatcagacgatctgcatctagttcccggatcattgaaagtccttccgattacattcagccagaacggcagcgaacaagagggcgccccattaaaagagggtgatgattatacgctgactgataacgggaacggctttgaaataaaattcaagcaaactgtcacaggagcatataagatcatttatcaatctcaagtcaacgatggggtcattattgacagtcctgtcaaatacaccaatacagcaatgacagatacgggggactcaaaggaaactccgggaaccgccattcagcagaatctgatcaaacattattcaaacgcagactatgagaagaagacggttgattggacaatcacagttaacaaaaacggttacacaatgaaagactggacgctggatgatcaattcaccagcggaggcctggcgctcattgacgattcatttaacatgcaagacacgactgaaaacaaaacgctgaaagaaggaacggattatacattaacaaaaaaacccggaaatcaaggctttacaatagcattgatcggggactacgcagaaacaaacagtcagtttaagatcacgtataagacaaaattcaacgctgacttttcaaacgaaacgattaaaaatacggcggagtcgacatggaccgataaaaacggcaacaaacgcacaaataaggaatcgagcggcttcacaccgaacaatcagacgtcccataacggattcaaaaacggctcatacaacgccgtttcaaaagaaatcacatggaaagtcggcatcaattacaatggcgaaccttcaaaacatccttatataaaagatacgatcacagatggtcagcaatttttgcatgggtcggttgctgttaaaacgtataccatcagcaaaaacggctccatcactgaaggagaggcgctggatccttcaaaatatgaaatagaagagccgtcagacggcaacaaaaatacgttaaccgtacatctcaaaacagatgacgctgtaccatacctgattgaatttaaaacgtcattaaaaggccaggtcattaaacagaatcaatacacaaacaaagcagagtactttaataatgaccatgcagaccgaacgctgacgggttcagtttccgtcgcaaacggaggaaacctgatttctaaaggcggcaaacagaacggaaacaatatcgattggaacatcaatgtcaatgccagccaatcgacactggatgacgtaaaagtcaaagacacaccggatgagaatcaaataatagatgaagattcttttaaagtatatcaagcaaaatataatgagaacggcgttatgaaagacagcagcggaaatcttattccgggtgatgtgcagcttgagaaagataaggactataaattagatatgaaaactgacaatgccaccggtgaacaatcatttgcccttacctttacaggcggctataaacaaatcgaccgtgcgtatgtcatacaatatcgttctctcattaatatttccggcagcagcggtcaggtcaacaacaaagtgtcgatatcagggacgaatgttgaggagcagacccaagagaacaacagctcagtgtttgtcgctatttcaagcggcggcggctcagggtcaggggagaagggaagcctgacgatatctaaaacaggatcagacggaacatctctttcaggagcagactttcaattatggtctaaagacggcaagcagctgctgcgtacgggcacaacagacgatgccggtaaacttacgtttgggaatatccgttacggaacctatgtactgaaagaaataaaagcgccggacggctacaccatcagcgatgcttatgtaaacggggtctccgttacgattgacggcaaatcctccgcagcaggagcactctataaagtcataaatcaaaaaaataaggtgacgcttatcaaaaaagacgaaaacaataatcctttggccggtgctgtatttaagcttgagaaaaaatcaagcgacggtacctatactctgataaaaaataatattgaaagcgataaaaatgggaaagttgagatcaacggtttgcccgccggatactaccggctgatggagacgaaagccccatcagggtttatcgtaaacacaaaagccattcacttctcaatcgcaaagaacgaaaagaatcaagtacctgatgttgaattgggatcaatggtgaattataaaggaaaagccgctttaacgaagaaagatgcagacggcgggaaccttgaaggcgcagttttcaaaatcgtcgatagtgatggaaaaatagttcaggacgatctggtttcagataaggacggaaaagtagaaacatccggccttgccccgggtcattacgccttcatcgaaacgaaagcgcctgacggctatgtgttaaatacggagaaagtggagtttaccatctcagaaacagcggaaggaaagccggagtcaactgacgcaggaacggccgtcaactataaaggctctgtgttgctgacgaaggaagatgcggaaggccgaaaccttgaaggtgcagttttcaaaatcgtcgatagtgatggaaaaatagttcaggacgatctggtttcagataaggacggaaaagtagaaacatccggccttgccccgggtcattacgccttcatcgaaacgaaagcgcctgacggctatgtgttaaatacgaagaaagtggagtttaccatctcagaaacagcggaaggaaagccggagtcaactgacgcaggaacggccgtcaactataaaggctctgtccggctgacgaaggaagatgcggaaggccgaaaccttgaaggtgcagtcttcaaaatcgtcgaccgtgatggaaaaacggttcaggacgatctggtttcagataaagacggaaaagtagaaacatccggccttgcacccggtcattacgcattcattgaaacgaaagcgcctgacggttatgtgttaaatacggagaaaaaagagtttaccatctcagaaacagcggaaggaaagccgaagccgtctgagaccggcacctttgtcaactataaaggctctgtccagctggttaagaaggatcaagacggaaacgttttagacggtgcagtatttaaaatcattgacagtgatggaaaaaccgtaagagaagatctgatgacaaaagaaggcggcaaaattgacgccggcggtttggcgcccggaaactatcaatttgttgaaacaaaagcgccggatggttatctgctgtcaacaacccctgtgcggtttacgattaaggctgagaacagcggaaaaccggatcaggctgccctgactgcagttaacatcaagaacagtgttgttcttacaaaattggatcaaggtgacaaacggaaagtcctgcaaggtgcgaagtttaatctgacagatgcaaacggcaaagtgctgagagaaggtctgacgacagatgagcacggacagattgttgtacggggactgaaagcaggcgaatatcaatttatcgaaacaaaagcgcctgaactttacagtttggatcaaacgccaatttcattcaagatcacaaataccgacataaaaccagtcgaaatcagtgcggagaatacactgacgccgggtgatgtaacactgacaaaagtggatcatgacgataaaaataaggtgctggaaggtgctgaattcaagataacggattctgccggacatccggtaaacaccggcggcagcaaagaacggccggcggtatggaagacggatcaaaagggccggtttacggtgaaaggattagcgcccgggcagtatcgatttatcgaaacaaaagcgcctgacggctatcagctgaacgaaaaaccaattgaattcacaattgaaaaaggacaatcaaaagctgttgaggtcgtcgtttctaataagaaattaaaaaatcccgcacctgggaaagacacaccgaatcatcaaacgaatcaaggcgggcatcaccctgataccaatagtaaaaccaatcacccggatacaggcaaaaatctgccgaaaaccggtgatacggacggtatgatgccggtcacggccggtattctgctgctattagccggcggagccgcggctgttgtatcaagaaagaagaaagcaaggaatagatagacgtaatcgcacctgatcatgtaagaatcgatcaggtgcttttttaaaaagagaatcatttctcaccaaatactcaccgcatgacgtacaagaaaggaattttcttcatggttaaaaaaatgatcattgccgttcttattttgtccgggctgcttctcatttcctctcctctcatgaaaggctgtttgattgcgtacctcagtaaaagccaaattgaatcggaattgaccgcagaacaagcgcggaaaaataacatgaaaaaagcggactatgaatttgaatccattcatccgcccggtttcagggaaacagttcagtcaagttttaatcgcaaaccgaaaccgataatcggacggataaccatcagcagcatcgatttagaccttccgattttaaaaggcacaaccaatgaaaacctgctgatcggcgcggcaactatgcgtccggatcagaaaatgggcgagggaaactacccgttggcaggccaccatctgaagcaggagaacctattgttcggccctcttttacacataaaaaaaggtgcgcaaatcgtgattaccgactttagaaaagactatatttattctgtaacatcaaaaaccatgatttcagaaatagaagcaaacgcaattcaggagacaaaagataaagagattacattaatcacatgcgacaaggcggtaagaaccgaaggacgcctggccgtcaaaggaaaattgattgatatttccggtcattcaaatgtatctcagccatcatagagaaacactttgtcaactgaatatacgtccgttgtgaaacatcccgagactggctcctgtcagtctttttttgcgcagcgattataaaaagttcatccttcttatctctcttgagggaaattataccagactgcactttttgaaagaaatgacaagagaaaaagatcgcgaaaattctcaaaaatgagaaatgaagatttaaaaaatggtatgattttaggaggaaaggacggctggtgctgtgttggaagcgaagcggttttatgtctctctgcaaatgaaaatcgccggattaattacggctttattaatacttgtcatcggaacgctcacggttatatttgcctttcagcaattaaaggaagggcagaagcaggctgaacagctggcggtgcaaacggcaaaaaccatttcatatatgcctcccgtaaaagaggcgttccggcttgcggatcaagaggcttttacaaagttagacgtcattgaacaaatgaaagaacaggcaggcgcgcacgccgtctacatcactgatcaaaaagggcatgttgcatttcattcggcccgaagcagtattccgaaagaaaatcaaaatctgcaaaataaaaccgtcatgttcggcgggtctccggtttccgacggaatgaaggccgtccggggaagcgccccggttattttggaggaaaaaaatcataacgaagtcgtcggaacggtgacagtcgaatttctacaagatgagatagaaaaagatatgaaggcgcatttgcggcatttaggctattttgcatgtttggtgtttcttatcggcatcgggggagcggcggcgctcgcaaaaagcatccgtaaagatacactcggccttgaaccgcatgaaattgcagcgctgtacagggaacgcaatgcgatgctccttgcgatgaaagaagggattatcgccgtaaacaaagaaggcgcggtaaccatgatgaatttatctgcggctgatatgctgaatcttccggaaccgatgatcggaaggcatataaaagaaatcatgccgggcgcaaagctcatgccggtgttggcagggggagaattaccgccgaacgtggaggtgcgtgccggagataaagtatttatcttaaacgtgaaagaaatgaagcagaacggacaagtatacggagcggtgatcagcttccgcgaaaaaacggagctcaagaaactgattaacaagctgactgaaatgaaaaaatactcggaggatctccgggcgcaaacgcatgaattctcgaataagctttacgcgatactcggtctgttagagctgggagaatataatgaagccattgaactgataaaagaagagtacgccatccagaatgaacagcacgaaatcctctttcaaaacattcattcacagcgggttcaggccatactattaggaaaaatgggaaaggcgtctgagaagaaagtgaagctttcaatagatgaaaacagctttttagaatcgctgccggagcatgtgggttcatcccagctcattacgatcatcggaaatcttattgataacgctttcgaagccgtcgccgaaaaagagaaaaaagaggtatccttttttatgaccgatatcggcagggatatcgtcatcgaagtggcggattcaggagacggcgtgcctcaggaaaaaacagaaacgatatttgaaaagggctactcttcaaaggggacaaggagaggatacggcttagccaatctgaaagaagccgtcagtgagttgcagggagcgattgagatttcgcagcaaaagagcggcggtgccgtatttacggtgtttataccgaaagaaaggccaaagggggaatcggtgtgattaacatcgcgattgcagaggacgactttcgaatagcgcaaattcacgaaaaatttatcgaacatcttgatggattcaatgtcatcggcaaagcaatcaatgccaaagacaccatatcgctgcttgagaaacggcagcctgatctgctgctattggatatttatatgccggatgagctgggaacagatctgctcccgcttatccgcggccgttttccttccgttgatatcatcattattacggcttctgccgaaacaaggctgctgcaggaagcgctcagatcaggcgttgcccattatgtcataaaaccggtgtcggcacataaatttacagaagtgcttttgcagtaccgtgaaaaaagagaatggctgcactcacagccggagctgagccagtccgtgattgacatgtttttcggaagcggtcagaaagaacaaaaacagcacaatgatctgccgaccgggattaattcgattacgcttcaaaaaatcaaaaacgcgctcagaacggcccaaaaagggatgacggctgaagaactgggagaaaaaatgggtgcctccagaacaacggcgcggcgctacgccgagtttctcgtttctcgggaagaagcgctcgctgaattagagtacggcattatcggcaggccggaacggaaatattatttagcacatgagtaagggatgggagaaatgaagcggttgggagtgcttcttgtcatgctggcggcgctggtttcttttgacggacggcaggcggcgggcatccgttcagctgaagggccggttgaaatagtcgtcccggcagcgcctcaaggggctgggacgtaacggcaaaagctttgcaatcggtaatagagcggaagcaaatattaggccggcccgtaaagatcatctataaacccggaggaggcggagacagcggctggaaatatgtaaacgaacgaaaaacggatgtcatcagtatgaattcaagtctgctgttaagcaatgaaattttgggacaaagccggctgaaggcagctgattttacgcctttggccattatcgcaaaagagtggcagaccgtcgctcttccgaaggattcaaagataaaaagcggaaagcggctgctcggcgatattaaagcaaatccgggcggcataaaaatcggatttgcgcccggcctcggaaatgatgaccagctctcctttgcgagagcggcggaaatggccggaatttctccgtttgatatccgcttttttcaatacggaagcagcaatgaagtcattgaagctcttatcagtcacgagatagacgccgcctcaatgaccatttcagaagcgagagacgcctatcggaaagggaaaatcacattggcggccgttacgtctgacaaaaggctctccggcttcagcgatgtgccgacatggaaagagcagggggtgccgtttgtctttgcgcactggagaggcatcatggggccgaaagacatgaccgaaggcgagatcgcctattgggatcaggctttgaaacagattacttcatccgcggagtggaagcaaatgttgaaaaaacgggattgggagagcttttataaaaacagcagcggcgcaaaacgctttttagaagagcagaccgagttttataaagagatgatgagcagcgaaaaataagccttccgcatatttgcggaaggcttttgatttataaatgaacaaaatgaacgaaaaggttataaaaaattaaaaatctttaaaatccaaaatatttacttcaatatccaattctcataagatagcaaaaaggcggataaaggggatcgggcctttaaaatgtaagcgtattcatgatgagggggacatactgtgttagcaatcttaggctttcttatgatgcttgtttttatggtgctgattatgacaaaacggctttcagtgttaacggcgctcgtattaacgccgatcgtgtttgcgctgattgccgggttttcttttaaccgggtcggcgagatgatgatctccggtattgaacaggtggcgccgatcgcagtgatgattatgtttgcgattctttatttcggcattatgattgataccggtttatttgatccgatggtgtcgcgtattttaaagctggttaaaggcgacccgctcaaaattgtagtcggaacagccgttttgaccatgcttgtcgcactggacggagacggctcgacgacgtatatgattacgacaagcgcaatgctgcctttgtatatcatgctcggaatccgtccgattattttagcgggaatcgccggggtcggcatgggtatcatgaacacgattccatggggcggcgcggcgccgcgtgcggcgagtgcgctcggcgttgatccggcagagctgacggggccgatgctgcctgtcatcgcgagcggaatggtgtgtatgattgtggtcgcttatgtactcggaaggatggaaaggaaacggctcggggtgatcgaattaaagcagccgtcccatacaaatgaaacggctgcggctgcggaagatgaatggaagcggccgaaactgtggtggttcaatttactgttaacgctttctttagtgggatttttagtgtcaggaaaagtgaatttaaccgtgctgttcatcattgcgttttgtatcgcgctgattgtcaactatccgaaacttaatgatcaaagggagcgcatttcagcccattcgagcaatgtgcttgcgatcggttcgatgatttttgccgcaggcgtgtttaccggaattttaacggggacgaagatggttgatgaaatggccatttccctcgtatcgcttattccggaacagatgggaggttttattccggcgattgttgccttaacgagcggtatctttacgtttctgatgcctaatgacgcctatttttacggcgtgctgcccattttatctgagactgccgtggcgtacggtgtagataaggtggaaatcgcccgcgcttcgattatcggccagccgattcatatgttaagcccgctcgtgccgtcgacgcatttattagtcgggcttgccggggtcaccattgatgaacatcagaaatttgcgatgaaatgggcggttcttgccgttatcgtcatgacggcctttgcgctcatcatcggcgcaatcacgattttttaacataaaacacccggttcgtcgcacactaaaggcatcagaggaggtgccatgatgagtgatccgtttatgccgcttttttcagtgagaagcggcgccggttttaaagcggcggacggcgtttacggactgaccgtgcagattgcgaatgtttactttatcgaaaatccctcagctccgcgggaaatcattctggttgacgcgggaatgcctcaatcgtcggagatgattacaaatgaaatgaaacgccggttcaaagaggggtatgagctgaaggcggtcattttgacacacggtcattttgatcatgtcggtgcgattgaagaactgcttgagctttggaatgtgccggtttacattcatgaaaaggagcttccgtacgtcacggggaaagcggattatccgcctgccaggcccgatgcgaaaaaagggcttgtcgcaaagctgtcaccgctgtttccgcgccatacgatccgcattccgtccgttcaggcactgccttcagacggtaccgttccgtttcttgaagaatggaaatgggtgcatacgcccggtcacacacccggccatatttcattattccgggataaagaccgcgtgctgcttgccggtgatgccgtgatcactgttgaacaggaatcgcttgcggacgttgtcattcaaaagcaagagcttcacggtccgcccgcctattttacagcggatacgcagacggcggccgcatccgttcagaaattggcggaactggagccggaagcgcttttgacgggtcacggaattccgatgacgggaaaaaactaccgtgaggatttgcttacactggctgaaaaactgcattccgttttgtaaaacacctgcgaaaatcacaggtgttttttcttcgcagtttccagtatgatacaaaaaaaccattgtgttcacacctaaaaacgatacaatgggaaacagatgtaaattgaaggagagagttttttgaaacatacggaaatactttgggatgaggcgaaggattttattgatgtctgctatcacgaactcggaatggaatcgcaaatcaacgcgcgactgcacgcgataaaagatgagatagatcggacgggaagttacgtccatacggcggaagagcttgaacacggggcgaaaatggcgtggcgcaacagcaaccgctgtatcgggcgtctgttctggcaatcgctgaacgtcattgaccggcgcaatgtgaacacgaaagaagaggtgcgtgacgcattatttgaacatattgaaatcgccacgaacggcggaaaaattaaaccgacgattacgattttccctcctgagaagaacggggagaaacaagtggaaatctggaatcaccagctcatccgctatgcgggatatgagactgaaaaaggaagagtcggtgatccggcatcatatgagctgacggctgtctgcgaaaaactcggctggcgcgggaagcggaccgaatttgatattctgccgctgcttttccggatgaaaggggacgggcagccggtctggtatgacctgcctcagacgctcgtgaaagaagtgccgatcacccatccggatattgaagagtttgccgatttaaatctcaggtggtacggggttccgattatcgccgatatgaggcttgaaatcggcggactgtcgtacaacgcggcgccttttaacggatggtatatgggaactgaaatcggcgcaaggaaccttgctgacgaaaagcggtatgatatgctcaaaaaagccgcttcggtcatggggatttccgccagcctgaataccgacctgtggaaagatcaggtgctggtggaactgaataaggcagtgctctattcatacaaaaaacacggtgtcagcattgtcgatcaccatacggccgcgaatcaatttaaacgctttgaagaacaggaacaagacgcgggcagaaagctgacgggcgactggacctggctgattccgccgatctcgccggcttccacccacattttccataaatcatatgacaatacgattgtgaagccgaattatttttatcaggacaagccttatcagtaactgatggaaaaggtgcggtaccctttcagacggtgtgattcttcgatggttacgtttgtgacatttgagaaggggctgccttttctgaccgcttcggcaaattgttttaacgactcttcagggccttcggcaaggatttccacccggccgtcatcacggttttttacccagccggctatcttatgtctgtcggcttccatctggacgaagtagcgaaaacctacgccctgaacccggccgtctgcaatcatatgatactgaagcatggaaaaaccacctttttcttactatgataaaggaaaggtaggatatttcgcaaaggatgtgaacgagatgacgcaagactattctgtcttatctatcaatctcggaaagcccgcaattcatgaatttgccggcagacaaatcaattcaggcatcatcaagcggcccgcagattctcccgtcatgctgtataaaacccattttgacggggacgggcaggctgatctgaagcatcacggaggtcccgataaagcggtgtgcgtgtatcccgccgagcattattcatattgggaaacaacgctcgcgagaaaacttcccgccgccgcgttcggagagaatgtaacggtcaaaggactggccgaacaagacgtgtggatcggcgacatctttcagctgggtgaagccgtcgttcaagtaagccagccgcgccagccctgcgtcaaactcgcgctcaaatatggcatcaaagatatggtgctccgtgtacagcagacgggatttaccggcttttatttcagggtgcttgaagaaggatatgtcgatccgcgtcccgtcctcaagcgtctgtcgagaggcaaagaaagcatttccgtctggtatgcgaacgaagtgaaataccgtgattcagacaatctgtcagcgattgaagaaatactgcgggaagaagcgctgtcagaaagctggagggagtccttccttaaaaaaagggacaggctcactaatgtatagaaaaaaagccgtgctgcactgacagcacggctgatttacgttatgcttgtttctttgtttccagcagattggcaaggaagtactttttgaagctttgaagctttcttccttcatagtgggtaattccttttttctttaactcttctacataccagcctttactgccataatgcatgtcagaaaactcctttctccgttctcccgctggggaggtttcttcagtttttgccaaacttttggcattgtaacatctataaaaagacgctgaaaagggataatgcaaaaactgagcctttcgattcagagatgtaaagctttcttacatatatatgtaaagggcggtcttttcatgcttaatggccggttaattttaacagcaccgttccgagtgtcatgattccgaaaacgacgccgaaataaatcagcatccccttctttttcttcaccccgtaaacggtgagaatgatgctttcaataaagaaaataaacccgaagataataaaccacatgttgaaaaatggctcctttcacagacatatgtccagtgtagcacaactcttataacggagcataaaaaagccgggcactgtatcagtgtccggcaagtttgacgagaagctgggccaaatgctgtttttcattatcatccgcgatgtcccacagttcttgtaagagtttttcttccgcattgcggggctcctcgtgtttggcgagatagtccccgaggatggcggcgcttttgatgattttgctgtcatccagacccagtttttttccggcggaaattttctgatgaaggtacgccttaaattcctcgaaatcctctaaaatctgctgtttcgttacgccgtgcatggcgtgtatttcgttttcaattttgattttttctttatcttttttcatgcgtctccctccttcgggttagttgttgtatacctgttcgggagggagatgaaacattacaatgcagttaaaataatcggtttgtcttttgtaatcacgatggtgtgttccacttgggcgacaaggcttttatccggcgttttatatgtccagccgtctcccgcttcaacaatcgtttccgctttcgtggaaataaacggctcaagcgcgatcacggttccgtttttaaacagcgcgttatcaaacggatcgtagtaattcatgatgtggttcggcgcttcatggaggtttctgccgattccgtggcccgtcagcgttttaatgacggtaaatccgttggagcgggcttcatggtagacggctctgccgatctggttttgacgtttgccggcttttgcctgatccaatcctttctgaaatgcggatgccgcgcagttacaaagcttttgcagacgttcatcgccttctccgagcacaaatgaaatgcccgtatcggaataaaaaccgccgaactccgccgaaatatcgatattgacaagatctccggcttttaagattttagaggcgctcggaatgccgtgagcgacttcgtcatttacgctgatgcatgtcacgcccgggaaatcgtattccttctccggagcggaagcggctccgtgctcgtcaagcaccgcctttccgatcaggtcaagatctttcgtgctcatgccgggctcggcttttttcttcatttcttcacgcgccagcgcgacgattctgccgatttttttaaggccttctaattcttgatcgttcgttacaatcattgtcattcccgctttctatttttaatcatctgattcaagcttaccacaactggtttataaatagaaaaccaacaagccttatgtgaataaatgaaggaaaattggtatagatcactagataacttatgtggtatatttaagaaaaaagaagggggatgggtaaaatgcttcaatttttgcaaaaactcggaaagtcttttatgcttccgattgccgttctgcccgccgttggtattattttggccatcggcagagaggacttattaaatattccgttcatttacgcggcggggaccgcggtatttgatcatctgccgctgattttcgcgatcggaatcgcgatcgggatttcgaaagacagcaacggggccgccgctctgtcgggagccatttcttatatcatgctggacgcggctgtaaaatcaatcaattcgacaaataatatggccgttttcggagggattatcgcggggttaattgcgggatacacgtataatcgctttaaggatacgaagctgcccgaatatctcgggtttttcagcgggcgcaggctcgttccgattgtaacggcgctgattaccattattttggcgggtatcttcggatttgtgtggccgccgattcagtcggtgattacgtccttcggggaatggatgatcgggcttggcgggatcggcgcggggatttacgggatttttaatcggcttttgattccattcggtcttcatcatgtgttgaataatattttttggttccagtttggcgattttcacggaaaaacgggagatctggcccgcttctttgcgaaggatccgacggcggggacttatatgacgggattcttcccgattatgatgttcgggcttccggccgcttgtctggcaatgattgccgcggctaagccaagtaagcgcaaagcgacggccggaatgatgatcggtctcgcgctgacggcatttattaccggaattacagagccgattgaatttgcatttatgtttttatcaccgcttttgtacggggttcatgctatattaaccgggttctctttatttatcgtgaatgttctcggaatcaggtcaggtttttcattctcggcgggggcgatcgattatctcctcagctacggcattgccgaaaaaccgcttttgctgctcgttgtcgggctttgttatgcggtgatctattttgccgtcttttatatgctcatcaaaacgttaaacttgaaaacgccgggacgggaagatgatgaggaagaggaagaagtgcttagtgaagatacggccggttccgtcgaagaacatgccatgctcaaggggctcggcggcaggcaaaatctcgaaacgattgatcactgtgcgacccgcctcaggctgaccgtgcaggatacgtctctcattaatgaggcggcgcttaaaaaagcgggagcaaaaggggttatcaaaacggggaataaaacggcgcaggtcattatcgggccgaacgtcgaatttgtcgcggaagagctgagagaggccgtccgccttgacgatcagaagcagacttgaaaaatccggatcacctatgtgatccggattttttttgaacatatatcaagtttcacataatgtacaaaaaacaatgtttccttctatgttaagattcatgtagaacaagtatggagatgatgtaaggtgacatggattgcagttgtttcaattgttgtcataagcctgattaagattgtgctgacatgccttcctaccggagcggtggaatggatcctccgcaagtttgaaacccattcaaagctcagtgacgagtccgctgccgtttccctcgggggaaaacgtctggaaggcgaagacaaacgacgggtgattgatgattttaacgaagccgtgtttatcgaacggcattatatatacccagggatgaagagcgttatcttcatccgcaaaacggagccgatccgcttgtcattaagacgagaaaaggaaaaaaagatgtgacggtgtttgtatacagctacgaagatcatgtagatgtcgtcaagcagcagaaaaagaaagtaatcgcttattcagttctttccgacagcctgcaaaagcgcactatggccgccgccgggagctgaacataaaaaagccagatcatatcaatgatctggcttttgtttattctttttgatcgtctgctgaggaatcttcacgcttcgtataatcgaattgtgacggatccactttcttgaagcctttcggctgatagaaacgaagcagatcgccgttgatgatcttatcagacatttcaagctcagtcttgacgagagagtcttcttttttgtcgacttctgaatcatctaaaagtcttccggttttcgtatcgtaatacttgccggacactttcgtatagttcggcgagatgaagtctccgttacggaacggaatgacttctctgtgctctttcgataagatatcagaacctgacatgagataatctttcgtatcgacgccgagcagatgaagaacggtcggcgcgacatcgacttcaccggcaaatttatgattgcggccgcctttcacgccgggagcgtggataaagagcggcacccgctgaagctgggcattgtcgtattcagtgatctcatctttgccgagcactttcgccatcgctttattatggttttcggagatgccgtagtggtctccgtacatcacgataatcgacttatcgtacaggccgtcttttttcaggtcattaaagaactgttcaattgattcatccagatagttcgcggactggaagtaattattgacgactgaatcgccaaagtctcccgccgggaagtccgtgtcttctttatccattccgaacgggaagtggttggacagcgtaatgaacttcgtatagaacggctgcggcaggctctttaagagcggcatggattctttgaaatacggtttgtctttcatgccgtagtttttcgtattttcttcgctcatgtcataataagcggaatcgaaaaacttatcgatgccttccgatttgtacatttcgttacggttccagaaagtctgcgtatttccgtggaaagcggcagacgtgtactttttgccttttaagatcgcaggaacggactgcagcgtgttttgcgctttattgacgaaaaccgaaccttgcgaaagcgggtacagagagttctccatcataaattccgcatcagatgttttaccttgtcccgtttggtggaaaaagttatcaaagtagaatgtttgattatcgtgcgccagtttgtttaaaaacggcgtcacttccttgccgttaattttgtaatcaatgataaaggactgcagagactctaatgagacgtagatgacgttttttccttcggcttttccgaagtagacgttattcggcacgtcatagttggccttcatatagttttccacatccgttacatcgcttgaatcggcaagcgcgcgctggctgtttgatttcacattctgcacggcatcgtaaatcgtaaagttgtacgtgcccaagtatttcaccagatagtttcggtcaaatgagcgtgtcaaaagctcgggacggtcggattccgcgacggcgaggttgatcaggaacacaagcacggcggaagccaaaacgattctgaatgatttcttcgccggtttttcagccggttttttcatcttaagggccaaaataatcaaaatgacggtatccaggaagtagaaggcgtctgtccatctcattaacgagaacgcgctgtctccgagctggccgccgtttgtctttgcctgcatcatgaccgggatggtaatgaaatcattaaagaatctataatagacgatgtttgcaaaaagcaaaaaagacaataaaaaatgaatcacaataatggctgtctgctgtaatttcttcttgaaaagaagcccaaatccaagaaagaacaagctggagctcagcggattcacaaaaagcaatattttctggatcgtgttgtctatgccgaggttaaagtttaaaatataagcgacatatgttttcacccacaataacacgaccgctatcaagaagaaggcaagtcctctttcttttataaatgttttcattgttacactccttttttccgatcacggtttacacggaacgatagaaaaaacgaacgtaatcaatataccatgaaaccagcaaatagaaaaggtggaaaaggctcatcggaaaaagggcgaaaaacgctgtcgcagcggcggttgatctgttgaatgacagctttaaaaaacacaaatggcacaaactgggatgtgaatttccgtatgatcacacccgattctattgaagaaagaggtaaacagtgatggatattgcgcatatcgtggctgaagataaaatcaagcgcgccattaaggatggagagttcgccggcatcaatggaatgggaaagcccctgccgaaagacgatgccgcacatcttccggagtcgctcagaatgggctaccgcatattaaaaaacgccgggatcgccgaggatgagggcgcgctgaagaaagagctgatgacgctcgattatttgatcgccaagtgccgcaatgaacaggagcgggatcacctgcggaacaaacggacggaaaaacaagtcagactcgacaaactgacggaggagaaagccatgttctcaaaacccgcatcttctcattataaggagaaagtgtacagacggctgggccgcccgtaagccggctctttatatttttttctgaaaaggaatgtgctccataaggcgcgggtaggaaatgtggagcaggccgtttacgcactgcgcctgtaacaggtggggctcagccggttcaggaagctcaatcgtctcatcgatttccccgtaataccggttttggcagacgcccatgttcttcggaaaaaggggtgtgatgtttcctcttatatgcagccgtgttcttgacagcagcctcaatgtcaattcttcttcgtaaacgccgggcatttccacaatgacaaatgtgtgctgttcatcctgataaatatcataagtcagggtgtttttttgtaaggagaaaaaatcttcgggagatttccgtttcaggacattggtccaaaagtcgctgggcttgtgctcgttcgtaatctcaagccactttctcattttttcgatatccacttcggcagaacctccctatatttgatttgcgatcggcattgacgggttggcgatctgatcctgatcgctcacgtcagggtcaagatggcccgaattcaaacatccggcggccggcgaaaaatcccctaaagaaaagttcgcgccgacaaatttgctgttggcggtgtggctgttttgtacggtctgaccgatatcgacgtttccgttttgcgttgctccgtttacttttatattgacgacgttaatttggtaaggcattcataaaaacccctttaatctataatgggcggcaccggcgtaatatttgcggtatctgcggttccgatggctgtctggtcgttgacatcaggatcatttaacaagttctccatcatcgattctataggtgacgtatcgccgaatgaagagttcagtccttgtgatttgttatttgtggtgggactgttgtatgccgcttccccaatcgtaatagatccgttgccagaaatactgttaatcttcaaatagtacaggttgataacagtggatggcatctcttcacacctctttaacttagttgtacagtactgtatgctttttgtgctcctgttgtgaattccgcccggacatgttcccgaccaaacaagaagtcaaggcccggttccggcggggctttttttgtttcagggtctttcgcagtatatttgtgatgaaagcgctataaaaatagattgacgacatgtatatacatcattacaatagagtcataaacatgtatatacaagttttttgagacaaaatgaaaacggttacggaggggttggcatgggtgagtttaaccgggctgcgcggcagatcgctgaagctgtcggcggaatcgaaaatattgaggcggcgactcattgtgtgacgcgtttgcggtttgcattaatagatgaaaccaaggtaaaccaaaaaatgcttgatgcaatagacattgtcaaaggatcttttgcggtaaacgggcagtttcaagtcgtgatcgggcaggggacggtcaacaaagtatatgcggaattagtgaaggaaacggggatcggggaagcgtccaaggatgacgtgaagaaggcggcatcgcaaaaaatgaatcctttacagcgtgctatgaaaacgcttgcggacatctttattccgatcttgccggcgatcgtcacggccgggcttttaatgggtctgaacaatatcttaacggcggaaggcattttttacagcacgaaatcgattgttcaagtgtatccgcaatgggcggatcttgccaatatgattaatctgatcgcggggacggccttcgcttttctgccggctttaatcggctggtcggcagtgaagcggttcggaggaagcccgcttttgggcatcgtgctcgggctgatgctggtgcatcctgatctgttaaacgcatggggatacggggccgccgagcagagcggcgatattccggtgtggaacttgttcggccttgaggtgcagaaagtcgggtatcaaggtcaggtgctcccgattctgctggcgtcttatttacttgccaggcttgagctctttttgacgaaacggacgccggagggcattcagctgttggtcgtcgcgccggtgacgcttttggtcatcggttttctatcctttgttatcatcggtccgatcacctttgcgatcggtaacgcgctgacggcgggattgattgccgttttcggccaattctccgccatcggaggcctgctgtacggagggctgtattcggcgcttgtcatcacggggatgcatcatacgtttctcgcggtcgatcttcaattaatcggatcaaagctcggcggcacatttttatggccgatgctcgcattatcaaatatcgctcaaggatcggcggctctggccatgatgctcattacaaaagataaaaaacagcgggggctttcactgacggccggcatttccgcatatttgggcattaccgagccggcgattttcggcgtgaatctgcgttacaaatttccgtttgtgatcgccatgatcagctcggggattgcggggatgttcatctccgtcaaaggcgttctcgcaagctcggtcggagtcggcggcgtcccggggatcttctccattatgagccggtactggggtccgtttgcgatcggaatgctgatcgtgctgatactcccgtttgcgggaacatacgggtatgcgcggctgaaacggcaaaaatagaaaacctgcggggcgccttctaacaggctgtcccttttccctttccattcaaaacaatacaggcggtgaagaaaaatgaaaacagacagcacaccatggtggaaaaaggcagcggtatatcaaatttatccgaagagctttaatgatacgacgggaaacgggatcggtgatctgaacggtattatcgagaagcttgattatttgcagaagcttttgattgatgtcatttggcttacgccgatttacgattcgccgcagaatgacaacggttatgacattcgcgattactgcaccatttatgaagaatacggaacgatggaggattttgaacgccttctcgatgaagcgcacaaaagaggaataaaggtcgtcatggatcttgtcgtaaaccatacatcagtcgagcatcagtggttcaaagaagcggtttcgtcacccgacagtccgtatcgggatttttacatttggaaagacggcaaggaagacggccgggcgccgaacaactgggaatcaaaattcggcggttccgcttgggagctcgatccggcctcaggccagcactatctgcatttattcgatgtgtcgcaggccgatttgaactgggaaaatgaagagatgagaaaacaggtttacgacatgatgcatttttggttccgaaaagggatcgacggcttccggctggatgtgatcaacctcatttctaaagaccaatcgtttcctgatgccgaggatggtcgtgacgggcgcccttattatacggacgggccgcgcgtgcacgaatttcttcatgagatgaaccgggaagtgttttcgaaatatgacagcatgacggtcggtgaaatgtcctcgacaacggctgaccactgcatccggtacacaaaccctgaaaataaagaactcgatatgacctttaactttcatcatttaaaagtggattatccgaatggtgaaaaatgggcgctcgctccgtttgattttctgaagctgaaacggattttagcgttttggcagacggagatgcaaaacggcggaggctggaacgcattattctggtgcaaccatgaccagccgcgggccgtatccagatacggagacgatggcgtataccggacgaaatcagccaaaatgctggcggcggccattcatatgatgcagggcacgccttacatttatcaaggtgaggagatcggcatgggcaatccgaagttcgatgacatcggctcataccgcgatgtcgaatcactgaacatttacaaaaagatgaaggaagaaggcgtgtcagaaaaagacattatcgccattttaaaagagaaatcaagagacaatgcaagaacccccgttcaatggaacagcgggccgaacggcggcttcacgacgggaacgccttggattccggcggcggatgattatcgggacattaacgcggaagcggctttgcgggacccggattcaattttctaccattatcagaagctcatcaagctcagaaaggaatatgacatcgtgactgaaggaacgtttgagctgcttgctgaagatgatccggcggttctggcgtacgtcagacacggcaaggatgaaaaacttctgtgcatcaacaacttctacgggaaagaagcggactttacggttccgcttaaagacacggacggctggcggtttacggtgctgctgacgaatgatgaaccgagggaagggcggccggaacgattgacgctccgtccgtatgaatcgatcgtttatcatctgacaaaagcgtgatacactaatctgggtggtcatgaatgaaagtgaataaatatatcacaatctataaagatatggtgcggcagattgaaagcggccagcggaaggctgaagacgttcttccgtctgaaaatgatttatgcgatcaatacggcacatcacgagaaaccgtccgtaaagcgctcaatatgctggcgcaaaacggctacatccagaaaatcaaaggcaaaggctccgtcatattagacagagaaaaaatgcgctttcccgtctcaggcctgatcagcttcaaagagctttcggaaacgctcggaaaagagacgcgaacggaggttcaccgtctcgggctgatcctgcctccctcagaagccgcaaaagagcttggtacagtggcggatgaaaaggtgtgggaagtcgtcagatcaagacggattgacggagaacatattattttggacaaggattactttgtgaaaaaacatgtgcctctattaacgaaggcgatttgtgaagattcgatctatgagtatctcgaaggagagctcggcctgtccatcagctacgcgcaaaaggaaattgtcgtggagccggcgggggaggaagaccggaagtatttggatctcggcgggttcagccatatggcggtcgtgaaaaaccgcgtctttttggaggataccagcctctttcagtacacggaaagccggcacaggctcgataaattccgtttcgtcgactttgcgagaagagaaaaataaaaacggactgccgcggcagcccgtttttttgtcagtatcaaaatgaatactatccaacaaaaatgtgcgtactggtactttcaaaaataatggctacaatagtacataacgagataaaaaggagagatcatgaatgtcagataaaaaacagcagatcatcgaagcgtatcaattcagacacgctacaaaggaatttgatcctgagaaaaaaatttcagaaagcgattttgaattcattttagaaacgggaagattatccccaagctcactcggtttggagccttggaaatttgtcgtcgttcaaaatccggagcttcgtgaaaaactccgcgagttcacatggggggcgcaaaagcagctgccgaccgcaagccatttcgtacttctgcttgcccggacggcaaaggatatccgttttgacgccgactatgtcaaaaaccacttgcgggaagtcaaaaaaatgccggaagatatgtatgaaggctatatcagcaaaacggaagacttccagaaaaatgatttcaatctgcttgaatcagatcgcgcgctgtttgactgggcatccaaacagacttacatcgccctcggcaatatgatgacagccgctgcgcagatcggcatcgattcctgccctgttgaaggcttcaactacaaagagatccaccggattcttgaagaagaagggcttctggaaaacggaagtttcgacatctctgtcatggccgcattcggctaccgtgtcagagaaccgcgcccgaaaacaagatctgcctcaaaagacgttgtaaagtgggtataagataaaaaaagctgccgggcgtgtcccggcagcttttaatgtttatttggttttgctaaaaaacaggcggtgatccaggacgtaacgggaatgatgatgccgatcccgattccggcgcaaagaatggtgacggcttccgcactgaatacttttgagttcactattttttcagctgagtatgataagtctttaaaccagataattaaagccaaatagctgccgaaaaaagcaaagaataacgtattcgtattcgttcctaaaatatctctcccgatgcttaatccgaatgtgtacagttcttttctgctcatggacggattatgactgtaaatttcccgcatgggtgaagtaatggaaatcgcgacatcagtaatcgccccaatcgtgcccatgatgatcatagctgcggtaaccttcacaaaatccaccccgacaaacagtgtgaatatgccgatatcccccaattcttcttcaccgaatccctgaatcgaagtatgttttgttacggacataataaaaaacagcagcaatgcaatggtcagcatcgcagaaataaaggcggttacggttttgacgtttcctccattaatataaaaaagagtaatgctgcaaatcacggcggaagagagcaatgttaaaacaatcggattgatatgcggatctgtcatgaaaataatggtgagaaagagaaccccgaaatttaagaataacgcaataaaagacctcgctcctttttttccgccgataatgaccattaatagaaataaaatcgccgcgagaattacgatgacattcatgagcttgccttcttttgtttaataaaaaagacagaagcatacagactggcgggtatggttaatacaattccgatccccccggccaatgctctggctatttccaaggaaatgttcatagaaagagtgaatcctatcggggaatcatttttcaaatacaaaagcatcatcggaatagagccgcttatataagcaaaaaacagaatattggtcatcgctcccatgatgtcttttccgatctccatcccggaacgtctgagagcttgtaatgagatacccttgttttcttcatataatccgaagacagatgacgtcatggtaatggctacatccatgaccgctcccagtgatccgataaataccccggccataaacaccgtgtgataagggcgggttaaatactgcatttcctcatatctgagacctttctctccggttgccagcatcaccagatacgtaatcagcagggaaacgaaagtgcctgcgagcgtcgcggctatggcggcatatgttttcgcgtgaaaaccgctgacaagcagcaatgagatgaccgtaaagatgagaatacagataccgcagataaaaattaaccctatattaggatgcttcctgtacaaatctaatgcaaacgacagtaaaacggcgttaaacatcaggctgacgatcgaaaagaagccttgtttttttccgacgataagcaaggtgaagatgaaaacccaagcgatcagcaaaagctgtttatcccgttttttatctataatgcttcccgatatatctttgtttgatggtttccctttatcaatagaaacgaatacttcatcgccaatcgaatatttctgatcattcgctccggataaagaatactgattggacaaatgaatgagctgccctttctgactgccgttttcaagtctggcagtgatcgtctgattgaaaatcttatctttgtttttatgcatgtcctgtacgtttgcctggtgttccaaagttgttttcgtcactctggcaatcggccgctcataaaaagaagcgttgtgagtgacaaaaatgatcgagctgataaaacaaagcgctgttatcacgtaaaacagctttttcttgtaagacatgcggtttcgtttgtttcctgtaatcttcaaaaaaagtcctccaaacaggcggcgccgtgtaaaagagaggctccgccgtgaagtgttaaacgatgcggatgcagtctttcgcgaataacgttcatattttatcactcggccgtacggctgtcgactcagagggggaccggcagaaaaagctctcctgatatcagatcaggagagctcttgggatgaaccgcccgataaaagcggtctttttatgcttcgttcactttttttgcttttcttctttggtacagatacagtgccgttccgagcgcgctgatgagtaacccggcaagaaggatggaatacatcgttgtggctgtatcaggaagcaggccgcccggcgatactccgtcctgcgcagggccggatgacggtttttgtccgcttggctgctttccggagccgtgatctccgcttgtcggcggcgcgctcttcgtgtttgcgtttaatatggtgtattcactgaaatgatttgtatagcccgtgacgagatcgtgtgaaaccgaaccgttgtctgtttttgtatagacgttctttttccggtctacatgataaatgccgggctgtttcgcctttttcatattctcaatgcgcagggtgagctttaccggcgctttgaatgttttgatgtctttgtttttctgcttcattgtaaagtcgtatacatttgaaagcgccccgctaacttttcctttcggcgccacgccgaatcgtgtatcagctgaagcggcgtttgccatcggcattttcatgctgaacttgtcatgcaggatcgtaagggaagaatccgatgttctgtcctttaacaggccgatttgttttttggtcacgctgagatcaatcggctttttggcgccgtcattcttatcgtaatacacgatcggcgtgttggcgtttttggcatagacggcaaatgcgctgtcatcttcaagcgtccacgaaccgtttttttgttttgtcggcaggtacacttcctgcgcgcggccgtcaactttcggttccaccgcttttcccgctttttcaagctgctcaacgaagacctcatagtcggcaaagccaaggtcttctttatgggatgcttcgttaaagacggaatatccgtctccgccttcaccgacaaagttactggtggcgactctgtatgtcttcttatcagaaatcggctttacactgccgtcatcctgtacggccgaagcttgaagaacacggtgtcccggctttttattcagtgtaaacgtgtatgttaaaccggcaacttgagggaaggcgccgccttgagcctcaattccgcttaatccttgttccagggcttgtttgatctgttttccggttaaatccgcgacgtaaagcgtgttgccgaacggcattacattcagcacgtcgccgagtgtgatgtctcctttatcaatgcccgcgcggatgccgcccccgtttgtgatcgcgatttgggcgccggccgcttccttcgctttttgcagcatgccgtccgcgatgaagtttccgagattggtttctttggagcggacatgctcgcgccggccgtcaagtgcgaccttcgttgaaccgactttttcatttttaactgagacgagctcttttttaaacggatcaagctcttttttcagatccgggtcttctttcgtctgctcattcaccggcagcgcttgaagagaggattgttccggcaggacgacgccgtttttgtcaaatgcgacatcgacacggcctaaatattcgccgtattcttttgcctgggcgacgatggtcggctcttcgtttttgacaatttccattttatctacaagcgtatgcgtatgtccgccgacgattaagtcgatgccttttacttttttggcgagatcgagatcacgctgatgtccgatatgggtcagggcgataattttattgacatgttccttgttctgtatttcttttaccgtatcttgtgcggattggaaggcatcatgaaagacaatgctttttcccgggcttgatgtgacggacgtatcttctgtcgtcaagccgaatacggcgactttttctccgtttacatcaagcagaatatatggatagatgcctgcttttttctttttccctgccgtaaatgtgtctgcttttttcatgaatggtctgagttttgactctttggacacatcgacatttgagctgacgagcggaaagtcaggtgcttgaaaattgtatttcccggacgggtcagacgcgctcccgttaccgctcaagaagctggcgagagcacccggacctttatcaaactcatgatttccgaaggtcattgcgtcgtagcccatgctgttcatcaattttaaatcagccagcccctgccactttgtgaaatagagatcgcctgagaaaacgtctcccgcatccagcaaaatgctgcggtcggtttcgcttctgatttctttgattttcgtcatccgcctcgccgcgttatcaaggtgggcgtgcgtgtcatttgtatgcataacggtgagtttccatgcgtcatctttcggcggatctgtgcccggttcatcatctttgaattggagcttgtactgtccgtagcccgcgttttgtgattcaccgatataggcgacgtcatctgcgcggtcggcaaacggctttgcggccaaggaagattcaaatgtcagatttgtccctttgaccggaaggatggaccagttatgatcagcctgcggattaatcgttttctgctggatgatgtaatccattaagacctgcctgttctcatcggcagaagagtatacgattttgtcattgcttaagtgagggaatcctccgccgcctgaagcgcggtaattatttgtgacgatcagaaattcctgcttggcgctgacgggctttccttgataagaaaggttgacgatccggcttgcatcgggatgaatgactgttccgttttcgttgtatttcgccggttttgtgacatcgacctgataggtgacaccgtcaatgacatcaaaattgtatgagcggtaggcgtcatttaaaagcgcttggctgccgccttttgcctgatcgatctgattaaattgccccgcggacatttcgagccagtctttcacttcgcttccgttcagcttgacgatctgaaccgtgttgtcatacaggtacaaatcgccgatgtttttgatggcgaggtcgccagcggaaatgtttgtatagtagtttgagccgttccgcccgccggctttaaacggggcgcccgccgagaggataggcagatctttgtactccgtatccttcatcttattttcggcgtaccatttttgcgcatccgttacgatttgaatggacggatcatctttgacttgggcgaagaaactgttgatatcggcttttgtctggccgacgggttctctgatgtatttcaaagtgccttcgtgcgcttttttgacggtattgacgacggtttcgttttccgaattcacattgccggcaatcggctcgatgctgccttttgcatcttccacatgccacgcgctgtctgttttttcaagccggaggtcgatgacgcccgcatatttgccccagctgcttgacataacaacggggatgccgttaatcgtgcctttatcgacgtcgaattgagcagcgcctttgtattcggcatcagggaaaagcccgtgctgatggcccgatacgatcgcgtcaattccgccgactttcgttgccaggtcaaaaacggcgttttccgctccggaagactgcgcttttttttcgatgccgctgtgggcgagggcgatgacgatatcggctccttcagctttcattttcggaacggttttctttgcggattccacaatgtcctcgacctgaacgcggccttcgagatttttcttatcccacgtcatgatctggggaggaacaaagccgatatagccgacttttagctgatgcttgccgccgttttcatccgtgacggttttgtcttttatgacataaggcgtataacggttttcgccgcttactgttttcacattggcgttaacgatcggataatcagcgcctttgattgtcccgtccaggaattcaagcccgtaattaaattcatgattgccgagtgttcctgcgtcataatgcagactgttcatcacttcaatgatcggatgggtttttgcgcctgaaatgatatcatttttctcatattttacggcgtattctccgaggggattcccctgaatcaggtctccgttatcgacaagcaccgtattcgggttttcgcgcctgtgcttctcaataagctgagccgttcgggccagcccgaattccgttgtcggtttgtcgctgtagtaatcgtagtccatcatgttagcgtgaacgtcagttgtggctaaaatgctgagattcacactggaggatttgttttcttctgctttaatgggtgatgttgggaggatcagactaagtatcataactaggggcagcagaatacggagtgtcatattgacgctgcatcgtcttttctgtattctcacctgttctccacctttcaacaaattttgtcatgcagtaccattgtaagaatattttgtgaaagtttatatagatttcatgatgattcttgtgaaaagataaaaaatgaggataatgacctatgtaaaacaggcgggcggtaaacgcgttacctatgtttgatgttagtgtggctggggtacatggatttatgtagacttcatcaagcaggaggtagtaactatgggtaaaaaaattgcagttgtattaacggattactttgaggatgtcgagtatactgaacctgcgaaagcttttaaagatgcgggtcatgaattaaccgtaattgaacaggaaaaaggaaaaacagtcaaaggaaaacaaggggaagcggaagtgaaagtggacgcgtccatcgatgatgtgaatccgaaagactttgacgcattgctgatcccgggcggattctcacctgacatgctgcgtgcggatgaccgtttcgtccaatttgccaaagcgtttatggatgataaaaaaccggtgttcgctatctgccacggccctcagcttctcatcaacgcgaaagcattggacgggcgcaaagcgacaggatttacttcaatccgaatcgatatggaaaacgcgggcgcgaatgtggtggatgaagaagtcgtcgtctgccagaaccagctggtcacaagccgcacaccggatgacattccggcattcaaccgcgaatcattaaaactgcttgcgtaatataaaagcggagcgccgtatcaggcgttccgctttttttgtgaagattcccggatgaccagctcaggcgccagaataatgcgttgttttttgtgctgggaattggtgattttatgatgcagcaattgagccgcttcttttcccgactgccgcggaaaggaagaaacggttgtaagcggaggataagaaatttcagcttccggcacgttatcaaagccgacaatgtcaatatcttcgcccggaacgagcccggcttttctgatcccttgcatgacgccgaatgcgaccaaatcactgaagcagaaaatcgcggtcgggcgctcagaccggcggaggagctccgtcacggcgtcacagcctgcttcgcgggtcggcgcgctgtcaatgacatattcatttttcacttccagatccgcttcacggagtgcttttttaaaccctttcatacgcttcgtccatgttgatgagtgcttcacgccgcccagaaacgcaatctcctgatggcctttctcaatgaaatgacgcactgccttataggtgccttcctcataatcggctccgacaaaatcacagttggcatcggcaatctccctgacggcgagcacgaccggaatgtcaagctgctcaaggcgggaaagggtttcctcagccgtccctgaaaccggacacaaaatcaatccgccgaccctgtgctccagcatggtcgagatcagctgctcctgcttggcgacggaatcaaatgtcgtgcctaacagcaccgttaatccgacttcctcaagcgtattctgaacgccgatcagaaactctgagaaaaacgtattggaaatgtcagtgataatcaatcctaccgttgtggacgtctgtgatcgtaaattcgcggcgacccgatcatatacgtaccccagctcccgcatggattgcagcactttctcacgggtcgcttcggaaattcggggattattgcggacaattaatgaagcggtggatgttgagacgccggcatgttcggcgacctgctgcaatgtcacccggcgttttttttgctgtttcatacgtcgcattcctcacttggtttttattcgttacatccattataagcgttttggcgcatgagaagaaagagagaggagggggaaaaagataaagcgccggaagacggattgtccttcggcgcttctgtcacaataggttattcaaacatttgctctttaatatactgaaccggcatttcacggcctgtccaatattcaaacgccatggcgccctgccaaagcatcatgccgagaccgttaatggtcttgcagccggctgcttgagcttgttcaagcaatttcgacgtaacggggttgtaaacgacgtctgtcacaatcaaatccggacggagcatggatgtatcttcaataacactcaagccttcaagcggtttcatgccgacacctgttccgtttgtgaaaatatcgcttgaagcgatttcagcacgcagcgcatcttgatcttcgagcgggaagactttcgctttacaagaagatcccttcatttcttcattgatgatgcggacattttcttccgctttttcgaaaaacgcgtcattgcgggcgaaaatagagatttctccgaggccttccaatgcggattgaatcgctatcggagtggcggccccgccggaaccgaccagcgtcatttttttccctgtgatatcgatgccgtgttcttttaagttgcggacgtatcccataccgtcagtggagtgtccgatcagtctgccgttttcattaacgactgtatttaccgcgccggtaaatttcgctgaatccgcgagttcatcgagataagggagaatgttcatcttgttcggcatcgagacattgaagcctctgacgtttaaggcgcgcattcccgttaccacatcttccagctgttcattgccgacttcaaacgcgaggtaagcgtagttcaatcctaattttttaaacgccaggttgtgcatcgccggagataaagagtgtccgatcggtgtcgcgaataatccgataagctgagtttttccgttaatccgtcctaattctttcttcatgatgtattcctccgttagtccattcatttgtttttcctcccgctttgagggcaaaaaacgctgattacatatgtttatttaaaatgctgagtacgctgcgcaattcctcaacgggaatctgcccgggcgctgatgcttctttgcccgctccgaacgtgcacgctgagccgaagacttcgccggccagccggctgatcaggcctgttcccgccattgacatcgtgatgatcggccggtctgcgtattgtgttttcatcgtgtgagtggcatccaataagacgaaaacatcttcagtgctttgcggcatcaccgcgattttcggaatgtgcgcgccgtacgcctgcatgttccggagccgggaaatgatttcttcttttttcggtgtctgatgaaaatcatgattggacatgacgacatatacgccgttgtcttcagcggttttcacaattgatttgacttccgcttctcccgtaaacagctcaacgtctgcaaggtcaatatgttttgtttcgatggcggttttaagcaattcaatgtaaaagcggtcatcaataactttatttccgccttctttatgggttctgaatgtgaaaagcagcggtgttgctcctgcggctttccgcagcttttcaagcatgccttttacggcgtccaggctgtcaacatgctcgtatacatccgcccgccactcaatgatatccgggcgaagcctgttgacggcttcaatttcttcgagcagttctttctctccggccgccatcagcggcacaatgatcttcggaagcccttcaccgatgaccgtgtttctgattgtgatagattgcatgataaatcctctcccttaaaaaatagtcaggctttcatcacttgcttaaagcggattccgataaacaatgcgaggagggcgctgacggccgcaattccgatatcaagcagaaaaacaggcgtcaggccggcggctttggatatcgctcccgttacaagcggaatgacaataaaagataagcttgatgctatattaacaaaagatgtgattgtacctttatttttagggaataaaacagccataaccgtcatcgccaattgcagaatgcccgcagttgaaagtccgatgacaaaggagctgatgaccgatacggccggctgctgaatgaaaatcagagcaagcagcgcgattgccgcgatcacagggtacagcaccattaccgtaatcggctgaatcactctgtttaacagcacagccagcaataacacggacacaagcgccccgatgctgtaatagctcaacaatttgacggcctgcacctcaggcatgcccaaaacggattgcccgaacttaggaagccatacttgaacgagcataaacagcgccgttgatgaaaagcctaacagaatgatcgcaacgccttcgcgccatatcgacggctgtgatgtgaacgcgtcatcagacggagaggcttccgtccggccgccgtcttctttttgcttatgattcggaaacggaactttcaacagaaaaaagccgttcaggaagaaaataatgcccggtacgaaaaacgtccagccgtaaaacaaatgcctgtccgcaataaacgcgataaaaaacggaagcaccgtcgcgccgattgatacaaacgctttgattaacacggttgcagagcttgcgtttttcggaaatccttcaataagcgccggatatgtcccggaatccaaaaaggaattggcgatcccggcgaaaatggcgaagataaacgcggccgtatagtttgtcgaaagcggaatcccgattaggaaaatcagatacagaaaggcgcccgacacgataaacggccgtctcccgaatgtatccgaaagcttcccggcaaacagaagcgaaatcagcttcccgatcccgatggcggagaccaaatagctgacaccggctgcggaagtatgaagctgttttgataatgcctccatattggatgcgataataatattgatcatgcccagcaggaaatagttaatataaagacccgctgccattttggtgtatatgtttttcatgatgacatcccctaatgcggttaataaagaattaaattatttttttaattgataaaagcacagcaccatacccctttattgaaccactgcctttctttgaaaactgtttgatacaacggttgcatagacaaacttgaataacgctgatatcacaatgagtatatcgttctactaaacaaaaaaagataagcggcccgctcatttagtatatcgttctaccaagttcacagttactatactccttctttttatatgtgtcaaaccgatgaacttttattttttacttttttaaatcaaaaaagacccgccgtttttcggcaggtctgacatgggtttatttcctgagagaggcgagctcctcggcaatggcctgcatttcactcgggctgaatgatgcttttttcatgaccatttgatgaaggtatgtaagatcttctattttttcatcactgaaatcttccgctctgatgacgccgacattgagcatgttgagcttttgcgaaatgtcttcaatcattttatttaacgtttctgtttgttggctcggcaaattcatgcatcctttcatgatcgttttcgtcccctttattctaacagaattcatttagaataaaagcttatttccacagccgcagaaaaattgctaagatgttgataaggtttttgatcctcaaaatgcggggaaagaatagggaggttatcgatatgatacatgtgctgtttgtctgtctgggaaatatttgccggtcgcctatggcagaggcggtattttctgatatggtgaagaaaaacgggctgaacgggcagattaacattgattcagcgggaatcggcgcctggcatgcgggaaatccgccgcatgaagggacaaaggagatcctgaaggagaaagggatcagcgcaagcggcatcacggcgaggcaggtcgggtgagtctgatctgaccgattttgattacgtcattgcgatggatgcagaaaatatcggacatctgcgcagcatggccggttataaaaaagcggcgccgcgtattgcaaggctgcttgattatgtaccggagtcagaccttgccgacgtgcccgatccgtattataccggaaatttcagcgaggtgtacgctttggtcgagtccgggtgccgtcatttgctggagacaataaagaaagaccatcatttataaggggattgaccgatgaagcagacacgcatcatggcaaaagccattctgatcggcgctgccgccggcggagcactgtccttattacataagccgacgagagaggcatgtttccggaacatggacgcgtgcaggcggcgtgcggcattttaccgaaaacatcctgaagccctgaagcagcaggcttccgcaaaaatggatcaagtgaaaatcttcgccaataccgtatcggaagatctgagttttttaaacgggcagatcaccaagctgaagcagacgacaccgcaggtcattgacctgttaaaagaaacgaaggagcatttttcgaaaaacgatcattgaggtgggatgtcatgagttttataaaggagctgtttgcaaggttttctctgcatgaaggacaaagtaaatcggcggagctggcgtattttttcctgctgtcattgtttccgttaatgattttcatgctgacgctcaccgcctatcttcccatatcggcagaagacgtgctcggggcggtcgatcaatacgcgcccgacagcgccatgtccatggtgaaatccataacggagcaaacgctgaacaagcgcagcggcgggcttttgtcattcgggattatcgccgtcatctggtcggcttcgaatggtatgaacgcgattgtcagagcatttaaccatgcctacgaagtcgaggaaaaccgctcatttatcatcattcgcctgacctcaatttttttaaccattgcgatggtggttacgattttaatcgcactgcttctgccggtgttcggcagagaaatcggaatgctggccgcggatttcatcggcgcctcggacctgtttttgcaggtgtggtcggttgtccgctggggtatcagtccgcttatccttttaatcgtgtttaccgcgctttacatattcgcgccgaataaaaagctttccctccgttttgtcctgccgggagctgtattcgcggcagccggctggattatcgtcagtatgctgttctcattttacgtcggcacctttgccaactacagcgccacatacgggagcatcgggggaattatcgtcctgatgatctggttttaccttacgggaaccttgttgattttaggaggagaaatcaacgcgcttttacataaacgtaaaaagcttcctgatgaaaatccgtaccgcgggagcaagctatagaggaacggatgacgttcaagctgaaaaacggagggaatcggctatgaccaagcatacgaaaaaaggcggaagccataataaacaaaactcaaaaaacggcccgaagaataaaacaagcggaagcgccaacgggcagaacggataccactagaaagaagccgcctggctcagatcaggcggcttttttatgtggccggaaaagaatgggattcggaagcggggctgtgctttgttttcccgaagacgagcgcaagccaaatacagaccagaatcaccgtaataaagtaaaacaagttggcgctttcaaaccgctgcatataccagccgcccgccaccgggccgatcatgcttccgaggctgaaggaaatgccgcagagcaggttgcccgccggcagcagatgggacggcagcaggtcgctcatatagctgatgccgagggaaaacatactgccgaccgccatccccgccgtgaaaaagcagcagccgatgacagaaggcgacggaaacagtccggccgtcaaaaagcaaagggcacccgttaataagatgacgagcaggacacgttttctcccgaatcgatcgcttaataaaccgagagggaactggaatacaatacttccgatggcaaaagcgggcaatatcagcgcgacggcatccacggatatgcctaaacgaagggcgtacacgggaaagcttccgttcagcgccgtttctaaaaaaccgtacccgaaagccgggagaaaagcgacccagccgaaaagaagggcgcggtaaaaccgttttgcgctgttgtccccggatgtttcatccggaccttgcgccgggtactcgttacgtaaggcaaacacaaacagccaggcacaaagactgatacagccggatacgataaacggaagggacggacttgttttcacaagagggaccatgaacgggccgacagcgaatccaagcccgaaggacagtccgtacagcgaaatgtttcttcctctgtttcggggcgttgacttggaagtcacccacgtttgggttgaaaaatgcagcatatgatccccgattccgataagcagccgaagaaaaaaccataaccatatggattgaagccaaataaaactgaataagctgatgataacaagaaatccgcccatgaccatcagaggtttgaatccgagcttgcgcagcggggcctccataaacggcgacgccagaagcacgccgatataaaggccggttgcgtgaagtccgtttatggctgcggattctccgttcgtttcaaaaatgacggagatcaccggcagaagcatgccttgggaaaatccggagatggaaacaagcagaaccaaaataaagaagtacagtcgtgacatcgcgtatttctccttcttcagtatctttcttgatcgtacacggatttgccgcgtccggcaacctgaaaatgccaattcgggctgccgaggaagtgtaattgaaggagtttttgagaaggatataaaaagacttattcgaaaaaaggagccaggcagatatgaatcggatttttttctttacggctgcggcgggagtgccgctttcagtcatcggcggcctgatgcactggccgtcagcggttttgtttattatttattgcttgacgattattgcgcttgcaagttatatggggagagcgactgaatctcttgccattatcgcgggaccgcggatcggcggtctgctgaatgccacgttcggcaatgcggtagagctgattatatcgattttcgccttaaaagaagggctgacgggcatcgtgcttgcttcactgaccggttcggtgctcggcaatcttttgctcgtcgcgggattgtcattttttatcggcggtttgaaatacaagcggcaggaattcaatattcatgatgcccggcataattcaggcctgctgatttttgccattatcgtagcttttgtcattcccgaagtgttttccatagatatgggggaaaaaaacaagcttgatttgagtgtcggcatcagcatcatcatgatccttttgtacgtggcagctctttatttcaagctcgtcactcaccgcggtgtttatcagccgaatcagccggaggcaaaggaagaagaggagcagccagagtggtcggggaaaagagcgacagccgtcttatttatttcaactattattgtcgcctacatatctgaaaaccttgtccatacgtttcatgcggtggctgaacagttcggctggagcgagctgtttatcggggtgattatcgtcgcaattgtcggaaatgccgcagagcatgcgtcggcgattattatggcgtacaaagacaagatggatgtcgccgttgaaatcgcggtaggttcgactttgcagatcgccatgtttgtagccccggttcttgtgatctgttctatcttttttccggtcaatatgccgcttgtattcacattgcccgagcttgtggcgatgatatcatccgtccttttgatgacgatgatttcaaatgacggcgattcgaactggtttgaaggggctacgctccttgccgcttatgtcatcatggcgatcggttttttcctgctttaacctgtaaaaaatgcggataacaacgattgcggaggaaaagactaaaggaaaatgctatagaaagagtgatatgatgagaaagctgtttcatgccacactgattctgctgttatcctttagttttttcgcaatgccgtctgccggtgcaaagaaaccgtttaaggttcccaactctgttgtaagcatttcaaaggaaaatacgtatccgaatgcttcacaggaccagccgatgcttcagccgagcaaactggcaaaggaattgttagatacatccgagatcaacatcgaaaatccgcatctgataaaaatgctgaatgaatcctcggtttccggttcaccgcttgccatcggctaccgggcgacaatatttctcgggaaatgggcgctcggctatcaatcgaacgaaacggtcgccaactgggaatataaaaaaatcaatacgaacagagcggataaccggggcggacagcaaaccgcggttatctcatacgcccaagaacagcagtacaaaattaaaggcgggctcacagcgaaggtgccgaacgcagaagacgtaaaaagcatgatgatgcaaaaagcgatgaagaaaacaaaactgccgctcgcgtttgaaacggttatcggcgcaggcacaaaacgcgatcaaacctacaaaatttctccgcagcggctcggctacctgcacgcctacgctccggccgttaatgaaaaaggaaaagtaacatacggtgaagtgtatttggtgctgaaaggcagcaagcggaaacttgtcgtcaaaaatgtgacttcgcaaggaatcggggcttggattccggtgcaggatcacgtcacattcggttttcaaatgacagcgcagccgagataaataaaaaaagctgattccggttcgggaatcagcttttttgtgtgtgatacatttcctcaagcaattgcacattgttgttgtacagctcccgggcaagaacgcgtctcaccgcaaggcttgccgagaagtattctttatcttgaaccatgcctttgacggtaaattctatgcctctcgtcaatttgttcaggctcatgattccatgcacttgaaacggctccgtcgcattgagaaattcatcccgcttcagtgaatcgcgaagctcatcattgagcatgtcgcaggctttttctaagacggcatatacccgctcgggatcttctttataactgatcacgacggactcggtaatccgcataaaatcaatattatagttttgaagctgtctgacctcaccgtttgaaatggtaagcagcttgccggtccactcacggatctggagggaacggagcccgatttcttcgactgtgccgttgaacagattgttaatcgtcacgtaatcgcctttatgaagctggcgttcgtatatcaaaaagacaccggccaatatgtccttgattaacgactgggcgccgaaaccgatgacgataccggcaacacccgccccggctaaaattcggccgaaatcatgaacgaataacgaaatgacgtaaaagataaaaccgatcgtcgccgtatactgggtgatggatcggacgaggctttcaatcgttttccctttccgttcctccaagaaatctatgcgtttaaataacacctggacaaagcggttgatcagaaaaacaccggcgtaaagcacgagagcgacgatgatgatctcaaccactttgcttttcaaaatatccgtaattgtcgtttccatcttctgttaacctctggcttttcgtaatgaaaaatccgtgtcctgataataactgtttttgacaaggacgttcggtccgaggcaccggacgtttgtgcagcggcagttcagctctttgctcagcttcgtctgtctccacttgtcatatgcatcgggaaggctgtctgttttaatattgccgagcggcggtgtatcgccgaaatccgtgacaatgatatttccgtcaaaaatgttgacattcaggcgggagcggccgtcagggtcgtttcgcaccgtaacgtttttcgcttcccgcaggcggcggaggagcttctggtcttcttcatcagggctgcatgcgtaaaacgggagcgtgccgaacagcatccatgtctcttcatcgcgaatgtcgagcagatgatgaatggcctgtctcatgtccttcaggctgagtgattcaagcgcgctggcgaaatcactcggatacatcggatggacttcgtgccgctggcatttcatttcttccgtaatctgccggtgaatatgttcaatatgcggcagcgtccgcttgttcagcatcgtttccgctgaaaccattacgcctgcttcgaccagcgtgcggctgttttcaatcattttatcaaaatagcgcgcccgctgttcaaatgtcggtttcttctccatcatcgcaaatccgatgtcggcaaagtcctcgaccgttccccaattgtgggaaatgtgaagaacgtccaaataaggaataatccgttcgtagcgcccgatatcaagcgtcaggtttgaattgatctgtgtgcgcacgccgcgttcatgcgcatatttcaaaagcgggacgacgtattcctttaccgatttcagcgaaagcatcggttcgccgcccgtaatgctgatagagcgcaacagaggaatttcatcaagccgctttaataaaaggtcgatcggcagcgcatccgggtctttcggctggagcgtgtacccgacggcgcagtgctcgcatctcatattgcacaaagtcgtcgttgtgaattcaacgttcgtcagtttcatatctccatactggtcgacatccatgtacgcttcccaaggatcgtactccggtgtaatcggacgcagtgctgtgttttgtgtcatgactatctaactcctttataaatgggcatactaacgtctgccaactgttaattttagacctgatctgccaagatcgcaagtagcggaaccattgaaaaacgccaaaaaatacgctaccattataaaaaatgaatggagtggaagtatggggaatgcagtaaacagcaaagatcagcagctcgattacctgaagaacagactcgatatgtttatgaatgtcattgattcattagaccctgaatcaacggacgttgaagatatagaccggctcatcggcatgcttgatgatctggaagcaaaatacgaacgctttaaaaaggattgggaataacccccggcggatgccggggtttttctttttccataatgcggctgtataaaagggcagggcctactgcaaaataaggaaaaatgcagaaggagtgctggtcatgaaatggttttgttcaatttgctgcatggccgttttacttgcaggaggcatcaacagcgcagaagcggtgccgaatgaacggataaactggggatttaaacgcagcgtcaatcatcagccgccggatgccggcagacagctggacaatctggtcaaaaaatatgatgccttttatttgggcaatacgaaagaaaagaccatctatttaacgtttgataacggatatgaaaatgggtacaccccgaaagtgcttgatgtgttaaaaaaacatcacgtcacgggcactttttttgtcacgggtcattttgtgaaagagcagcctgatttgattaaacggatgtcaaaggaaggccatatcatcggcaatcattcttttcatcatcctgatctgacgacaaaaacgggcgatcagattcaagacgaactcgattccgtcacggaagctgtgtacaacattaccggaaagcgggacaacctgtatctccgtccgccgcgcggcgtattcagcgaatatgtcctcaaagaaacgaagcgtctcggctaccaaacggttttctggtccgtcgcatttgtcgactggaaggttaacgagcaaaaaggaaaacaatacgcctatgatcacatgataaagcaggcgcatcccggcgcgatctaccttcttcacaccgtttcaaaggacaattcagaagctctggacgatgccattaccgatttgaaaaaagaaggctacacgtttaaaagcattgatgacctgatgtttgagaaagaaatgaagctgccgcgcctgtagaaaacacctctcctggtaatggagaggtgttttgttatttgatacatttaatcaatgccgcccaatccaaatctccgcagccttgtgcgatcccgctttcaaaatggctcttcgccagttcggcaagagggagttttgcggaaacctgttctgcggcggcgagcgccagattggtatccttgagccctaaagacattttgaagccggccggctcaaatttctcctcagccatgatcgtgccgtaattttgatagacgggagagccaaagagtgcgttggcgatttctagaaattgtttttgttctaaaccgaacttatccatcattaagaatgattcagataacgcctccagcatagaaacgagcaagaaattgatgctgattttcgcggcatttgccgtttttgtttcttcacccgtgtcaaatacttgctgactcaggatgttaaacagcggttcggcctttttcttcgcttctgccggtccggctgtgatgatgcgaagctcggccttctcggcggcatcggggcggccgaggacgggagcggcaataaaggactgccctctgcccgaatgtgcggcggaaagctgttctgacagcgccgtactgatcgtgctcattgaaatatgaatgccgttttcagataacccggcaataatgccgcaagctccgaacgtcacgcctgttacagcttcatcgtctgacagcattgaaagcacaatgtccgcatgttcagctgcctggcggggcgtttcggcatattcggcccctttatccagcaggtcagccgctttttctttcgtccggttatatacagtcaggctgtatccggctttcatgatattttcggcgatggggcggcccatattgccgagtccgacgatggcgatcttcatttgacagtccctccaatgaaaagttttccaccattatacatgcaaaatggttattctgctgtgtacaggattgccactttcagttccggttctgaagaccatccggagtctgaggcggctgtccccttataaaatccggtaaatcgggttttgatgattgtttttgaacggggttttacagtgaatgtttttgatttgaatgtgacgtcctttatgttttctgataaatccggcgtgacagaaatggtttgttccccttttccgtaatgattgatataaagcgtgcagctcatgcccgctctttttcgttcaatcagatgactgcattcgctgcggtgcttcaaatattcgacagactctttttcgggcgcgaactgttttaaggaaaaagcggcatattcggtggcaggactgataccggaagcggcccccatactgagaaagatcagaaacagccccgccgagggaagcgtccgcctgaacgcggcggcacaccagattaacgccgcaaagtaaaggacgaccccgggaatgacggagatatgggctccgtcttcagaccaggaagaaaagccgagcgactcaaagatgtaatcagacaccgtacggccgttatacagcggggcaatggacatgacactgaaaagcaggaggacagaagaaatgattttatgagaaaggatggtaacggcgcacacctctttacgtttttttccagactatcatgttttctcaaaaaaaagaacagccggcagccgttcttacttgaaaatattaaaccagcctttgcgggcgaaccaaaacagcatggcggcgacaagaacggccatgacgcccaaaacgataaaatacccgtatttccaatgaagctcaggcatgttatcgaaattcatgccgtaaacccccgcgatgaacgtcagcgggataaaaatggtcgagacgatggttaatgtcatcataatggcgttcatccggtttgaattcagcgtcacatagctgtcccgcaaatctgacgtcatatcacggtttgactcgatcagctcggccagttttaacagatggtcataaatatcgctgaaatacgccttcgtttcacggctttcttttacatggtcaaggctcaaaatccggtacattaaatcgcgcatcggaatgatcgtccgtctcaggttcaaaagatcagtccgcaattcaaacacttcattcattaaagtgccgtaagatttatgtgttctgctgtcttcaatttcattcagccggtcttcaattttgtacagcacggggaaatattcatcgacaagctgatccataatcatataagtgatgtgccccggcccttttttggctaatcccggagaagcgaaaaaccgttctctcacccttgagacgccgggcgattcgtgcaaatggaagctgacgatgaaacggtcggactgaaagatgtccacctcttccatttccagtgtgtccgggttcaaggcgtggagcacataaaaacggtagccgtcataatggtcgattttcggccgctgcatatgctgaaagcaatcctcgatcgcaagcggatgaaagtgaaaataatcccgcagcagctcggtttcatgcatctcagcgccgaaaaaatcgatccagtaccatgcgatgtccggttgttctgtacgtgataggggatattatctaatatctcattatgtgttgtgattgcggttatatgtatcataaacaaccctccgcctgccattatatcatgcggcgttatgaagaaaagtatacgaattgccgcccgcccgcttcatgatatacttggacaaaaaggggtggagcatatgtggaaggaaacggtttcggtcacgccgccgtatcattttgataaagtccttgagaggctgtcgctcgatccgctgaatgcggtcgatcttcatgcaagatcaatcaaagtgccgctcagaacacgggacggcaaactgtccgtcactacggttcaagcggaaggcaccgccgcagacccggtcttcctcgtcagcggagaaacggaccgcgaggagatgattgaacggatcaaacacatttttcaatgggaacagccgcttcagcctgtgcttgatcatttctcaaaaacaaatctgtcggcgctttttgaggagcatgcgggaaccccgctcgtcttggaatatgacgtctacaactgtctcatgaaatgcatcatccaccagcagctcaacctgtctttcgcatttaccttaacggaacggttcgtccatgccttcggtgaacaaaaagacggcgtctggtgctatcccgagccgaaaacgatcgcggcgcttgattatcaggacttgcgggagctccagttcagcatgagaaaagcggaatatgcgattgacatttcacgcatgattgcagacggagcgctcaatctggcggaacttacccatttatcggatgaagacattatgaaaaagctgatcaccatcagaggcatcggcccgtggaccgtccaaaacgtcctcatgttcggccttggccgcccgaatctgtttcctttggcggatatcggcctgcaaaatgccatcaaacgccgcttcgcccttgaggataaaccgtcgaaagacgtgatgcttcaggtaagcagcgaatgggcgccgtatttaagctatgcgtccttatatttgtggagaagtattgaatgaaaaaccgctttgatcattttttggaaacttccagtgaaaaacatgaaggaaccgccggctgcatgttatactgaaaagatgtgatatttcaaatcagccgctttcccaggagaaaggctttatatagaaacggagagaaaaaaacgtgaatcaacatcaaaaaaaggcgcctgccgaattgaaaatcgggcagacatttccgctgaccatcaaacgtctcggcattaacggagagggcgtcggctattttaagaaaaaagttgtcttcgttcccggcgctctgcccggggaagaagtcgttgccgaagcgacaaatgtgcagccgaaattttcagaagcacgcgtcaaaaacatccgcaagccgtctgaacaccgcgtcacgccgccatgcccggtctacgaccagtgcggcggctgtcagcttcagcatctggcatacacccagcagcttcgcgaaaaacgcgacatcgtcattcagtctctggaacgtcatacgagattcaatgtcgaagaaatgaacattaaagatacgatcggaatggacaacccttggaattaccggaacaaaagccagttccaagtcggacgctcgcaaagcggcagcatcattgccggcttatacggacttgattcccataaaatcgtcccgattaaggaatgcattgtccagcatccggcgacaaacaaaacaacgggtatcgtccgccgtattttggaaaaacacaacgtatccgtttataacgaacggaccaaaaaaggcgatgtccgcaccatcgtgacgagagtcggttttgaaacaggcgaagtgcaggtcgtgcttgtcaccgcgaaagagacactgccgaataaagacgagatcgtcaaagccattcagaaccggctgccggaagtgaaatcgattattcaaaacgtcaatggcgcgcgcacatccgtcattttcggtgacaaaacaaaagcgctggcaggaagacatgccattcaagaagtgctcggtgacgtgtcatttgaactgagcgcccgcgccttcttccagctcaaccctgagcagacggtcaagctatatgacgaagtgaaacaagcggctcagctgacaggaaaagaaaaagtcgtagacgcgtattgcggcgtcggtacgatcggcatgtgggtttcaagcggcgcaaaagagatccgcggcatggacgtcattaaagaatcaattgatgatgcgaagaaaaacgccaaaaaacacggcatcaaaaacgcggcatatgtcacgggaacagccgaacactggctcccgaaatggacgaaagaaggcttccgtcccgacgtggtcatcgtcgacccgccgcgaacgggctgtgacagaacatttttagataccatcaaaaaagtaaaaccgaaacgcttcgtctacgtatcctgcaatccttccacactggcgaaagacttgcaggcgctgtcgaaagactatcgcgtcgaatatattcagcctgttgatatgtttccgcagacggcccatgtggaagctgtggcgaagcttgtgttgaaatcgtctaactaaaataaacaattcgtaatcagacctggatttcggtataaacatttccgatttccggttttttttatgcgcagcctttgccctggctgtttatcttccttcttttctcggagatctttaatttaaactgatgaaaagagttgaaaaaacgtgtggaaaagcgaggagaaaacagccaattttgacctcgtttgtataatgacgctgtggtttattgtgacattaatgggataatgtaaaataatttgatatcattggtttgagatgaagttgtaacattattcaactgtaaagtatttatcatgccaaagtaagtaggtctttaataaatgataaaaaggaggtgaaaccgaacgagagatattgagatttcaacaactgaacgaaggttctgaagtagaagctgtaaaaggcaagggtgctaactttcactaaatcacagcggcagttggcatatcaacaactgtcgataaaagatcaaatacactaaaaaagcatgtttggtcgttatatataatatgaaagcctaaacaggaaaaggaccccaactattcctcttgttctaaaaaaaggaataaatataaggcggaaacgcaagtgataacaactattacagtaatacctgcgatggttatatccttaataagtaattattgcgacaatcatgcttcatcatataatgatgttagattgacactaggctaaaaagtattgcagaaaaggaaatggataaagaaatgggtaaagtatataaaagaagttggtttcacacgttgttggcatttttagtatcacagctttattttaactttgtagaattaacgggatggggtcctaattatagagaaatgaatggattcccagcaaatatagctgaactggatttctttcaaacatatctttcattctatgataatccatggtttaatattgtcactgttttcttgggggttttcactgttatacaaatcattaaaggtataacaaagaatatccgaaatgaaagcaataacttctgatgccttatttaatgatgaaagaacatgaacactttctaattaatcttatgaatgaagactgcggcacttagtcagcagtctattttattggttttggatcaggattaccgaagcgtaaccttatacaaatatatataggtgattgtataaagatattaacatacggggtttaaaagccgatcaacccttagtacatatactgtatagagccaagccacttgcggcgttgattatttctagaccatgagtaaatccgaaaagatccagattgaagttcttgaattctgttaagttcgagtttattttcccatgccatcctctttactccatgtgattcacaagcggcaagttaaggctttttctttttacattcttttcagtactcagatatacccccagccccatttgcttaatcaacttatttcttgaaatttgttttatggtaatagggagaactcatatgatattctatttaggttggaatcctttttatccaaaaagagcaaaagtaaggccgctaagaaagatgaaggtcagcgctaatcttaataaaccacaatataaataaaaattaggtgtagataatcatcacactttttctctctcaaacccttttaaaggtgaaggagttgactgagttgatcagaaataaacgatatggggttgactatagcggtagtctattacgttagctcaattaatgtgttctactccagtttgcttttttacttttaacgtgtaaaaagtgaaatgttcaaaatttactatcgtttgataagaagtgctgacacatgctataagtgtaaaagaagcatggtcagtttttaattttgggataaaggtttcactgtatcccatcatgaaaggatttggatttgttatgacagataatttctggcgtgaattaccgcggccattttttgtactggcaccaatggaagatgtgacggatgtcgtttttcgccatgttgtgagtgaagcaggcagacctgatgtgtttttcacagagtttacaaactcagaaagctattgtcacccggatgggaaggatagtgtgcgcggccgtttgactttcacggaggatgaacagccgatggttgcccacatatggggagataagcctgaaaactttcgccaaatgagtattggaatggcggaattagggtttaagggcctggatatcaatatgggctgtcctgtacctaatgtggcggggaatggaaagggaagcggcctgatttgccgtcctgaagttgcagccgaattaatacaggcggcgaaagcaggaggtctgccggtaagtgtgaagacgagacttggctacacggatgttgacgaatggcgcggctggctgacacacatactgaaacaagacattgcgaatctttccattcatctgcgtacaagagcggaaatgagtaaagtagatgcgcattgggagttgatcccggaaatcaagaaacttcgtgacgagattgcgccggatacccttttgacgatcaatggggatattcctgaccgtgaaaccggcttgaaacttgctgaacaatacggtgttgacgggattatgattggacgaggcatttttactaatccgttcgcctttgaaaaggagccgagagagcatagcagtaaggaattgcttgatcttttgagattgcatctggatcttcatgatgaatattcaaaagcagaagccagagcatataaaccgctcccccgctttttcaagatatatctccgcgggttccggggagcaagtgaattaagaaatcaatgcatgaatacaaagtcaacagatgaagtgcgtgcattgctcgatgactttgagagaaagtatcttgatgggatggagcaagagtgacataaacaactcatcatccggcccggatttcggtttgaattccgggcctttttgtgtgcagcttttacccagacagatccatggccggtttcgtcatgcagaaataaacgaataatggtacattgataggagatacatcataaaggggagagaaaaatgaaacgactgtgcatcatcccctgcggcaagaaaaaaatttgggatgtccattcagatacagggccggtaagggcggaagacgcttatctcagcccgtttcatcaggcatgcgagcgatatgcgaaagcatttttcgatgagtgggtgattttgtcggcgaagcacggatttcttcgtccggatgatactgttcccggaaattacgatgtcacttttggaaccggtcacccggagatcatggcagcggacgagctgcgccgtcaattttatgaaaaaggcttttccgacgtcgaagagcttgtcatgcttggcgggaaaaaataccgaagcattctaaacgccgtcatcggagagcatcagcatatcacctggcctctgtcatcgtataaaggcattggttacatgcttcaagcactgaatcgggctgttgaagaaaaggatgaactgcagcgcgtggatatgaaaaaaagagtgtaaccactcaaacgccgtgatagactgtatgcggaagaatgaagcaataaaagatttccgaggaaataaatacgtcgatcattgtcaaagacagggtgatgcccggtcttttttgtatgccataaaacgagacaaagggaacggatcgagacaaaatgagacacctgtctcaaactgtctccattgaaaaaataaaaacattcattttacgggcttcaaaggctggcatgcttcttgcatttataagtgtgaaccctaaatagaaggaggcgcacaaaatggaattgttaaaacgagaaggcttgtcattaactgaggaaaaagcgctgtggatgtaccaaaagatgctggaaatcaggggctttgaagacaaagtgcatgaacttttcgcgcaaggagtgcttcccggattcgtccatttgtatgccggtgaagaagcggtagctgcgggggtgtgcgctcatttagatgatggcgacagcattacaagcacacacaggggacatggccattgtatcgccaaaggctgtgatctggacggcatgatggcggaaatattcggaaaagcgaccggactgtgtaaaggcaaaggcggttctatgcacattgcggatcttgataaaggcatgttaggcgcaaatggaatcgtcgggggcggatttacgctcgcatgcggatcagcgctcacggctaaatataaacaaactaaaaatgtaagcgtttgctttttcggggacggagccaataaccaaggcaccttccatgaagggctgaacttagcggcagtatggaaccttcctgtcgtgttcatcgccgaaaacaacggctacggcgaagccacgacatttgagtacgcgtcagcctgtgattcaatcgccgatcgggcggctgcctacaacatgccggggtcacggtggacggaaaagatattttagcggtttatcaggcagccggggaagcgatagaaagagcaagaaacggcggaggcccgtctttgattgaatgtatgacttacagaaactacggccatttcgaaggcgatgcccaaacttataaaacaaaggatgaaaagactgagcatcttgaagaaaaggatgctatccaaggctttaaaaactatcttctaaaagaaacagatgcaaataaattgtcagacattgaacagcgagtcagcgaatcgattgaaaaagccgtctcgttcagcgaaaagagtccttatccgaaagagtctgagctgttgacagacgtctacgtgtcatatgaaaaagggggaatgtgagatggcgagagtcataagcatgtcggacgcgatcaatgaagcaatgaagcttgcgatgagaagagacgacaatgtgcttgtaatcggtgaggatgtcgccgggggagcggcggtcgatcatttgcaagatgatgaggcatggggcggggtactcggggtcacaaagggtctcgtacaggaattcgggcgcagccgagtgctggatacaccgatttctgaggcgggctatatgggtgcggccatggctgcggcatccacggggctgagaccgattgccgagctgatgtttaatgattttatcggaacgtgctttgaccaagtgattaaccaaggggcgaaattccgctatatgttcggcggtaaagcgcaagtgccgatcaccgtccgcaccacatacggagccgggttccgggcagccgctcagcattcgcaggcgctgtatggcctgttcaccagcatcccggggctgaagacggttgtgccgtccaatccgtatgacgccaaaggtttgctgctggcggcaatagaagacaatgatccggtattcttttttgaagacaaaacgtcctacagcatgaagggcgaggtgccggaagattattatacaattccgctcggaaaagcggatatcaaacgcgaaggcagcgacatcacgctgtttgcggtcggcaagcaggttaataccgcgcttgaagcggctgcacagctttctgagaaaggcatcgacgccgaggtgcttgacccccggagtctgtctcctctagatgaggaagcgattttcacatcgttagaaaaaacaaaccggctgatcatcattgacgaagccaatccgcgctgcagcatcgccacggatattgctgcgattgtcgccgataagggctttgatttgcttgatgcaccgattaagcggattacagcgccgcatacaccggtgccgttttcgccggtgcttgaagatcaatatttgccgacaccagaccaaattgtcagcgtcacgcttgaattgcttggcgagccggcaatgaattaaaggagggatacagaatggctgtaaaagtagtaatgccgaagctgggaatggcgatgaagaaaggtgaagtatccgtctggaataaaaaagtcggcgacccggtagaaaagggagaaagcatcgccagcatcaactcggaaaaaatagaaatggaaatagaagcgcctgaaagcggcacgcttcttcacattaaagtcaaagagggagaaggagtcccgccgggaacgcccatctgttatatcggggaaaacggcgaagaagtgcgggagaaggaggcgccggctcctgaaaaagcagggaaaccgcaagctgaacctgaacatattcccgctccaaaagccgggcaaaagcgcaaacaccgcgtgaaaatatctcccgttgccagaaaaatggcggagaaagccgggttgaaagtcgatacgctgaacgggacggggcccggaggcagaatcgtaaaagctgacgtcatcaaggcgatgaagacagaagctgaaccgcagtcttcggttcagacagcacagccggagggaaaaccggcttcagcgatgagaaaagtgattgcagaccgaatgcacaaaagcctgcaaaacagcgcccagctgacgctgacgatgaaagcggacattacggagcttgtaaaatggcagcagcagctcgccgacagcgcgaaaaagcggagcggtgttaaactgacggtcacacatttcatatcccgggccgcggtgcttgcgctgaaacagcatcctgagctgaacagctcttatcaagaggagcggatcatcacctatccatatgtccacctcgggatggcggtttctcttgaaaacggtctcgtcgtgccggtgatccgggatgcggaaaagctttcattccttgagcttgcggatcacatcagcacatcggcacgccgggcgcgggaaggcaatgcttccggagatgatctccacggttcgacattttctattacaaatctcgggggttacggaattgagcatttcaccccgattcttaatccgcctgaagccggtattctcggagtgggcgcaagctatgaaacgccggcgtttaaaggagatgagcttgtcaaaagcatcatgctgccgctgagtcttacctttgatcacagagtatgtgacggcgccccggctgcggacttcctgaaaacggtcaaagcgctgcttgaagagcctgccggtttgattttatagagagaggtgaaaaaatgaaactagccattatcggcggcgggccggccggatatgcagctgccgtgactgccgcgcggagaggagcagaagtcgttctgatcgacaaagggccgctcggaggcacttgtctcaatgaggggtgcatcccgacaaagtcgcttttggaaagtgcgaatgtgctcgataaaatcaggcatgcaaatacattcggcatcgaactgccgcaaaacattacactcaattggaaccgcatgcaggggcgcaaacggcaaatcgtcagccagctcgtgcagggaattcaatacttaatgaaagcaaatcagattaaagtcatcagcgggacagcctcatttctcacagagcagacattgcttgttgaagaagaaggaggcgcaaaagacattctggaagcggaccggatattgattgcatccggatctgaaccggcggagctgccgtttgccccatttgacggcgattgggtaatcgacagcaaagatgcgctttctttacagaaaatcccttcgtctctgctcattgtcgggggaggtgtgatcggctgcgaatttgcctctttattcagccggtttaaaacgaaagtgacggtgattgaatcggctgaccggctgctcccggcagaagacagggaaatcgccgccgttttcgaagactctttaagagacagcggggctgatattcagacaaaagccgcccttcagcggattgacaaagaaaggaaaaccgccgtgtggacaaaagacggaaaagaaattgaagctcaggctgatcacattttggttgcaatcggcagaaaaccgcgtttgcaagggctgaatttggatcaagccggcatccggtattctccgcgcgggattgaagtcaatgaccatatgcagaccaatgtgcctcatatatatgcgtgcggcgacgcggccggaggaatgcagctcgcgcatgccgccattcatgaaggaatcacagccgccgcgcatgcctcgggaaaggatagcaaagtcaatatgcgggcggtgccccgctgtatttatacatcgccggaaatggcagctgtcgggctgacggaaacacaggcgagagagacatacggagatgtgaaaatcggagaatgctcattttctgctaacggaaaagcgttaattaagcatcagcacggcggcaaaatgaaaatcattgccgagccggaattcggagaaatcgtcggggtgtcaatgatcggaccggacgtgacggaattgatcggtcaggcggtcatgatgatgaacggtgaaatgacggcggatatgtcggagcactttatcgcggcgcatccgactctgtcagaaacgcttcaggaagccctgctgaatgtcaccggacttgcggtgcattccgtataaccggaataccctttctcagatgagaaggggtatttttcgttgaaagcgctttacttttcccctacaatatatgaaaagatggtctgaacaggggggagcgaatacaatgaatgtcattcggaatgattttaaaacctggaagcgctttgtgaaagaaggcgtgctcgatgaatcccgtattcagaagcgggtggccgcctcatggcaccgctgcaaaaaagccgacgtcaacccttatctagaaaagggaccgaatgtaatgccggcagatcatttagaaaggcaggccgaaaagcatgcgttatttttagcggcctcaatgccgcacgcagaaagaatgaaaacagcgatgcgggaaatggaaatgatggttctcctgattgattcagacggcgttgtccattcagttgacggccacccgcgcaccattcatgaagcgaaccgcatcaatttcttaaaaggcgcccgctggacggaaacggccgtcggcacgaatgcgatcgggacggctctttatacaaatgaaccggtcatgatacacggctctgaacattattcgctcgcttctcatcaatggagctgttccgccgcgcccatccgttatgaagacgggcggctggcgggtgtcattgatatttcctgccccgccgcccgcgctcagccttttatgctcggaattgcctcctccatcgcttatacggcggaacgggagcttgccctaaagatcaaaatgacagaacttgacatgatcagcaaattcgccgggcttacccggtctcatgatccgatcgtgctttgcaatgaaatgagccgggttatcgccgcaagccgtcccgttcagcattttaccggacatatgctgcgcgagcttgaggaacagggctatcatatcaagcggacgaagcgggaggagaacggcttcacatgcgtttacttatccaaacgggaagaaaagccgtcgtttatatttcatggtgcggcaggcaaaagcccgtcatcccgacatatgcttgagcagctggagcttgtcgcccgaacggacgcaaccgtttgtcttacgggagaaaccgggacgggaaaggaggttgccgcccgggcgattcataacaacagctccaggaaaaacggcccgtttatcgctgtcaactgcggagcggtccccgaaaagctgattgaaagcgaactgttcggctactcggaaggcgccttcaccggggccaaacggaaaggacatagcggcgctttgcaaaaagccgataaaggcacgcttttcctcgatgaaatcggagaaatatcacactccatgcaggtggctctgttacgggtgctgcaggagcggaaagtcaccccggtcggcgggacaaaagagattcccgttgacatcagaatcatcactgccacccacactgatctgagacagcttgtcgaatgcaaaaagctgagagaagatttattttaccggcttcacgtctgtccgatccacctccctccattaagagaacgcaccgaagacattcccggactcttccttgaatttcagcgaaatcgcggctggcggggggagcttcctgttgactttttagacgtattaaagagccggaaatggccggggaacatcagggaattgtttaatgtatttgaacgtctttccgtcatgttcccggacggacggctgtcagggcgccccatcgcagccctgcttgaagcgtcaggtcttaaagaagcggccgagtcttatgaacaggaagaagcgtcctctgtctccatccgggagcacattcagaaaaacatcatcgtaaacgcgcttgaatcagcgaaggggaatgtcacgctggctgctaaaatggccggaatcccgcggagcacgttttacaaacgcctcaaaaaattcaaactcaccgccggacaattgtaagaaacaagcatacttctcttgggtgccggacacgttatgtgtgaggactaaaggaggtttgagacgtgaatacacagcgtgcgaaagacatttcggaatccgccgccatggcgtatgtgacgtatgaaggagtcccgatttatattcagcatgtcaacgaagacaaggaaacagccaggatttttccgatcggaaatccacaatttgagcaggaagtgctgctttctgatttacaagagcatttttgagaaggggtctgctgatgacagcaggcctttttcgtacctgtgggaactttcccgctttttgagaaaaataactaaaaatgatcaaatgatctaactccttcaaacccggtacagatcggaccttctcatgatataaataaaatgtaaacgttatcagaggagggcttcacatgacagacaaatcattctcaatcgttattgcaggcggcggcagcacatttacccccggaattgtattaatgcttttgaatcacctggaagagtttccgatcagaaagctgaaactttatgacaatgataaagaaaggcaggagcggattgcgggtgcgtgtgaggtattcataaaagaaaaagcgccggacattgaatttttggcgactgatgacccagagacggcttttacggatgttgacttcgtcatggcgcatatccgcgtcggaaaatatgcgatgcgcgcgctcgatgaacaaattccgctgaagtacggcgtggtcggccaggaaacatgcgggccgggcggaatcgcatacggcatgcgctctatcggcggtgttctggagattcttgattatatggaaacgtactcgcctgacgcatggatgctgaattactccaatccggcggcgattgtggccgaagctacacggcgcctcagaccgaattcaaaaatattgaacatctgcgacatgccggtcggaattgaggatcgcatggcgaacatcctcggattatcttcacgaaaagaaatgaacgtccgttactacggcttgaaccactttggctggtggacgtccatcacggatcgagaaggcaatgatttaatgccgaagctgaaagagcatgtccgtgaatacggctacgttccgaagacggaggccgaacagactgaagcaagctggaatgacaccttcaaaaaagcgcgcgacgtacaggcggctgatccggatacgcttccgaacacatatctgcaatattacttattcccggatgatatggtgaaaaaatcaaatccgaaccatacgagagccaacgaagtcatggaagggcgcgaagctttcattttcagccaatgcgatatgattacgcgcgaacaatcatcggagaacagtgaaattaaaattgatgatcatgcttcctatatcgtcgatcttgcccgggccatcgcttataacaccggggagagaatgctgttaatcgttgaaaataacggtgcgatcgcaaactttgatccgtcagccatggttgagattccttgtctcgtaggttcaaacggaccggaaccgctctcagtcgggaacataccgcaatttcaaaaaggcctgatggaacagcaggtgtctgtcgaaaaactgacggctgaagcgtgggaagagcggtcatttcaaaagctgtggcaggcgctgatcctgtcaaaaacagtgccgaatgcccgtgtggcaagactgattcttgaagatctgatggaggctaataaggactactggcctgagcttgatgtaagcccgtctcctatttcctgatgacaatcttccccgttttctttatctgttattctatataatagaaagaaaacggggggatttttgggatgagtcttgaagaactggttaatcagcattacgcgaaattaaatgacaacgatttttatattttaaaatatatattgaatcataaacatacgtgctaccatctcggtatcaatgacatggcgaaagcctgtaatgtctctcggtcttccatcctgcggctcgcccaaaaactgggcttcagcggctatagtgaattccgtgtttttctgaaatgggaggatcagcctgaagagggcgagaatatgacgtttgaaaagctgctggatgatattgaagccaatgtaaaatacgtgaagtcaaaagatatgacggagatgtgccggctgatagatgaagcaaaacggattttcgtttacggatcggggacggctcagagggtgtgcgcccgtgagctgcagcggatgtttgtatcccggcggaagtatctgattttaattcaggacatcacagagtttaatatcatgtgtgatgattttaaggttgatgacgtattcatcattatttctttatcaggcgaaacacccgaattaattccgcaggtaaggaccctgtccgcaaagggagttccgtttatttcaatcaccaatctgaaaaacaacgtactggcgcaaacgacgccgtataatctttatgcgaccagcaagccggtgacgttaagcgataaaacggaaatcgtcgcatttgccccgttttttctggtgggcgaagcgttattccgtgcatatgttgattataaagagctcgaaaattttgataaatagcgggaggtcacgtgaaatgatgcaaaaagtccagcgcttcggcagcgcgatgtttgtgcctgttttattatttgcattttccggtattattgtcggtctgagcacgctgtttaaaaataaaacgctgatggggccgctggctgatcctgacgggttttggtatcaatgctggtacgtcattgaacagggcggctggaccgtctttaatcaaatgccgctcctgtttgcgatcggcatccctgtcgccttagcgaaaaaagcgcaggcgcgggcttgtttggaagcgcttacagtttatctgacattcaattactttatcaatgcgattctgacggtttggggcggggcttttcatgtcgatatgactcaggaagccggcggaacgagcgggctgacgatgatcgccggcatcaaaacgcttgatacgaatattatcggcgccatctttatttcatctattgtcgtgtatttgcacaatcgttactttgataaaaaactgccggattttctggggatttttcaaggatcttcctacatcgttatcatttctttcttcattatgataccgatttcacttgcggtggcatacgtatggccgatggttcagtccggaatcggatcgctgcaaagttttctcgtttcttccggggcgatcggcgtgtggatttacacattcctggagcggattttaattccgaccggcctgcatcattttatttactcgccgtttatttacggtccggctgtggctgaaggcggtatcgtcacctattgggcccagcatctcggggaatactctcaaagcgtcaaaccgctgaaagaattgttcccgcagggggcttcgcgcttcacggcaactcgaaaatcttcggcattccgggaatcgcgctcgctttttacgccacggcttcaaaggaaaagaaaaaaatcgtcgccggccttttgatcccggtcaccttgacgtccattgtagcggggattacagagccgattgaatttacattcctttttatctcgccgtttttatttgcggttcatgctttgcttgccgcttccatggcaaccgtcatgtatatggcaggcgtcgtcggaaatatgggaggcggtttgatcgaagctgcgaccttgaactggatcccgctggcgtcaagccacggtttgacgtatgtataccagatcatcatcgggctgtgttttaccgctgtttactttttcgtcttccgtttcctcattctcaaattcaacatcgccacaccgggcagagaaaaagaggaagggcaggaaacaaagctctattcgaaaaaggagtacagagaacggaagcaggcttcaaaagaaacggctgcggcagacgaaacacagcgggatacagccgctttgtatattgaagcgttgggcggaaaggacaatattacggaggtcaccaattgcgccacccgtctccgcgtcactgtcgctgatgaatcaaaggtcaaaagtgacgccgatttcagagagctgggagcccacggcgtcgtcagaaaaggcagggcgcttcaggtcattgtcggattaggcgttccgcaaatgcgggagcgcattgaacagcaattggatcaataaggtcaaaaccttcccctccccgggaaggttttatctttttcgcagattattgaaaaaacggcacaccaaatttctttattcatttgccggaaaggcataaaataataatattgaacaaaggatttggaggcttacacatgtcaaaggctttatcatatgtaaaaccgtattcccttttggcgggaatcgctctgtttttcatgctcatcgagcttgcggtagagctgatacagcccctgctgatcgggaaaatcattgacgaaggaattttaaagcaggatctcggtacggtttggctgtggggcggggtgatgatcggactgaccgctgtttcattcgcatcgggaattttaaattcattctactccgcccacatcagccagagctatgcgtatgatacgcgaaaagggctttttcaaaaaattcaatccttctcttattcgacgtttgcgcaattctcatctacgtcgtttatcaccaggctgacaaacgatgtgacgcaggtccagaatatgcttttcatgagtctccggtttatgctcagggcgccgttaatgattgcggggggcattattctctcgctgaccgtcaatgcgaaactcggtttttttctgctgatcacggtgccggttttgcttttgtttttgctgtgggtgctgaaaagaggcggcgcgctgtttcggtccgtgcaaaagcggcttgatcaggtcaacacgatcatgcaggaaaacctgacggcgatcaaactgattaaagcgctcctccgtgcaaaccacgaagtgaaacgttttttgaaatcgaatacgaagctgatggaaaaaacggtttccgcttttcgtctcgtggaagcggcgatgccgattttaatgctgctgatgaacagctgcattttgtttatcttatggttcggcgccaaaagcattgctcagggcggagcgcaggtcggcgatgtcgtttccgtcattaactatgcgacgcggattacaggcgcgctgtccgtcctgccatttctcattatggtattttcccgggcgaaggcttccggggaaagaatcggcgaggtgctggaaacagaaggcggcgagggaacggggcacgacccggcgcgggcgcttgcaggcgggattgagtttcgcgaagtgtccttccgctatccggacatggaaaaagacgcgctgcatcacgtgtccttttcagccagcccgaaagaaacggttgccattatgggcgcgacaggttcagggaaatcaacgctttttcagctgattccgcgcctgtacacggctgattcaggcagtattttcatagacggcaaaccgatcggtgaattctccgcttgcgggctgcgcagggaaatcggctatgtgccgcaggaagtgcttctgttttcgggcacaatccgtgaaaatatcgcctggggacgggaggaagcttcactagatgaagtaatggaagcggccaaagacgcgcaaatccatgacacgattatgaagctgtcaaacgggtacgacacggtgctgggacagcggggcgtcaatttgtcaggcgggcagaagcagcggatttccatcgcgcgcgcttttatcagaaagccgtccctcctgctgttagatgacagtacgagcgcgctcgatcttcaaacggaagcgaagcttttacaagcgatcagatcctatgaatgcacgacactgattattacgcagaaaataaccaccgcgatgaaggctgacaccatcttattgcttgaagacggcgaattgctggcaaaaggcacgcacaaagagctgatggcacagtctcatctgtaccggcagatttatgaatcacaattcggaaaggagggagctgacagtggagaaagacattcgtaaacctttccgatatccgaaaataccgctcaaatcaaatgaaggcggcagaaaacgcgcgaaagcaaaagatacaaaaggcacgctgcgcagaatctggtcgtatgtagccgagaaaaaagggcttttaacccttgtgatcatcatggtagtcataagcgccatattcggcctgctcggaccgttcgtcatcgggaaagcaattgatcattttatcgtcggacggacgacggacggattggcgggtgtactgttcatactgtttgggatttacctcgtgcaatcattgtccttatggtttcaaaactattggatgatcaatatctcgcaaagcaccgtgtttaaaatgcggagcgagctgttcacccatctgcatgagctgccgataccgttttttgataaacagcgcctcggcgatttgatgagccgggttaccaatgatatcgaaaatgtcagctccactttaaatacatccgtcattcaagtgctgtcgagcgtcattacattcgtcggcacaatcgccgtcatgctgttcatgagcccgcttttaacattgatcacgcttttgattattccgatcatgcttttgagcattaaatggatcaccaaccggacgggactcctgtttaagcagcagcagaaaaacctcggcgagctgaacggttttattgaagagtcgatatcaggagcgaaggtcattaaagcctattcgagggaagaccgcgtcatggagcaatttttagaaaaaaacgcggcgttacaatcatcaggcttttgggcgcagacaatttcgggattcattccgaaagtcatgaactctttaaacaatttaagctttacgattatagcggcggtcggcgggctgtttgcgctgaaggggtggatttcgatcggttccattgtcgtattcgcagaatactcgcggcagttcacgcgccctttaaatgatttggcgaaccagttcaatacgatgttatcggccatcgccggggctgagcgggtgtttgacgtgctggatgaaaaagaggagcgggaagatgaagagcatgcgacgcaccagccgatcaaaacgggagagattgaattccgagatgtctccttcggctatcaggaagacagcccgatcttaaaacatctgtccttcagcgttccgaaaggacagtcaatcgccttcgtcggaccgaccggagcgggtaaaacaaccgttacgagcctgatcgcccgtttttacgagcccaataacggaaaaatcctcattgacggaacggacatcaaaaaactgacgaggtccagtctgagaaaaaacatggggtttgtcctgcaggattcctttctctttcagggcaccatcagggaaaatatccgttacggccgtctggatgcatctgatcaagaggtggaggcagccgcaaaagccgccaatgcccacggattcatcgaacggctcccgaaaggctacgataccgtccttacccaaaacggcgcgggcatcagccaaggacaaaaacagcttatttccatcgcgagagatgtgctggcggatccggtgctgctcattttggatgaagcgacgagcaacattgatacggtgacggaagtgaaaatacaagaagcgctcggccgtttaatggcgggcagaacaagcgtcatcatcgctcacaggctgaacacgattcaaaaagccgatcagattcttgtgctgaaagacggcgaaatggctgaaaaaggaacccatgccgaacttctcagccagaacgggttttaccgggaattatatgagagccagttccgggaatcataggtagggaaaaagacctccgacagagtgcggaggtcttttttttgcgaagacaaatagtacttttaagttattttcgttaaatgtaacaaaattacttgacgtaaataagttatgtatatatactagcttacataaagtaagtgataataattttcaaggaggattttatgaataaatcattcgaaacaggaacactgcttttaagggttgtaacaggtattatcttttttgttcacggtttatccaagtttcaagggttggaaggaactacgcaatttttccagagcatcgggcttccggcctttatggtctacgtcatcgcgacgattgagcttgtcggcggggtactgatctttttcggtttggcgacgcgcattatcggcgttctgtttgccgtcacattagtcggcgccatcttcacggcgaagctttcctcaccatttatgggcggatcggaatttgatttcatcttactggttgcgtcaattcacttagcgctttcaggaagccgtctgctttcattggatcagctccttttcaaatcaaaaaagggagaaactttttcagcataagaaagaaggcgttcaaatgaccggcattcatcaagatacagcaatcggttatgtcaaattgacgattaaaaatatggaacgctcgctcggcttttatcggaatgtcatcggccttcaagtcatctcgcagacagatcgttctgcagaactgtcagcagacggaaaacgcgtcctgctggtgcttgaagaaaatccgagcgccgtcgttctcccggagcggtctgtcaccggcctttaccatttcgcgatacttctgcctgaccggaaagaactcggcatcgcattggccaggctgattgaaaacggcatcgcgctcgggcagggggatcacgcagtcagtgaggctctttacttgtctgatccggacggcaacggcattgaaatatacgccgatcgtccccgcagcacgtggcgccgggatgcagagggcaattacgtcatgcaaacggcgcccgtcgatgtggacgggcttttggaagaagccggagctgaacggaaaagccgtctcccggaaggaaccgttatcggccacatccatcttcatgtgacggatttacaggaagccaaagcgttttacaccgatatcctcggttttgacattgtcggcaattacgcgggcatgtccgctctgtttgtttcggcgggagggtatcaccatcacatcggtctgaatatatgggccggaaaacatgcgccgccgaaaccgggaaatgcaagcgggctggattattacaccatcacgctgccgcatcaaaaagagctgtcacgtgtgacaaaagcgctgaccgatgccggctttgagatcgaagaaagagaagagggcgtattcgtcaaagaccctgtatcaggggcggatatcgcatttacactgtaagaaacaacccttgccgtctaaccggcaagggtttttatttttctaaaggctcgggaaagaagaacgtcgatttgcaatatacacccggcttttgtgtgactgaagagagcgaacatctcagtgaggcgcaaacatgacgcgtggagcccgccatcgccggcccgaactcagggcatccgctggattgaaaatgggtgtccgttcggcggatcagggagctgtatgggcagactttgaatagaaaaagggaagagccgcatccggtcacaagatgcggcttttcatatacaatttacaattgtgtgaaaaatgcccaaaataaattgtacttcctgattcttcctgatatgataagccgaaaaaggagaacctccacaaatgaattcaaatgcagcacagacggaacagtctatgaagcataacggaaaccggatgacgttcaaggactttatcattcttgccaaaccggggattatcatctcaaattcactcgccgcattaggcggattttggatcgcgtggcttcagtcggaaaggacggacggagggcccggtatatttgccgccatggcggctgccatgatcggcacggcgttagtcatggcgtcaagcactgtttttaataacttctttgaccgcggcatggacgcaaagatggagcgaacccgcacccgcgccagcgtcacgggaagaataccgccgacggtcatggtcctgtacggcacatgtctcggcgtatgcggattcatcatgcttgcttcgcttaatgtactgaccgccgttcttggcctgcttgcatttttgctgtatgccgtcgtttatacgctttggtttaaaagacaatccgtctggagcacatttgtcggcagctttccgggggcggctccgcctttaatcggttattgcgcgctggccgggtacattgatatgcccgcgattttgttatacgcgattatgtttttgtggcagccgccgcatttctgggcgatcggaatcaggcgaaaggaagagtatcgtgccgccggcattccgcttttgccgatcataaaaggcaatcgcgtcacaaaaataaaaatgctgcgctatatcgccgttttgactgcggtttcgctgctcgttcctctttatatagacgtcagcccgttttataccgcgtccgctctcctgctcggggccatctggctgtaccggagcgtcaaaggctttcaggcggcggatgacacgcaatggtcgaaggggatgtttttttattcgattgtttatttcagtctgctttttcttattttaatggctgattcgtttatcaatgcggtcctcagaacgtaaacaggcggcctgcagatacagagccgccccgttttgtttatgcttttttgatgagagccaaaatatcttcaagccaggaaatataattccgttcccgctcaagcgcttttgtcagcacgagataatggccgaaatcaggagaagaaaatgaatccgcctccgcggacgatgtcatcagttcttgataactgttttccagatcggacaatttctcctgccgctttacgagctgatcggtgaatagctcatccgcttcttcctgcgtcaaagctgagatgaaataagccttcagcataaattcatccttcaccgtttccggaatcgggtcttttttcgtcagccaggcagcaagctccagctctcccttgtcagtcagcgtgtacatttttttctcaagcttcgttccttgaatcgcagtgcgaaacgtaataaatccctcagccgtcagtttttttaattccggataaatctggctgtgctttgcgctccaaaactggccgagctcttccttaaaatagctcgatatatcatatccgctcaattcgccttttcgcaaaagccctaaaatcgcgtactttaaaattctcatgttgtcctccaagcccattcatttgacagctagtataccatacggccgctcaaaaacgcagaagcaccggatgcttatcattgaatccgcggcgccaaaatcagcaaaaatatgcagaaaggggttatcgaaacggcagcagaactggaaaaagcctttctcgtgtctttgcctcattcatatgacatcatgatataatcattgtaaaaattaataaatactgggagggacatatgaagacggtgattgtgtatgcaaacccggatgagaacagtttcaatgcggctctcgtaaaatacgtcgccatggctttaaaggacagcggccaaagctatacggtcattgacttatacgccgatcaatttgatcccgtgctgaagtacggcggcgaaaaaaagcgctctgacatgaaccgggacgctgaaacgaagaaataccggaaactgatgaaagaagcggatcatctcattttcatctacccgctgtggtggggaggcgttccggcgattatgaaaggcttttttgacagagtgcttgtcgccggagaagcctacacatatgaaaacggccgcgtaaaaggactgctccgggcagagacggcacaggtcttttatacggcggactccccgggctggtacttaaagtggttccggaaaaactcggactggattacgctgaaaaaaagcattctgcaattttgcggcattcaaaaagccgagcggaaccttttttctgtcgtcagaacgagcacacccgaactgcgggaaaaatggctgcgccaagcatacgccaaagtccggcgcgcttgtgaaaaaggagcggccgcatgcagataaaagaaattttcgtgattcgctgcctgtcctgtttaagtgtcgttctgcttcacgcagtttcaatggtgctgatgattcaggaagagtccttagccagtgccgcccatacggttgatgcgtttcggaccctcttgatgttcagcacgccggcgtttatctttatttcggaatttctgcttgccaggtcatacccgaaaggcgttccagcgggttttttaaagaaaaggggcaaagtcattttcgtgccgtttctgtttattgccgcggtggatgccattttaatgaaaagcgtggcggaagaaggagccggattcgtttcagtgatcggtaaatttttagaaaatgtgtttttaggaaacttcatcggctacttcattcttgtgatctttcaattttacattctccatatgctgctgcaccgctggctgaacaacacatcccccgtgtgggtgctgtctgtttcgtttatcatcaacgccgtctatctggcttacttttccatctttcatccgccggcatcatcggggcttgattctatttttccgttcttttgggttccgtttccgggctgggtgttttatttctgtctggcattttattgcggaaaggaatatccgcgttttttatcgctcatcaatcagtaccgttatgcggtttacttcagtgcggccgtatcggcaatattgattgtggccgtttcatatatcagcggcggctccatttcctctaagcgtccggatattatgatttacgcggtcagtatgatctttctgtgttttcatctgttttcaaagctcaaaaaagtgcccgcgattgtgatgatgatcagcaactattcgttttcaatctatctgctgcactcctactttttaatcagcggatatcttctggaaggctatttgcggtcaatgcctttagcggctgccatccttcttttatttttgatctgcacgctaggtcccattttcgtatcgtgggggtgcaaccatttcagatacggatacctgtttgtcgggaaagtgtatcagccgaagcagaccaaaagaaatacggcggcgcatcaaggccgcacagtctgaaaaaaaggcggcgcttcggccgcctttttgatacgggtccgctttatccggcacgaggacggatagttgtacatcctgcatacaaagccccgcctgcggctgttttgacggatgcatttatgacaaaataacgccaccgattttctcccttgtgaagaccgatatattgtatacttataggaaatactttcaaaaaaagtgaaaaagagaaaaactgtgagcttggatgaacgactaaaaaggagcggggacattatgaatgactgtgtcaaaacattcggagaacttccggccgaactttattcctttgcgggaggaaaaggaagcattctctctaaaatgtatcaaagcgggtatcctgtgcctgaagggtttgtgattttgccgtcagcctttcaggacggacagctccgccatcaggcgagagaggctgttgatcaatatgtgaattccatccgcagccgccatgcatctgcgttgtttgccgtacgctcatccgcgctgagcgaggattccgctcaggcttcctttgccggagaattcgatacggtgttgaatgtcagaacagatcaagacatgtccagggcgattgatgaagtccgccggtcggtacagtcagaaagagtaaaagcgtacagcgccgttcagggaatggaagatgagcatgaaatcgcaatcgtcatccagctgatgataccgtctgagatatccggagtgctgtttaccgcagatccgattacggggagcaggcgggagatgacaggcaattacgtctacggtctcggggagcagctcgtttccggggaagccgatgcctattcttttaaactggcacggcccaagaaaaaatatgacggccccggggaatttcgcaaatatgcgtcaaagctctataaactggcgaaaaagctggaaaaagatcttggagggccgcaggatattgaatgggccgccgcgggcgggacattgtatattcttcaatcccgcccgattacgaccttacaagccggaaatctggaaacctatgaatggaacgattctttcagcggtgattttttatggacaaacacaaatataggagaagcgattcccgatgtgatgacgccgctgacatggtcgctcctccggaatctggatgaagagtcgggcatcattccgggctattatgtctggtccggcaatatttgcggcagagcctataacaatatgagccagcctctttccgttctcgccgctttcggtctgaatccgaaaggcggaaaaattggaaaaatgatgagcgatacattgggagaaatcccggcggaaatgaagatacctttatatccgttctcaaagtatgaattattgaagatcatcccgaaaaaactgaaaccgtatctgtcgaaaatgaagcaagcgaaaaaaacatgtcctcctacttggacgaatcaccggagtggtgccggaatattgaggaaaagctgaaacgcgccgaaacggagcaggcattattagcgatatggaacgatgagatctatccgtatttatgcaacgcgtggtttgcgttaatatccggcgggcgtgattctgcgcaatcctcttcgtcgttaacctctcaattaacaaaactcgcaggcatagaagatgcgaatctcctgctttccaatctgaggggaaaaggcggactggccagcctggagccgattatcggcattgatcaagtcatgaaaggccgtatgagcgaggaagaatatctcaggaaccagggccaccgtggcccgcatgaatacgaactttccataccgcatccgggagaaaaccgggattggctgacgaagcagatcaaagaacacaaggagtcgggtattgatgccgaacaactgcttttgaaacagcagcgggcgcatgaacaggccttccgaagatttgaaaaaaagtttcctcataaggtcaaatggctcaaagccaaaatggaaaaagcgtcagaatacgcgaatattagagaaacaaccagatccgaatttgtcagagtgtaccggacagccagagcattcgcgctcagagcggcggaaatgaccggcatgaaggacgatattttcttcctgtatctgcatgaaataaccgatctgctcgcggggaaagagccggcggttgcgtcgattcaagcgagaaagcaaaactatgaaacctataaaaaactgccgccgtttccatccgttattaacggaagattcaatccgtttaaatgggctgaggatcctgacagaagagcggattattacgatgcttttatgcctgcggaaacggatgatgcgcatactttaaaaggtttcgcgggagcggccgggagagtggagggcattgtccgtgtccttgatgctccggaagacggtgattcttttgcggcgggggaaattttagtgacgtcgacaaccaatgtaggctggaccccgctttttccaagagcggctgccatcataacggacgtcggcgcccctttgtcccacgcggcgatcgtcgcccgggaactggggattcctgccgttgtcgggtgcggaaatgcaacgtcaaaactgaaaacgggggacagggtggccgttgacggcgggcaaggcatcgtccagctggaaccgcggcagactccggtcacttctgaagaggaaaatggtaaactgatagaatagaatcatgagaaaggagccgcgcatgaataaagcagttattaacggggagcaaatcagaagtatgagcgacctgcaccagacattgaaaaaggaacttgcccttcctgagtactacggtgaaaaccttgacgctttatgggactgtctgaccggatgggtggagtacccccttgttttagaatggagacagtttgaacaaagcaagcagcttacagaaaatggcgccgagagtgtgcttgaggtctttcgtgaagcgaaagcggaaggctgcgacatcaccatcatactttcataatacgagcagcgggagagagacaaaaatggaaaaacaaaccctcagccatccgattggagagtatcagccggctgaatcgatttcggccggacagaaacaagaatggatcaatgcgctggaacacgctccggctaaactgaaccaagctgtcagagcgatgtcggccagtcagcttgatacgccgtaccgcgaagggggatggactgtccgccaagtggttcaccatctggcggacagccacatgaacggctatacccggtttaaattgagcttaacggagaatgaaccggaaatccgtcctatgatgaaaaaggctgggccgctcttcatgattccaaaaccgccgcttgcggggatgcgcttgagctgttaacgatcctgcacagaagatgggccgctcttttgcgctccatgacggaagcccaattcaaacggacatacttccatcctgtatctaaagagacggttacgctggaacaggcgctcgggctatatgtctggcactctgaacatcacatcgcccatattactgagctttcccggcggatgggctggcatctgtcttagaggatgccggcttccggaaaaacgccaaaacagccgcagacacaatcgtgcataatgaaatgacggcggctgccgtataaagatggtggtagccgctggaaatgcccgcttcaatcgcatcagaaaccgcttttttgacggcgggaacggggattcggcttacctgctcctgcaacgaagaaagtccgccgccgatatcgggcgtttgcgcctgatcagcgggaatgccgcttttcgttaaacggtttttaatgtcctctccgatccggtcaaagcccgctgtaatgaagccggcatataaagccggagcgagcgtcagcccgacctgtcttacgagtgacagcgtgccgagcgctgttcctttgttttggcccgccgtttctgatacaagcacattcagcggagccccgagcagaaatccgaaaccgatccccgcaatgacactcgccgtgacaaattcccatttatccgtcacccataacggaaacaggctgaagcccgcaaaggcgatggcgcctgatacaaccgcggagaagaccggtccttttttatccgtgaccgccccgccgagccacgctccgatgcctgacgccaacgcaagcggcgtcatccaataacccgctttctccgccgatacgtgtaaatattgctccgcataagaaggaataaaaatgaccgcagcgagcagccctcccgataaaaatccgatgacaagcgtccattgaaacactttattttgcagcagcgagtaggcgagaatcggatcgcccccgcggtattcaacccgcttttcgaccttaagcagcaccagaaagagaagtgccgctcccaaaagatacccatacacctttacgtccattatgctttctgacagcttcgtcccatcgagattcgtgataccgatcatacaagataagatcgcaagagacagcagcattgtgccggcgagatcaagccgtttcgcctcaggctctttcgtttcagcgataaacaaaccgccgcacacaaccaaagcggcggcaatcggcaggttaatcaagaacagccaatgccacgatccggttacatcaagcaaaaagctcccgatattcggtccgaggacggccgccataccgttcatcgcccctaaaagcccgagagctttcccctgtttctccttcggaagcacggccagcacatgcgaactcccgattataaaaattccgccgccgccaagcgcctgaatgagccgtgccgccaaaaacatcgggaagctctgactgagtgcgacaagcaaagagccgagtccgaacaggccgacttccatcataaacagttttttccgcccgtatcggtccgacagcttgccgacaatcggcacactgacactgagtcccaatgtgtaaagggtcactccccatgatccccatgaaggagaaacatcaaaagagctgttaatcgtcgtcagagcagcggaaataattccgttgtccagcgccgccatgaacacaccgatcgtaaaaagagtgatggcccggctctggtttttttctgtttgcaatggatccggcatactgatcaatccttccttttttaattcacttcgaatatattattcacttcaagtgaattaaatgtcaaacaaaaaaaggccgccgataccggcaggcctttttcatctctatgcctgtttggaagaatcaagggctcttgccaagatggcaagtccttgattgaccgtttgtttttcttcagcggtcagcgtttccaatgaacgcttcaattttacatgtcctttttgataaaggctgcggaaaatatctttcgcgttttccgttaattgaacgacgactgaacggcggtcttcttctgacggagcgcgtgtaatgaaacatgatttttctaaacggtcaaggagccccgtcgtatttgaaagagaagcgcccattttctccgctatgtcactcaccttaagcgtcccgtggttgttcagaagcatcagcaccttcatttgcggcatgctcatatcaagcttcatccactccgacacatcgccgagtcccgccgaggtcatcactttcatgtacagcacccaaatatcccgttcctcaggagaaaaaatatcgccgcctaataccgttgtatcatgcagattataatccatcgtctcacttcctcattcatactcctgcataccatattactgattttaatcagagaaagaaagttgcagacgagttttgtttgaatgtgaggtggtagtgtataatatgttggagattattgggggaattataataaataagctattttatgatgattggagagaacattgctgactaaaaagaatgccttatcgatattaaaagtattatttcctattgcagttttgcttttagtcatttatcagtccaaaaaggaattgacagacctttcttttaaacgaacgctgtatattattaacgggattgagcgttacgatttatttattctcgttctgctcggtctccttgccgtcagcgcgatgtccttttatgactttgtgctgaaacggacgcttcgcctcgacattccgaattggaaagtattcagggtctcctttatcgccaattcctttaacaatgtccttggattcggcggtctggcgggcgtcgggctgcggacgatgctttacaaagagcatacgaatgacgtaaaacgccttgtcgcaggcatcgcctggcttacgtcctcagcgctgctcgggctgtccgtcttcagtatcctgaccattgcccgcattctgccggtcggagagattacaggtgagaaaccgtggctgtgggctgtaatcgccggagtggcgcttattgtgccggcagccttaatcgccgcttgggtcaacaataaaaaagctcgcgcagaagacggtgaagcaaaaccgaggcatccggttttttcttacatcggggcatcgtttgccgaatggtttgcggcggccgtcgtcatgtattattccctgtatgtcatggggattcacgcggatgtccgccatgtattcggtgtatttgccattgccgctatcgggggaatcatcagccttgtgccgggaggattcggttcgtttgaccttctgtttctgctcggtatgcagaatatgggctttccgcaggaggcggttgtgacatccatcgtcatctaccggattgtgtattcatttattccgtttgtgttcgggctgttctttgcggccggcgatttaacggaaaatacgcttaaacggctggaatcaaatccgaagatggcgcccgccgtggaaacgacgaacgtgcttctcgtattccagcgcgccatcttaatcagagtgctttacggttcgctgtcgcttttagttttcatggcgggagtcgttgtgctggcatccgtcgccctgccgattgacagggagacggtcatcccgcatattccgcgcccggcgctccttgcgtttaacgcgttatcgttaagcgcggctttgattcttttaatcttgccgattgaattatacaaacggacgaaacgttcttattcaatggcggttgccgcgctggtcggcggttttgtgttcagttttttaaaaggattgaacatcagcgcgatctttattctgcctgtcgtcatcgtattgctggtgctgttaaagcggcagtttatcagagagcaggcatcgtatacgctcggccagatgatttttgcggccgctctgtttattatcgccttgtttaactacaatctcattgccggctttatctgggataaaatgaatcggctgctgcgccacgattatttcgttcataacaattcgcacattacatatgccacgatgacggccattattgttgtgccgctgtttttcctgttgtttacggtcttttatcataaaagatcgaagccgatcggagaaaaggccgaccctgaacggctgaagtcctttttggcggaagaaggcggaaacgccctcagccatctcggctttctcggggataagcggttttatttctcaagcgacggcaaagcgcttttattgttcggccagatttccagaaggcttgtcgtgctcggtgatccgtcaggacagagagactcttttccgcttgtgattgaggaatttctgaatgaagcgcataagcaggggctgagtgtcatgttttatcagatcgaacgtgaagatctggcgctgtaccatgacttcggctataacttcttcaagctcggagaagaggcgttcgtggatatggaagcatttacgctgtcaggtaagaaaaaagcggggctgcgggcgattaacaacaaatttgaccgcgaaggctacacatttcatgtcggggaaccgccgttttcctccgagtttatcgccaagctgaaagacatatcggacgaatggctcggaccgaaaaaagagaaaggtttttctctcggtttcttcgaccgggattatctggaacaggcgccgattgcttacgtgaaagacgcggaaggggagatcatcgcttttgccaacctgatgccgatgtatcaggaaggcgagatatcagtcgacttgatgcgttatcggaaaagtgcgccgaacggtattatggacgcgctttttatccgtctgtttctctgggcgcaggaaaaaggctataccacctttaatatgggcatggcgcctttgtcaaacgtaggaacggcttttacatctttctggtcggaaagaatcgcggccgtcattttcaacaacgtccggtatatgtacagcttcagcgggctgcgggcctttaaagaaaaatacaaaccggagtggcgcgggaaatacttggcgtaccgtaaaaacagatcgctgtccgtcacgatgattctcgtcacccgcctgatcggaaaaaccaaaaaaagacgccgttaaaaggcgtctttttttttgaagaattaactaaaaattctaattttactctgttatactgaataacatgatcataaggtgaaaggaaggctgatgaatgaaacaggcaaccgtgtttaaatatgaagcgtttaccgatattcctgttttgggaaatcccgcgggaatcgtctttaacggagatgattattcagatgaagagatgcagatgatcgccgaaatggcagggtacaatgaaacctcatttctctgcaaaagcggagaagccgatctgcgcatccgctattttacacccggccacgaaatgaatttatgcggacatgctaccgtcgcctctctttacgcattaattgaaaagggaaggcttcaggctgatcagacatatcaaattgagacaaaagccggtattcttcccgcaaaagccgctgaacgaaacggccgggtatacatcacgctcgaacaggcacccccgcaatttctgccgtttacgggagacaaagaaaagcttgcggcctcgctcgggattacggctgaggattttcacagcgagctgccgattgtttacggatcaacggggatctggacactgattgttccgctgagatcacttcaagcatcacggaatatggtgccggacaacgcacaattccccgctgttttgcgcgatcttccgaaagcgagcgttcatccgttttctctggaaaccgttcatccggaaagtgatctgcacggacgccatttttcttcccctttctccggaacgaccgaagatcccgtcacgggaaccgcttcaggcgttatggcggcctatatgcggcaatacggaggctctgaagccgaatgcctcacgattgaacaaggccaggaaatcgggaaagacggaaaagtggaaatcaggattacagaagataacgaaaagatgaaaatcgagatgacgggaacggccgtgtatgccgaatcaatcaattttcagcttccgtaacggtttacaaaagacggtcgtatccgttatattataaatgataatcattttcaattgaataggaaggtgaatcggcatgccgaaaaccgaacaactacagcaaaacgaaagtcttgcacatacaatcagaaacagaagatccatccggtcgtttaagccggaaaccgtaccttctgaagtcatattagatatgcttgaaacggccgtttacgcgccgaaccacagactgacggagccatggcgttttatctacgcagcaagcgaagcgggtaaagaaaagcttgcggacagctacgtctcatttttcaaaaaaataaaagatgatttcaacgaggaaaaagagcggaacatgagaaaaaacctcagcgccgttccgggatttttgcttgtcgtcttaaaagaagatgaaaatgaatttacgagaaacgatgatttcgcggcgctgagcggcatgattcaaaaccttcagctgctcgcacatgaaaacggcatcggcatggtctggaaaagcggccgcatcatgtatgacaaacaggtgcaccaagacttcggtctggcagacaatgagcgcttcgccgccatcattcaaacgggctatccggatgaacagcctaaggcgaaagaacggacgccggcaaaaagcctgtttaccgagttgtaaaaaaatccccgtctctatacagaggcggggatttcgtattagcgggttttgcttttagctctgttgtcagcggctttcatccgcgcctgcgcttcgcggtcagcggaatcagcaagctcgcttgaatattcctcgtacgtgccgtctgtttcgcgtttcaaagcatccggaacttgaggaagtttttgtttgtttttatcacggtttttgtgagtatgatttctgcccatatcaatcgccccctgaaaaaagtgatatcaaacaaacatagtatctgcccggccccgatctttattcagtttatttccgtttggctgctctttccgcttttttaaattcaccggaataaaggacttcctgcatttttttcagattggctccctgctgatgtttttcgcgcttcttttccataaaagaagaccctccttcaaaacagaataccaataggattggcttttatttccgtttttatgcagataagatatcctttaaagccaactcaagttcttcatacgtaaactgaaaaccggatgtcagcgcctgcttaggcagggcgcgctggccttttacgatcagcaggctcatttctcccaaggccttctccagaaaaaattccggtacgggaatccaatggggcggtgcaggacgcttgcgatcgtctttccgaattgcttcatttctacgggattcggcgatgtcacattcatgggaccggacaagtcatcatgctccgccgcaaaagcaataagttccgcggcgtcatcgacatgaacccatgacagccactgccgtccagagccgacggtgccgcccgctaacagcttataagggagaaccatgagcggcagggcgcctttttcaccgagcatcacgccgaatctggcatataccgtccggatgccgagcgcttcaattttctggccttcacgctcccacatatgagccgtatgactgagaaagtcttcatttgacgtatcggactgctcagtgaacgttttctctgtgcttgtgccgtaaatgccgacggcgcttgcctgaatcaaagcccggggttttttcggctgctgcttcataatccgtctgacttctctcgtcgcttctattctgcttgaaatgatttgttccttcgttgtgtccgtccagcggtcaaagatggatttgccggcgaggttcacccatacatcaatagggggaagctcgcgctcaggcgccgcgttttcggccagccattgaacatatgtcacatttttttgttcggtttctctctgttttcttgataaaatatagacatgatgtccccggcgggtaaacacacctgtcagatgccggcccagaaaaccagtgccgcctgtcatcgcgatattcatatccatctctccttacacgttgatacatatactgtacctcatttgccaaaaagaaaaacgcctgaacatcggggcggggaaggagaccgggatgccgtttattacaaaaatatcgacccaaaagaaaaataccgagcgcttcaacatctttcttgatgagaaatatgcattcagcgtcgacgccgacgtgcttgtgcgttttgacctgaaaaaagggaaagaactggacgagcttgacattcttgaaatccagcacggtgatgacgtgaaaaaagcctttaaccgcgccgttgaatttttatcatatcggatgcggtctgaaaaagaagtccgggatcacctgaagaaaaaagaaacaccggacatggtcatttctgaagtcatccataaactgtacgattaccgctacttaaatgacaaagaatttgccgaagcctatgcgagcacccacaaaaaaacaaacggcaaaggccctgacgtcctgttccgcgagctgaaagcgaaaggaatagacgacgataccatcaaggagacgctcagcgcgtttacatttgatgagcagatacaagaagcgctgaaacatatcggcaaaatcctcaaaaaagacaaaaagctgtccacaaaagagatcagacagcgggcgcagatgcagcttcagcgaaaaggtttccctttcgacgtcatcaatgccgctctggagcagacggagtatgaaaatgatgatgaagccgagatggaagctctgaaggctcatgcggaaaaagcgatcaggaaataccgctatgacggcagctatgaaagcggaatgaaggtcaaacagtacttattcagaaaaggattctcgattgacgatattgatcaattcttgcaggaagaggagtaaactgaaatggacaaacgatacagtcaaatgacgcctcatgaactacagacagaaattgcgggactgacggaaaaagcgcgtaaagcggaacagatgggcattgtaaatgaactggccgtgcttgaacggaaaattacgatggccaaagcttacatgctgaacccggaagactttcggcccggcggggtgtatcagatagaaggttctgatgacactttccgcattgattacatcaacggcgtattcgcctggggacacagatcttccccgtctgacggggaagaagcactgccgatttccgttttaaaagaaaaataataacaaaagaggccggttccggcctctttttcttttcgggcacattcgtttcaacctttcagtaaaaaatgattgaattcatttttgatatcttttaagatggaattcgttgttttttaataaaaaggaggcgatttgcgttgaatatcaaaatgaaacagccatctgtgaaattaatgatttttgttttaatgatttgcacattttccatcgggtatacggaatatgctgttatgggtattctgacgtcgattgccgatgactttcatatacatgtatcttcagcgggcatgcttgttacggcgtacgcggcaagcgtctgcctgacgggcccgatcgtaactattatcgcggttaagctgccgagaaagccggtgctgctagggttgatgggcatcttcgtgcttgccaacctgatgagcgtctttgcgccgaacttcgccgtgctggcgatttccagaattttatccgcatccattcacggagctttttttgcgatcgccatggtgtttgcaagtgaaatggtgccgcctgaaaaacgttccgccgccgcggcttccatgaacggcggattaaccgtggcgctgatgctcggcgttccgttcggctcttatttaggggatgcccttaactggcgggccgtctttttcattatttctgttttaggcctgatcgggctgatcggactgatgctggtcgtaccgaaccgaaaaccgaaagtgattccgatgctgatgaatgaatggagtgtctttaagcataaacaagtgattttttcctttgcgatcaccattctcggctactcaggcgtctttatcgcttacacgtttattgagccgattttaagagattcagcggggttcggcacagtcggcattacaggcgcattatttgcctacggtctcggcggagtggcggggaatttcttcgcggggaaagtgccgctcaaactgctgacgcgcacgatgatcggtgtgatgatcggcctgatcggcgtcttggcgatttttccttatatcgctgtttttcccgccgcagccgtttcagcgacatttttgttcggcgcatgtgcgttcggcacgccgccgcttttgcagaccaaggttatttcctcctctgaaaacggcacgacaatcgccgctgcggtgagcgtttccgcctttaacctggcaaacgcgctcggcgcctggatcggcggattgattctcgggggaacgggatcttactcatggctgtttgccggcggtgcgctgatgacggctctcggccttgtgctttccacgttcgctcatctgtctgagaagaaagatgtttatgaataccaagtgcataaaggataacaaaaagcttgcaggggatattccgcctgcaagcttttttcaatgtttcaacgtaatgctgatcaccgtatgtttatcgctctcagctaaggaaatattccgggtttccggtaccccgtctttttcaaaaacaacggcataggttcctttcgcgccgcttttccatgtcatctcaccgtggtgatcagtcttgcctattatctctccgcggtctatattcggctgatgatctgactccgccgctttcatcacggtaaccgtcacaccggccgccggtgaaccgtctgcattctcaacatggagcgtaacgggcagtgcttttttggcggcggaatcatccgctttgccgcatccgcataaaacggctgccgcgagaaagaagacaaaagctttattgatttgaccaatattgaatgttgtcgaatacactgtttgtcacccttgttcccagattgtaagacgacccgccgtttgtatgaatggcaatggcggtctggccggtgtcgctgtaattgcggtaaacgggcgatccgctctggcagccgaacgtatctgtcgtgtaagtgagtttatatgtctcggcagaacgtatcggcttgctgtccgaccacatggaaccggacactttgtcgcacggataccctgtcacggttgaggaaagcccggccggactggaactgttggtcgtccgatagccgtaccagccgacagtattcccgggcgacccgtttactttgattgcgccgtagtcatagtttgtgtcaccgttttctgtccaccctttgacactgtagaatgtcttgcctgaataagagtcgtacgggtacgatgacccgttgcggccgggagctgccgtaattttcgatgcccagccgtttttctgatcatacacgcaatgtcccgccgtaacgatcgtgtcagcattgacaaaaaaaccggtgcatccgtaggtgcttgtgctgccgctgtatgtaacggtcagctgtgctgtcgcgcgatatggaaatgatgttgtgggagaaattctgattcgttcgtctgtcccaataatactggaaggctttaatgacttgatgtcagctttgctgttttgtgcaagctgtcttttggtgaggcccgttccttcataagcgggggatgtctgtgttgtttgtacaggctgattctgatttgcgtcaaactcctcaccgctgtttgatacagatgtctgcgggctgcccgctgcttctgctgaaacagcaaataatgaaactgacagtaagaatgcggtaaggctcagcaatcgttttgaaactgtcttcattttataaaacccctccttttttgtctaccggcttgcggtttagcatttaacatattatggaatttatttagcgttatgaccgcaagaggatgtttttttccgcaaaaaaaagaccgggtcattcccggtctcttacggtgtgtgttatcgtctgcctgaagctctcatgcgctcttgcgggtgcgaattaattgaaccgtccgcccgtttagaagcgtagtcatcctttgcccgcggttcgccttcaaacttattattgttctgattaggaaatccttttgccttgttccggaccatttgttttccccctcggccaatatcaaaaggttgcgccttctggactgaagacgtaaagttagtatatgcctgtgacaagctgcgtaaaagcagcaggttttcccaaggaaaggagacagagacatgaatacatatatcgacaaactgacgaatttgctgcttgagaaaaatgacatgctcagctatttgcaagcgcggacttgggttgagcttttatggggagatttcgaagcgacttacgcaaaagccggccgcccgtaccaaggagagcaaatgacggaacgcgtcgtcaaggaatggatcgaatcatacggcagcaagctccatatgttccaaagcgttcgggaagacgtttctcattatttggatcaaagcaggggtctcctgcattaatatagcagtgcgcccgccggataccgtccggcggttttttctttttataaaagaaatgggaaaatcatgtttgacgaccggcggaatgtggaaatgtgtaataacttataaaatagcggggaggaaccacaatgaacatgaaaaaggggttaaccgcatttattccggccgcaggactttgcttatttttagccgcaggcaccgttttttttgatccggcagcgaatgccgcagcagttcatcagacaaaaatagacaccgcagcagatacatatatcgtgaaagcaggagaacttaacgtccgcaaagaacccaataaacaagggcggattatcggcacgcttcgttcagaggattccgtaaaggttaaacggcttcaaggagcagattgggctgaaattgactacaaaggtcacaaagcctatatttccacgcattttctgatgaagcagccggtgaaggcggtgaccgcgaaacaaaccgatttttatacgccgactttggaaaccggcaaaaaagggtctgttaaagcgggtgaaaccgtcaatgtgctcggctgggggttcagccatgacggaggatttgaccgtaaatgggcgtacgtcacatacgccgggaaagcaggttatgtaaaaacggccgacttaactcaaaagtaaagattcaggcgggcgaataagcctgctttttttctgaaacctttcgcctttcctttcgtaaaagatgaaaaggagagtgacggatatgataatggtaatcggcggccttctgatggctgcggccggcatttcagtcacgttttttccgccgaagtcgatcaacagcctgtacggatatcggacgaagcgctctatggcggatgagtcgcagtggaaagaaggcaatcgattcagtgcgctcctcatgattctgttcggccttatttcggcggcagctggatttgcgggcagcctgcttatccggctgactcagccgttcgccctgatcgttcaggccgtattgttgatcgcgatcagcgtactgatcatcgtcttaacagaaagaagattgaaacaaacggggaggagaatcgatgaatgacattacgtttcacatgatcgaaacaaacggagtgacgctgcacacggcttcagccggtccgaaagacggtcctttggcggtgctgctgcacgggtttccggaattctggtacggctggaagagtcagatcaaaccgctggcggatgccggataccatgttgtcgtgcctgatcagcgcggctataatctcagtggcaaaccggagggcattgaaaactataccattgatacgctcagagacgacattatcgggctgatcactcattttacagatgacaaagccgtcgtcatcggacatgattggggaggagccgtggcctggcatttggcatccacgcggccgcaaaacgttgaaaaattgatcacggtcaatatcccgcacccggcggttatgcggaaggtcacaccgttctacccgccgcagtggaagaaaagctcttatatcgctttctttcagcttccggaaaagccggaacggagattgtctgaagacgattaccgcgtattggatcacgcgatcggcttatctgaacgcccggcgcttttttcacgggaagatgtcgacagctacaaagaagcatggggcagaaaaggagcgctcacggcgatgctgaactggtaccgggcgatcagagccggcggtttaggccctgccgttccgcttaaaatgcccgttccgtaccggttaatatggggcgtcaacgaccgcgcgctgagcaaaaagctcgccaaggaaacaaaacggatgattccaaacggcgacttaatcttcatagatgatgcctcacattgggtcattcacgaaaaaccgcgcatcgtcagccatttgattcatgaataccttcagcaataaagtctgtcccgcgtacagactttttcttttttttctcatatctgccgaaaaacatgacaaaatataaatcatatgcagaaaaaaatttctttccctgtaacaaaaaaagggtttaaacgtcattaaaaaaaggaaaagccttactgaagttttgcggacaattcctttaaggccgtcctaaaaaaagaataatacaaagaaggtgccttcatgaaacaaaggttaatctcaattattattccgtcttacaatgaagggaacaacgtcaagctcatccatgaatctttaaaaaaagaatttcagacgattcattatgactatgaaattttctacatcaatgacggaagcgcggatgacacccttcagcagattaaagaactggccgccagaaaccatcgcgtcaaatacatatctttttcccgcaacttcgggaaagaagcggccattttggcaggatttgaacacgtgcagggcgaagcggtaatcgtgatggacgccgatctgcagcatccgacccatctgctgaaagacttcattcaaggctatgaagaagggtatgaccaagtcatcgcgcagcgcaaccgaaaaggggacagccccgtgcgttccgtgctttcttccctgtattataaatttatcaacaaagccgtcgaagtggacttgcgtgacggggtcggagatttccgcctgctgagccggcaggccgttgatgcccttttgaagctgagtgaagggaaccgtttctcgaaagggctgttctgctggatcgggtttgaccagaaaatcgtattttatgaaaatgtcgaaaggaagaacggcacgtccaaatggtcattcagcaatctgttcaactacggaatggacggtgtcgtctccttcaacaacaagcccctcagggtatgctttttcaccggtattctgatattgcttctgtcgatggtttatattgtaacgacctttgttcatattctgacacacggcgtgtccgtacccggatacttcaccattatttccgccgtgctgtttttagggggcatccagcttttgagtctcggcatcatcggagaatacatcggccggatttactatgaaacaaaaaaacgcccgcactatttaattaaagaagcgaatataacgtacggagaacaaaatgaaacgaattatacaaaaaagcgcaagtggaaccattaaacagccgccgctgtgcgcagggtctggggacgttgtatgaaaaaaaataaatggatcttgccggcagcctgtgtgctggctgcggcagccgctcatatttttttcttaaaagagtggtcggaaggccgctatatgacggggtctggagacgggatcgcccaaatggcggtcttcaaaaagctgctgtttgatcaatatatgaacggcaggctgttttacagctattcgttcggactgggcgggggagtgtacagtcagctcggctattatttctctacttcttttctattcctgtttatctccgccgctgtccgctttttgcagcttattcagctgacgggtgaggctgatgcgctgttttgggcgcaggcctccgtttttatcagcatcgccaagcagagtttcatcatattcacggcggcgtgtgtgttccgctatttcgtcaaacggacggtgcctgcttttgccggcgccgtgttgtacggggtctcgattatctacttccggcatgaggtgtattgggactttttcactgacagtatggtgtggctgccgctgctcgtgctcggcgcggaaaaaatcatcagggaaaaaaagccggcgtggtttatcttcgcctgtgcgctgacattgatcaacaacttttattttgcgtatattaatctgattttcatcggcatttatatcttattcaggtggatgatcccccttgaaggcaatgaggcgaaaaggctcgctcaatgcaggatatttattctgtcgggccttctcgggttcggcataagcgcagtttcctttatccctgtcgtatacggatatcttcataatctgcggccgccgtattcagagcaaattgcatggcttgatttttccgacaacattttattttcaagccggataatcattctgccggcggtttttttactttttctatttacattttctttatataaaaaccggctgttccggctgtttgcgggaatcagtctgctgtacattctgtttcacttcagtccgtttgcggcaagcgcctttaacggtttttcagctccgcaaaacaggtttgaatacgtcctgtgcttcacgattgccggaacggttgcagcagggctttctaagctttcagacatcagcatgaagagtatgctgatatccgccgtactcgccgttctgctctattggagccaagtgagacggttcagcctggatatttctgatcaggccaacctgcctatcctgctccttctggggctgaccattgccgctttccttgcagcaaagacaagactgaaaggcgcggtgtccgccgtctatgccgtcattctcttgacggcggtgctgacggctaatacatatgaaaaatatgcgttatcagaaggcgggaagatttatacggtatcgcatacctttatgacgggtcctgactataagggcaaagaacaaacagagcttattcagcgcctgaaagaaaaagaccctgatccgtttgcccgtttggattggatgaacggtgttttcaataacactccgatcatatacgggttcaacggattcagcgtatattcaagcatactgaaccgcaatctgctgtccttttactggaacgacctccggattgacatgggcagggaaagcgtcagccgttatgcgacattaggaaacagggctaatttatacagcctgctttacggaaaatattatatgacggaaaaaacaaacggggccggcgtgccgtacgggttcaaaaaaatcatggaatcatcccattatgcggtttatcaaaatcaatatatgcttccgttcgtacggacagctgatcgcgtatataacgaggacggtctgaaaaaagcgccctcccttgccagagaacgggcaatgcttgacgggatcatcacggaatcaagcgcagccaacacgaaaaaagcgcctgaggcgaaaaatatgatccgtcaggcaaaggtaacggccgaccatgcggattatcaagacggcatcctgacggtaaatgaagacggcggcggcctgatcattacgccgcaagccgctaagatggacggcggcgattattacgtcagcttttatttgaagaataaagcgaaggaccagggctttacattaaaagtgaacgattacacgacaacgagaaaatcgaatcaatccatttacaaaacaggtgtcaacgatcttactgtcagagtgccgaaaacaaaaaacatccaaatccgtctgccgaaaggatcgtatcagcttgacaggctggcgctttacgaagaacggtacgatacgctgaaaaacgcataccgaaaagcggaaaaagaaccgcgggccgatctcagatggcgcggaaatacgcttcatatctcgtatgaaaacaaaaccagcgcgccgtatatcatgcttccgattccatatgaaaaaggctgggagctgaagataaacggcagaaaagaacagattgaaaaagcggattattcctttatcggatttaaagcgcaaaaaggaaaaaacgatattcaattaacgtattacccgccgttttttaaacccgcggccgctctatcggtgatcagcctcgtgtttgccgcattatatgtgagaagacaaaaaaagcccggctcttaaacagagccgagctttaattttttctgcagtttttcctcgctgaaaatccagcccgtgtaggaagagagaagctctaaatcatgactgaggtggacgatggcgacaaaaggatagtggcctttgctccggtagcgcaaatcaataaagcgcacctcataatgatctttaaaagtatcgacctcccacctgtaaacgggggaaaatgaaagaaaggctgcaatattttcgtcctgtttcgcggccttcatcacatcggtttccggaacgggcacgcggttgaatgtatccaatatcacgacatggccgtcaaggcttctgccgacataaaaggcatgggccgtcgtcacggcgatacgccactgcctgaatttcatcgtcggcgaaataatgatggtttcaatctcctcttcaatcatttcgcgcagccttcgctttatccgcagctgcatcaaaaaccggacggcgtaatatcctgcaaggatgatataaagcatcagaaatgtcacgcccggatgacctccgatataccaaacggcaatcgcggccaaatggctgacgaaaataaacggatcaaaggtattgattaaaccgagagcgatccattttctcgaaaacgggcggatggcctgtgtgccgtacgcgttaaaaatgtcaacaaacacatgcaaaacgacagccagaagcgtccacagccacaggtgcaaaaagttcgcttccggataaaacataaacaaaatgcccggaatcagaacggaccaaaataatacggcgggaatggagtgcgtgaatcctctatgatttcgaatataaacggcattatttttcagcttcaatatggtatcaatatcaggtgcctgagagccggcaagcgcggcgatcataactgcctgagacattggggtgtgcatgccgacggcaggatcaagagttgcgattccgccaagcgcgatacccatgacaacgtgagtgccagtatccattgttgacctcctagcaggcgttaaaaatcagccgcccgcatatttcgcattataagatattccccattttctgtttgcccaatcatggcgtttatccgccgttctcatatgtttccgctttttctttatcactatttaatgtaacatattatcgtaacgtgcccttagtttacaccaaaatacagtgtcaagaaaagcggaacccgaaacatctgaggagaagatatgaacgcacttgaagaaaaaatgaaacaaaaagatatagacaaatttcgcgaggacttaattacatggttcgaaagagaacagagaattctgccgtggagagaaaatcaggacccgtatcgggtgtgggtgtcagaggtgatgctgcagcagacgcgcgtagataccgtcattccttatttccggcggtttgttgagcaatttccgaccgtttcggcgctcgctgaagccgatgaggaaaaagtgctcaaagcctgggaagggctaggttattactcccgtgtaagaaatctgcaaagtgccgtaaaagaagtacatgagcggtacgggggagtcgtccctgccggggaaaaggaatttggcggactgaaaggcgtcggcccttatacaaaaggcgccgtgctcagcatcgcatacaacaaaccgattcccgccgtagacggcaatgtgatgcgtgtcatgtcgagaattctttccatatgggacgatatcgcaaaacctaaaaccagaaccattttcgaacaggcggtatccgctttcatttctcatgaaaaaccatctgaattcaatcagggtttaatggagctcggcgcgatcatctgcaccccgaaatcaccgtcatgcctgctttgccccgtacaaaagcactgttcggcatttgcggaagggacagagcgggagctgcccgttaaaagcaaaaagaaaaagcccggaataaaaacaatggcagccgttgtgctgacagacgaacaaggcgatgtctatattcataaacggccgccaaaaggcttgctcgccaacttgtgggagtttccgaataccgaaacccagaaaggaatcaaaaccgaaagagagcagcttgaagcctatttagaaaaagagatgggaataaccgctgaaatcggggagctggaaggcatcgtagaacatgttttcacccatctcgtctggaatatttcggtctttttcggtaaagtaaaacaagtgtcggatacaacggaattcatacgggtcacaaaagaggagctcaaggaatacgcatttcccgtttcccatcaaaagatatggaaaatggcggaagaaagcggccgctaaaaagcgtcagtcatagctgacgcgagtgccgtggccgtaatccgcttcattccgtttcagtccgccgcgggcttcgatttcctgaatcagttcccggtatttggactggccttcttcgtttaaatacggcataatttgctggaaggcatgatggaaataggcgagctctgaatctctccaatcttgtttgggcatcatggccaattcgcccatatcacgtccgacatacatataaaagacccctttcaacagatattgcttttattgtttgttgaatgaaaagaactatacacagcaaggagctgaggaaaaatggaacaaaataaatgcgcactgatcacgggaagcagccgaggcgtcgggaaagcagccgccatcagactcgcggaaaaaggatacaatatcgtcatcaattacgcccgcagtaaaaaagcggcattagaaaccgccgaagaaattgaaaaactcggcgttaaaacgctcgttattaaagctaatgtcggccagccggcaaaaatcaaagacatgttccgccagattgacgaaacattcggcagactggacgtgttcgtcaataatgcggcttcaggcgtgctgagaccggttatggaactcgaagaaacacactgggactggacgatgaatatcaacgcgaaagcattgcttttctgcgcccaggaagcggcaaagatgatggagaaaaacggaggcggccacatcgtcagcatcagctcgctcggcagcatccgctatcttgaaaactatacgacggtcggtgtctcaaaagccgctttagaatcgttaacccgttatctggcggttgagctttctccgaaaaacatcatcgtaaacgcggtgtcaggcggagcgattgatacggacgcgctgaagcatttccctaacagagatgaactgctggaagatgcccgccaaaatacgccggccggcagaatggtcgagattaaagatatgatcgacacggtggagtttttagtttcttcaaaagcggacatgatccgcggccagaccatcattattgacggcggacgctctctgctcgtataagttttaaaaaaagatgaatagccttatcgtctcctgcgcattctaaagtgcgtggaggtgataacaatggcaaactcaaaatacagcaaaacagacgttcagcaggtgaaaagacaaaaccagcaatcagcttccggtcagggtcaatacggcactgaattcggcagtgaaactgatgcgcagcaggttagaaagcaaaaccaatctgctgaacaaaacaaacagcaaaacagctaatcactgaaacgaaaaagcacttcatcttcggatggaagtgcttttttctgttgctaaaacgacaaaacttgtgattcctctacagaatgagtcaaagggttttccggcgtaaaatcgaaatggtaaggagtatcaacctaaagcctaaggaggaacccgatgtcagagtttgaaaagcttgtaagtgaacagatgaaaatcatggatcagcttctcgagctgcagtcagaacttgaccgctgccggcaggtggaagcggaactcatcagtctggaaagagatgcaaagctggacaatgtacaggacgaaattgcgacaaagcgaaaagacctggccggcatacaggagttattccaaaggcagacagagcaagtcatccagtcttatcgcagcacggaaaagccgtcttcctatgtgcagaaatgaatgtgccattccggaagcggagtggttcttttattttcattttttaattcgtaacgttataatagtgaaaagacttgtcggaaagcaattgcggctgcattgactgcagggctttacagaaagtaggggagaaatatgggatatcccaaggaaggagaaaccattcaaattcacagctataagcataacgggctgcttcatcgaatttggaatgaaacgacgattttaaaaagtacggaattgtgtatcatcggagccaacgaccggacaatggtgacggaatccgacggacggacgtgggtgacgagagagccggcgatctgctactttcatgcccgtcagtggtttaacgtcatcggaatgctgagagatgacggggtacactattattgcaacatcagctcgccgttcgcttatgacggagaggccatcaaatatattgattacgatttggatgtcaaggtgtttccggatatgacgtataacattcttgacgaggatgaatacgatgaccaccgcaaatcaatgaattaccctaaagagatcgacagcattctgaaggagtatctgaatacgctgctgcattggattcatcagcggaaaggaccgtttgctccggaatttgttgatatgtggtatgaacggtatctgcgctatacaaaataaagaatacaataaaaaacctgttggggtgtcaacaggtttttcacatgggctcacacgccttaaagagagagggggataaagtgtgggcgtaatcagacgctatatgcaatttgtaaaaccttataaaaaacaaatttttatcacagtgttaatcggcattataaaattctccatcccgctggctctcccgcttctgttaaaatacgtggtcgatgacattattcaagggagcggaacggcaagcgctaaaacatcatcgctattcacgataatgggcatcatgttcgtgctgtttttaattctgcgtcccccggtagagtactatcggcaatacttcgcacaatggacgggcagccgggtgctctacgatatcaggggggtattgtttgatcatattcagaaattgagcctgaggttttatgccaacacgagaacgggcgaagtcatttcccgggtgataaatgatgtcgaacagacaaaagactttgtcataacgggactgatgaatatctggcttgatatgatgacggtgctgatcgtcatctgtattatgtttacactcgatgtgaagctgacattgatatctgtcattttgtttccgttatacggaatttcagtgaaatacttttacggccgtctccgaaaactgacacgtgagcgttctcaggcactcgcccaagttcagggacatttgcacgaaagagttcaggggatgcccgttatcagaagtttcgccattgaagattatgaacaagccaattttgatgaaaaaaacggacattttctggacaaagcgatccgtcatacgaattggaacgcgaaaacgttcgcagttgtgaataccattacggatttggcgccgctgcttgttatcgcgtttgcgggttattttgtcataaacggcccgctgacggtagggacgatggttgcgttcgtcggctatattgacagaatgtacaatccggtcagaagattgatcaactcatcgacgacgctgacccagtcgatcgcttcaatggatcgcatatttgaatttatcgacgagccgtatgaactgactgataaaccgaatgcattaaaagctgacggcattaagggtgaagttgaattccgaaatgtctcgttccgttatgaggaaggaaaagaaacgattttgcaggacgtttccttaaaggtgacaaaaggggaaaccgtcgcgctcgtcgggatgagcggcggcggaaaatcgacgcttgtcagcctcataccgcgtttttatgatgtatccggcggcagcctgctgattgacggcacagatattcgcgattatgaagcgagaagcctccgcaatcaagtcggaatggtgcttcaggatacgtttctgttcagtgagacgattcgtgaaaatatcgctatcggtaaaccgggagcgtctctggatgaggtggttgcggctgcgaaagcggcaaatgcccatgaatttattatgaacttccccgaaggctacgaaaccaaagtcggcgaacggggcgtcaaattgtcaggcgggcagaagcagcggatttcgatcgcccgtgtattcttaaaaaatccgccgctgctgatcttggatgaagcgacatcggctcttgatcttgaaagtgaacactacattcaggaagcgatggaaaagcttgcgaaaaaccggacgacttttatcgtcgcccacagactgtccacgattacgcacgcggataaaattgtcgtcatggaaaacggcgccgtcgtcgaaaccggcacgcacgaggaattaatggcccaaggcggccagtacagacacttatttacgattcagaatttgaactgatacaaaaacgtatgccgtccgaatgggcggcatacgttttttgaatgcaaaaaaacccggttttacggaagcaccgggttactcttcgtctgtttctaattcgctgtctttcgggtggtatgtctgaaaactcgtaattagcgtatcgagatgctccagctgctcgcggtattccgcaaccgcagccataatgctgagcatattgtaatcaagcagttcatcctcgcagttctgctgatttttcaagaaagacttcgtcaaaagctgtttatatcttatgctttcttcagcatcgtcatcatgcggtttgatcttgccgaccgtccgcatcagaatcctttcgtgccaatgaagcagataatcaatttcttctgtcagcgtctcctgaaattcctccggcatatgataaatctcgttttcatagcggtgcagctttttcagcgtatcaagcgcccgatttgccgtaataatcgcctgtctgaataaaacaagcttgcgcgactttacatacgtcgttttcttaaagtagcttctctcctctttataaagaaggtacgtatgatcaagcttcatcattttttccttcagcttctcaatatcctctttcaatatcgagtgttccgtagactgacgcatcgtcagcctgatccatttcatgatctcatcggtatattcaaccgtatgatgagtcagcttcgtttcgtatttcggcggaagaaacacaaggttcacaataaaagaagacagcacgcctaaaataacggtgcttgttcgtatcagagcgaacgtcaggaagctgtttcccggtgtttctaaaatcgcgataaccgtcacgagcgcaatcgaaatggtgtgttcaattttcagttttaacatgatcgtgatgacaatcactgcggtcaatccgatcataatcggactcggtccgaaaatcagtccgaataccgtagcgatgacagcgccgatgatatttgcctgaacctgatcaataatgataagaaaagacctgtaaatagagggctgtatggcaaatatagctgcaatcccggcaaagatcggcgacggaagtccgatccatgatgctaagtagagcgcgagcgtaatcgcaatccctgttttaaaaatgcgggcaccaagtttcattggtttgtgcgtgcattcctttctctaataaattatgtgccgaacgaacggctgacacttacatttccctgtcggctgatttgctaaacaataaagtaatatacagggatcataccaattattcaaggtctttttttgaaaaaaccattatctcacaaatcggacaaaaagaaaaagcggaagccccgggctcccgcttgtttcagaagttattttttcatatgtctgaacgcatcttcaacggcttgtaaagtggcgtcgatatcctcttcagtatgtgcggttgtgataaaccaagcttcatacttcgacggagcgagattgatgccgcgttcaagcatcagcttgaagaacttggcgaatgcttctccgtccgtattttccgcctgctcgtaattgacgattttttcatcagtgaagtaaaccgtgagcgcgccttttaaacggttgacggtgatggtaatgccatgtgtctccgcatgggcgagaatgccttgctcaagtctggcgccgagctcatcaagccgctcgtaaacgccttcttccttcagcacttccaggcaggcgatgcctgataggatagatgccgggtttccggccatcgtgccggcttgatatgccgggccgagcggagcaacctgctccatgatctcttttttgcctccgtaagcgccgatcggcaagccgcccccgataattttaccgagcgccgttaaatcaggcttcacttgaagaagatcctgcgcgcctccgtacataaaacggaacgccgtgatcacttcatcataaatgacgagcgcgcccgctttatgggtcaattcatttacctgttctaaaaatccttcttcaggttcaacgatgccgaagttgccgacgatcggctcgacgagaaccgctgcaatttctgaaccccatttatccagcgcggctttgtagctttcaatatcattgaaaggaacggtaatgacctcattggcgatgcttttcggcacgccggcggaatcaggggtgccgagcgtagacgggccggaacccgcagcgacaagtacgagatcagaatggccgtgatagcagccggcgaatttaatgatttttgtgcggcctgtataagcgcgtgcaacccggatcgttgtcatcaccgcttcagtgcctgagtttacgaatcgtactttatcaagtgaaggaatggcctccttcagcattttggcgaaagtgacctcatgtttggtcggcgtcccgtacagcacgccgttttccgccgctgttttaatcgcttcagtaatatgcggatgggcatgtccggtaataatcggaccgtaagccgctaaataatcgatatactgattcccgtctacatcccagaaataagcgccgttcgctttttccatcgcaacgggtgaaccgccgcctaccgctttataggatctggacgggctgttcacgcctccgacgatatgctctaacgcttccttatgaagttcaactgattttgtatacaaaaaatgaccctcctaatatctccttacatcatgttctattgtagcatgcttcattgcgagcacaacgggttcatgcttccagaaaagagccgggggataacggttgtaatcttaacgtgaattggatacgcttaataaaaaacccggaggtataagaaatgacgattgaaatcggacaaacagcaccggatatgaaattagtgaatgacagcggggaagaagtagcattgacggattttaaagggaagtacgtcgttctctatttttatccgaaagacatgacacccggatgcacgacggaagcatgtgatttccgtgatcagcacgaaagtttcgcgggacttgatgcggttatcatcggagtaagccctgacagccgtgataaacatgaaaaatttaagcaaaaacacgatcttcctttccagctcctcgttgatgatgagcacaaactggcggaagcttttgatgtgtggaagctgaagaagaattttgggaaagaatatatgggtatcgagcgatccacttttttgttagacaaagaaggccgtcttgtgaaggagtggagaaaggtaaaagtgaaagatcacgttgccgaggcgcttcgtgaattggaacaaattgcgtctaattaatggacaaatgctgaactcacggggttttcttcagattacatttgacaggagaccggaaaaagatgtacactaattataaacattataaagtaagaatcttttttagaagagaggtgcatgacggatggctgcacatgaattaaaagaagccttagacacgttgaaggatacgggagtccggattactcctcaacgtcatgccattctggaatatctcgtggattctatggcacatccgacagcggacgatatatataaagccttggaagggaaattccctaatatgagtgttgcgacagtgtataacaatttgcgtgtattccgggaagcggggcttgtaaaggaactgacgtacggagatgcgtccagcagatttgactttgtcacctctgaccattatcacgccatttgtgaaagctgcggaaaaatcgtggacttccattatcccgggcttgacgaagtggaacagcttgctgctcacgtcacagggtttaaggtaagccaccaccgtttggagatttacggcgtctgccaagaatgttccaaaaaagaaaaccactaaacgaagctgaccgctttgatacggtcagcttcgtttattttacactgttttttctgttataagactcatcgaacgctttgccttccaatcctttatccaatgtaagcggctctctgcaatgcatgcacatatccactctgcccagaatcttcgtttctttctcgcaagcggggcacatcacccggaccgcttttgtggacagcatgccgatccaaaaataaacggcggtgctgagtccgatcgacagcaggccgagaatcataaacaagctggcaagcaaaacagactgcttaaagaacagcccgatgtacataatgataaacccaacgaaaaccaaacttaacgcaaacgttctgatcttattaattttgcttgagtatttcgccatgtccatccccctctcgtttaactatagcacaaaacatatggcatattcttcatgttttcgtaagaaaagggaagaataaatatggcacctgaaaggaaatttgttataatagtgcaatgtgtttagaaaaaaggactttcatgttttatcatagaaatgtagaaacaatagctagtgaaacaatcgcattggaggaatcgtaatggacaatcttctccgtccaatttaccaagaaagagcaagtcatcccgatacgctggccgtccttatgattgagagaaggagtaaagcatcatccatcacggataactttgatgcggtcatgcttgtcattgtgaaacaggctgatgaacctctttttataaagcattatgaattcgaacacaaaaccgcttctttacatattgtaacggatgctctgcttcaggaatggattctgcttgggacaaatagaagagtcatagattggatcatcaacggcaaagtgctgtttgaccgcaatgaatatatatctgaactcaatgaccggctcagcacttttcctttcgccgagcggaaattaaagatcggaatggaatacggcaagctgatcagaagatttgtagaaggaaaagcgttttttgaagctgatcattttctggatgcatattatgcggtagtgcacgctcttcaccacttggcccgcatagaagtgattgaccgggggttttatcccgaaacgacagtctggaaccaggtccgtcacattgagccgcaggtatataagctatattccgaacttgtcgagagtcacgaaagcttggagaaaaggctcgaattattattcttagcaaatgattttctcatccattcaaaagctgaaatcggttctgcgcacctttttcaggtgatgaaagaaaaagaaatgtggcagtttggagaattgcttcagcaccctgaactggtgcacttcacccaagatctcggtgtcatgcttgattacctgacggaaaaaggctttgttgaagtatctcaaatagagaccaaagggcaggaagtatatcatcgaggatattctttcaaaaaaagtgttgacgctgaatcataggcatggtatattattaaacgtcgctgatgcgcttcaccaaaaagctcacagcggcggagaaataaaaacaaaaaaacatttgacagcaaatcgctgaaatgttatactgaaaaagtcgcctcgagatgaggttgagatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagacctcgggtcttataaacagaacgttccctgtcttgtttagttttgaaggatcattccttcaaaacataggaacacctgctaaatgcgccacttcctgtggcaacgcatgtgttagcatgtcctatgcgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaattttttaaaaaaactcttgctttttccgaaatacatagtataataatacatgtcactaaaacgtctggtgatgatggcgaagaggtcacacccgttcccatgccgaacacggaagttaagctcttcagcgccgatggtagtcggggtttccccctgtgagagtaggacatcgccaggcagacttcattccgcagtagctcagtggtagagctatcggctgttaaccgatcggtcgtaggttcgaatcctacctgcggagccaattatggagagctgtccgagtggccgaaggagcacgattggaaatcgtgtaggcggtaaccccgtctcaagggttcgaatcccttgctctccgccactaattatcaatacataacaaacgaaaaaataccagggcccgttggtcaagcggttaagacaccgccctttcacggcggtaacacgggttcgaatcccgtacgggtcacttatatgatggaggattagctcagctgggagagcatctgccttacaagcagagggtcggcggttcgagcccgtcatcctccaccattatcatcgcggggtggagcagttcggtagctcgtcgggctcataacccgaaggtcgcaggttcaaatcctgcccccgcaaccaaaaaaatggtccggtagttcagttggttagaatgcctgcctgtcacgcaggaggtcgcgggttcgagtcccgtccggaccgccatttataaaaaggctcggtagctcagttggtagagcaacggactgaaaatccgtgtgtcggcggttcgattccgtcccgagccaccatttgccggtctagctcaattggtagagcaactgacttgtaatcagtaggttgggggttcaagtcctctggccggcactctaaatgatggaggggtagcgaagtggctaaacgcggcggactgtaaatccgctccctcagggttcggcagttcgaatctgcccccctccaccattttataaataggggcatagtttaacggtagaacagaggtctccaaaacctccggtgtgggttcgattcctactgcccctgccactatattatttattcatcttcagattatggcggttgtggcgaagtggttaacgcaccagattgtggctctggcactcgtgggttcgattcccatcaatcgccccatattatcattgggctatagccaagcggtaaggcaacggactttgactccgtcatgcgttggttcgaatccagctagcccagttgcatttttttgaaaacaacagcataagatgtattaagttcttttacatgttgcggaagtagttcagtggtagaacatcaccttgccaaggtgggggtcgcgggttcgaatcccgtcttccgctccaaattacggcggcatagccaagtggtaaggcagaggtctgcaaaacctttatccccggttcgaatccgggtgtcgcctttctattgccggggtggtggaattggcagacacacaggacttaaaatcctgcggtaggtgactaccgtgccggttcaagtccggccctcggcaccaatttaactttgagcgaattatgttaaattggtcatcaattttcttattataaaacatatatgagagtgatttgcatattgcaggtcgctttttttatataataaaagcgtgaagactatcaatataagtttcttgcttgtatcgtatatactgcattaccatttgaaaaaactttactaaaaccattgactctttatagaatgcatgttatatttatatacgtcggttgaacacgacgcattatatgccggtgtggcggaattggcagacgcgcacgactcaaaatcgtgttccttctggagtgccggttcgaccccggccaccggtatacaaaggcttctacatattgtagaagccttttttgttgtatgaaaatatctccaaggcttgtgaaaacatgatacctgcagtaggaggagctggattcggcgcaccgtgcttatattaaggaaacaccgattcggccgtggagttaaatctttccgatcgggctgtttttgctattaacactgtttctcagctggtggggcggccattcaaaagcgcgcattattggcagcggttattgcagtatttgctctttttatgtttcagcgctttcctgcaggcgagcttgttacccattttattaagggcggaaacgaattggtcaacgttattattatgttatcgctgatttgggccgtaacagcagtagctgaaaatctgggattctcgaaatatgttacttctcatttaacatcatggagccctcatatgtttattgcgccgtctctttttatactgggggctgttatatcccattttatcgggtcatcctgggggacttggggcgctcggcgtaacgctggcggttcagttacataccagcttattattagcgagcggaacatttggtttgcttctcccctcagtgataatacggtgttggggatcaatgttgcgaagtatgcccgttcgaagcttgttccggcgattaacgccgcggggatctccgttgtgttatacggtgcgtatttttcagataacaaatactttttgaaggcgttatccgaaattgagataacgcctttttaatgagctgttatacttgagaaaaaaagaagtgatgacattgaagcagattattgcaatgggcggcgggggttttccatggagccggatcatcttgtgctggatcagtatattttagagcagtcggcgcggtcaaagccgaaagtttgttttttgccgacggcaagcggagattcggagaaatataccggcaggttttatcaggcctttcaaaagctgcggtgtgagccggatcacttgtcgctgtttaaaccgccgggttctgatctcagatcctttctcatgaagaaagatattatatatgtcggcggcggaaatacgcgcaatatgcttgtcttatggaaagagtgggggcttgaccttattcttcgtgaggcttgggaaaacggcatcatcttagcgggtctcagcgccggagcgatttgctggtatgaagaaggggtgacggattcagcgggggatttgcgagagttaacagctttaggatttttgccgggcagcttttgtccgcactatgacggagaagcggagcgccggccggtgtatcaccgtctgatttccgaaaagatactcagggagggctatgccgctgatgacggcgctgcgcttcattataaagacggtcagctgttccgggctgtctcttcccgggaaaccgcaaagggttatcgggtttttaataccgaagaaggcgttcgggaaacagagcttatgaccattccgttatctgaattttgataatatgcttttttttgtacacaacttatgttacgatgagagcgaaatcaatagttactgggggtgcccgtctgagcgggctgagagagaagcggcggcttcttaaccctttggacctgatctggttcgtaccagcgtggggaagtaaaggttttattattgttgaggaaaacaataatagtttctttctgactgcaaaaccgggttcttctttgaacccggtttttttgtgctggtgctgagcttggttctgttattcaaatgataaaggagagatttgtatgcaaaatcaatcagtacagcaagcgaacatttccattatgtcgagtttttccggcagtaaaaaggtttatgcagaaggttcttcgcccgacatacgagtgccgatgcgggaaatcagcctgagtgcgactacgggggcattcggggaagaggagaatgcgccggtccgtgtttatgatacgagcggaccgtatacagacccggatgtacagattgatattcatgaaggtctgggggcgctccgcacaaagtggattaccgggcgcggagaagtagaagaatataacggccggaccgtgagacctgaagacaacggctataaaaaagaagatcatgctgccgaataccccggcctgcagcggaaaccgcttcgggccaagccggggaaaaatgtaacacaattgcattatgcgagaaaaggcatcattacgccggaaatggagtttatcgcaattcgcgagcatgtgtctcccgaatttgtcagagacgaggtagccagcggccgggcgattattccttctaacgtcaaccacccggaaagcgagccgatgattatcggccggaattttcatgtgaaaattaatgccaatatcggcaactcggctgttacatcttctatcgaagaagaagtcgaaaaaatgacgtgggcgattcgctggggcgctgatacgatgatggatttatccacgggaaaagacattcatacgacgcgtgaatggattatccgcaactgccccgtgcctgtggggacggtgccgatttatcaggcgcttgaaaaagttaatggcattgccgaggatttaacgtgggacatttatcgtgacacattgattgagcaggcggagcagggcgtggattatttcaccattcatgccggcgtactgcttcgttatgtcccgttaacggctaaacgcacgacgggaatcgtatcccgcggcggggcgattatggcgcaatggtgcctggctcatcatcaggaaagctttctgtacacgcattttgaagaaatttgtgaaatcatgaagagctatgatatcgctttttcacttggtgacgggcttcgtccgggttcgattgcggatgccaatgatgaagcgcagtttgcggaattggagactctcggagaattgacggagattgcgtggaagcacgatgtgcaagtgatgatcgaaggaccgggtcatgtgccgatgcataaaattaaggaaaacatggacaagcagctggaaatttgtaaagaggcgcctttttacacgctcggcccattaacgacggatatcgctccgggctatgaccacattacttcagcaatcggcgcggcgatgatcggctggtacgggacggcgatgctttgctatgtcacgccgaaggagcatttggggctgccgaatcgtgatgatgtaagagaaggcgtcattacgtacaaaatcgcggcacatgccgcagaccttgctaaagggcatccgggtgcacagatccgtgacgatgctctgtctaaggcgcggtttgaattccggtggcgtgatcaatttcatttgtcgcttgatcctgaaagagcaatggaatatcatgatgaaacgctgccggctgaaggcgcaaaaacggctcacttctgttcgatgtgcggcccgaagttctgcagcatgagaatttctcaggatattcgtgattatgcgaaggaaaacggacttactgaagacgaggccgtcaatgaagggctgaaagaaaaagcaaaagagtttgcagagaagggaagccgcttatatcaataaaagaaaagatgaagatggagtgtatccatcttcatcttttttagaaaaacggtgaacggcgaagcggcggaatgctctgctcgaagcggaatatattttccggatcatatttcgttttgacttgacggaggcggtgaacattttctccgtaatacgtttgcagccagtttctgatttctctatcaggccaattcacataatctcccatcgtttctcttgatagggacgttctcagtccttcgatccagcggacattttgtctttcttcttcagcagatgtccaagttgtaatatattcttgggcaatgattgcgttgcgatagtagaatgccgtttggtccggagcgatccgtccggccgccccgccgagagattgctgccagacactggcgttttcgttcggagcgtgctctaaatagcgctttaaagtggatattgcgcgtgttgataatggtttttcaataaaggatcctgaccgcttcatcttttgcggctgattgcctcccgggctgttaaaaaaggctgctgctttaataaatggcactgtcttgaccatgccgcttgtcggttttcccgctttcattaacggagccagcagttctttcagctcctcttttgtcccggtaaattgaccgagtgcttctatgcggttgacttccttaggccaaaactgaattgatgaggtaagccggttgtctgtaaatggagcccagcgctgccacgtattaaatacttcctcgaaatcatcccagccccaagtgacagaaaaaacagacacgcacgagatcggcacggctttaaacatcatggatgtgacaatgccgaagttgcctccccctccgccctgagatgcccaaaatagatcagagtgctttgagcggttgactgtgatcaagtcagcacccgctttttcgtccgctatgatcatttcgagctggaggagacgatcgcaagtaagtccggcagtccttgttaaatatccgattcctcccccgagcgtcagccccgtgattcccacattcgcaatggttcccgcaggaagggtcaagccgtaccgccagagtgtccggtagacttcccctaattcggctcccgcttcaatcgagaccagccgcttatcctcatttactcttattttcttcatttcactgagatcaatgactagtccgtcatttaacagggaaaaattttcgtagctgtgtcttccgcctctgatacggaaaggcacattgttctcacgtgcccatctcaccgcattgagggcgtcatgtttgttttggcaaaacacaatgatgtctggatatctttgcaggcttaaattgaaattggttcttgcggcattatagtccgggtcatcttttttgacgatgcgaccgctcaatgttgtcttttccacattctcactcactttcacttgtaatctgctatgttttctagcatatgcggaaaaatgagagagtgtatgaggaaaacccccggaaggacacgatattttaaattgtagttgacaggtagggattgtatgaattaacataatcattacatatttccaaacgatggctgatcggatcaccgaaggctcttatctattaaacagataagggccttttttgcgtgaaagtcattaaatgaaaagcggagggatgaaaagtggcgttaaaaaaggtatcacatgtgcgcaaaaagagaaaaaagcggaaaaagtacagaaaacacacattgaatttcgaactgcttgtagagaaaaacaaacgggagattatgagaaatgaggaacagatggagcagatttatataaagatagatgaaaagcatgcgggggttcgataaagatgaaggagagaaaatggaggttgaaaacaacggtactcgcgctgtcggtatccatcatgttatcagggtgcgcgttagggagtgccggggaagaaccgtcatctgcggctgataaaaaggaagaaacacgtatcacccatgtcaagacaaaggaatttaaagcttctcatccggcggcgattcccgctaaatcgaaagccagaactgacacttttgttgctgggatttccgcgccgggcggcgtgtttctgccgtacttttacgaaaacggctgggatggaaatgcgacagatcctatttttgaaccgttagtcaaactggataaaacggggaagcctgccccggctcttgcggaaagctggaaaatttccaaagatcagcttacatacacgttccgtttaagaaaaaatctcgttttcagcgacggttcaccgctgaccgcaaaggatgccgcattcactttaacactgctgcatgatcctgcatacgcgggctatgaagatatcaccacggcttatattaaaggcggtaaggcttacaaagaaggaaaggcaaagacgatagagggcattcgcgtccttgatgacagaaccattcaaatcacgactgagaaagtcagtgcgaagtcgctgcttcttttgggcgggcaggtgctgtcagaagcctactacgggaagaaatatcaattcggcaaactggactatttaaaagagctttatgccaaaccgctcggagcgggaccttatcaatttacagaataccttccgggacaggaaatacgctatcaggctaatgaacactattatgccggaaaaccgaaaacggaaaagctgatttataaaattatcgatccgtcaacttcccttcagctgtttgaaacgggtgaccttgattacgcttctttctcacctgatgatgatacggttcagcatttaaaaagtctcggttttgcgaatataagcgtatctgtcgtgaatgattacgggcttgtgtacgtcaatcacaagcgtccgccttttcaagataagaaagtgtcccaggcgcttatttacggacttgaccgtcaaaaaatcgtcgatgtccgctttaaacgctacggagaggtcgcgaatgttccggtgtctccggtttcgtgggcttatgatgacaaaggtgtcaatcggtatgcgtttaaccctgaaaaagccaaaaagcttcttgacgaagcaggctggaaaacgggcaaagacggtgtacgtgaaaaaaacggcaaaaagcttgaaatcagctattacacatctaaagcggatgatgatttcatcccgatagcgaaagaaaattatgcggacatcggaatctcattaaaaccggaagtgatggattttaatacagaagtagcgaaaatcaatgacaaacaatatgaccttgccgccgtttccacctcgcagatccttgatccgaatgacacggtggaaaagctggcttccggccatcccaataatgtgacggggtattccaatccgaaagcggaccggctgatagagaaaggagccggcacgcttgatatcagcaaaagaaaagagatttatcaccagctgtaccgggagctcggggaaaacccgccttacattctgattcattaccgtcagagcgcaagggcggtcagcggaaaaataaaagggcttgaggctgacaattattctggaatcagttcaagtctctcaaatgtctcaattcaatagaacggttgggcaaaatacccgatgcatcctggggattttgccctttcagcggaaaggaggggctttttatgaaacggtatgccgcagaacgattcattcaaatgcttgtgatcttattcggtacgtcctttattatttttttcttattcgccatgctgccgggcgactatattgattccaatgtaaacctgactccggaaagagcgaaggagttaaaagcgctttacgggctggatcagccgatttggcagcgttatgtgacatggctcggaaatgtgctcagcggagattttgggttttctttgaaatatcaggagaacgtcctgtcactgcttcggaaatatgtctggaattcgttttttgtcgcgtttttggcgttgcttgttacatggtcagccgcgatgataacgggtgtcatatccgctgtcaggaaatactcatggtttgacgggatcgtgacgtttcttgtttttgcttccatggcgtttccgtctttttttatcagccttctgtttattaagtggtttggggtggatttgaaaatattgcccgtcggcgggatgattgataccggcagcacgagtacaggtttttcgtacgtgcttgaagccgccagacatatgattcttccggtcgtgattttatctatgctcggcatcggctcgctgacaaggtatttccgctccggcatgctggacgtgatcagacaggattatatcagaacggcgagagcgaagggattgaaagagcgcaccgtcatctggaaacatgcgttgaaaaacgcgcttattccggccatcaccctgcttgcttttgaactgccgggactgttttccggagccatcattattgaacagattttcgggtggccgggtgtcggacgtattcagcttgaatctgtgcattatcgtgattatccggttttgatggcgtttaccttgtttttgtcttgtttaacgattgtagggaacttcttggcggatatcgcttatgccgcggttgatccgcgggtcagactgaaatagggggtgttcggaatgaaaaaacaaaaagaggtgccgccttctctttggaagcagacgtaccgccgcctgctgcagcataagctgacggtcatcagtcttcttttcttatattttatgtttttattgtgctttatcgggccgtctttttctccgtacataacagatcggacggatatttcaaatgccaatcagcatccgggaatccatcactggctgggcaccgaccagtacgggagagatgtgctgacgaggctgatgctggcggggcagatttctctgaccgtggggcttgcttcaatggtgctgtcgcttgtcatcggctctttactcggggctgcggccgggttttatcggggagccgctgatatgatcattatgcgcattgctgatatgctcatgtccatcccgggcctgccgctgcttttgattttggctgcggtgatgtcggagtggaaagtgccttctgaatacagaatgtacctgattatgatgatgttaagcctgatcggatggcccggtttggcgcggcttgtacgcggacagattttgtcgctgaaggagcagctgtttatgatggccgcggaagttttggggcttagtgataaacggaaaatcctctatcatttgcttcccaacacattgccgttattactggtagcggcgactttgcatgtggcgggagcgatgctgagtgaatctgcgctgagttttctcgggcttggcgttgctccgccgacaccttcttggggaaacatgatggaagcggcgaatcattttatggattttacactccgcccgtggctgtggattccgccgggaacggccatttttctgaccgttgtggcgattcatttgcttggagacggtttaagagacgcttttgatcctaaggtaaaacggcaggtgaaaatgaaatgaaaaaaccgcttttagaagtaaggcatttggaaacggctttttatacagaggagggtgcggtaaaggccgtggacggagtcagctttacgatacatgaggaggaaacggtttgtattgtaggagagtccggctgcgggaaaagtatggcgtcattgtccattatgcagcttattcccgagacggggagaatcgaacggggagcggtgcatttttccggacagaacctgttggaactgaaaccaaaagacatgcagaaaatccgcggaagcgaaatcgggatgatttttcaggaaccgatgacatctttgaatccggtgtttacaatcggtgagcagctgaccgaaccgattcgcgaacatttgttgctgagtaagaaagaggcatggcggagagccgttgaactgatcacgttagtggagatcccgaatgccgagcaggttatgcaccgatatcctcatgagctgagcggcggcatgctgcaacgcatcatgacggctgtcgcgctaagctgcgatccgaaactgatcattgccgacgagccgacgacagcgcttgacgtaaccattcaggcgcaaatattggatttattgcgggatatgaaaaagcaatttcgcacgtctattttattcattactcatgaccttggcgtggttgctgaaatggctgattatgtgattgtcatgtatgcgggaaaaattgtggaggaaggaccggttgcagagctgttttctgatccgaagcatccgtatacgaaagggctgctcgcggccaagccggttatcggtcaaaaaagggagacgctttacaccattccggggcaggtccccgagcttgcggacctgtcgggatcgtcttgttattttgcggagcgatgtgaacacagcacggaaatatgccggagatcgagcccgcattttactgaattcgggaaggggcatcaggcggcgtgctggctttacagagaggagaaagcagatgagtgatgtgttgctggaggtcaaggggctgaaaaaatattacgaggagcatggggggatgagaaagactcataaaaaacccgtaaaagcggttgacggtgtcagttttacgataggaaagggagaagtgttcggcttagcgggagaatcgggcagcggaaagtcatcaatcggcaagaccattttgaggcttcatgagaaaacagggggagaggtgttttttcaggggcgtgatgtgtttcggatgagccggcgcgagctcaaaactttcagatcggaagcgcagctcatctttcaagatccgttcagttctttaaatccccggcgccggatcggagaagccatcggtgaagcgatgatcgagcatcaattggcggtgaagcggaatgcgcgtgataaagcggcggaggttcttgaagcctgcggactttccgcaaacttcatcgatcgttatccgcatgaattttcaggagggcagcggcagcggatcgtgattgcaagagcgatggcgctcaaaccgcaatttatcattatggatgaacccgtggcggcgttagatgtctccatccaggcgcagatgatcaatttgttcagcagccttcaaaaacagcacgggctgtcatacttgttcatttctcatgatttaagcgtggtggagcacttatgtacgaaggtcgccattatgtatttagggacgattgtggaatatgcgtcaaaggaggagctcttttcacggccgcttcacccttatacgaaagcgctgttatcagccgtgcctgttcctgatcccggagcgaaaagggagcggataattttaaagggtgatataccaagcccctctgatccgccttcaggctgtaaattccgaacgagatgtccggcagccaagaagatatgtgctgagaaaagtccggcgctgtcagaaaaagggtttcatcattttgcggcatgccacttcgtgtaattgagaaaaaaacggttttattgataatgaacataaaaaacctgccgggcagaccggcaggttttttgatgttattttggtgacggcagtccgagtccttcggcaacgcgtctgccgtattcaggatcagccttgtagaagtggccgatctggcgcagcttaatttcttctttttccacaggtttcatcgcactgacgatattggcgacaaggcgcgcgcgctcttcctcgctcatcaggcggtacaggtcgccggcttgtgtgtaatgatcatgatgattatagcttacactgtcagcgaaacctgatacagggtatgccgcctgtttatcttcaggtgactctttcgggccgccgaagctgttaggctcgtaatagacggagcggccgccgttatcatcaaaacgcatttgtccgtcacgctgatagtttttcacttcattgcgggaacggttgatcggcagcgcctgatggttcgcgccgacacggtagcgatgcgcgtcatggtatgcgaacaaccggccttgaagcattttgtcaggtgagacgtcgacgccgggcactaatgtgccgggagagaacgtcgcctgttctacttccgcaaagtaattttccggattgcggttcagaaccatgcggccgacttcgatcagcggatagtctttttgagaccatacttttgtgacgtcaaacggatcaaagcgatatgtgtttgcatcttctaacggcatgatttgaacatataatttccatgcggggaaatcgccgttttcaatcgcattgaacaaatcttccgtatggtaatcgggattttcgcccgcgatttttgcggctgtattaacatcaaggtttttcacgccttgctctgttttaaagtgatatttaatccagacgccttcgcctttatcatttgtccatttaaatgtatggcttccgaatccgtgcatatggcgaagagtcgccggaatgccccggtctgacatcagaatggttacctggtgcagggattcgggtgacaaagaccagaaatcccaaacggccgtcggatttttcagatgtgttctcggatctcttttttgtgtatggataaagtcagggaacttgatggcatcgcggatgaagaacacgggtgtattgtttccgacgatatcgtagtttccttcttctgtataaaatttaacggcaaatccgcgcgggtcgcgcactgtgtcactagagcccagttcgcccgcaacggttgagaaacggatgaaaagcggcgtgcgtttaccgacttctgacagaaatgcggctttcgtatattttgtaacgtcatttgtgacttcaaaataaccgtgtgcgcccgcgccttttgcgtgaacgacacgctccggaacgcgttctctgttaaagtgcgccaatttctcaagcagatggacgtcttgtattaaagcaggaccgcgatcgccggccgtcattgagttttggttatctccgacaggagcgccccagctggttgtcagtttatttgaactcatgtgatcacctctttaaatttataagaacataatatcacctatcagtaaaaagtcaatattattttataatgattataaaataattatttttattatcgaaaagaaggtatgggtttaataacacacttgactgacgggaataatgggtttaatatgagaaaaaatagaaaccgctgacttggacacaagaggctcttattcttcactggataagggcctttttttattgtcaggcggtaagggaggcggcgattgtatgcttttccggcagcattttaaacctgtcgatattcacggtcatctgccgtacagccttaatttcggcaaaaacgataagacattttccgattataaccgggagcggtcggaaagaatgaatctcacttgggattttcctgatccgcatgatgttgatggcgatgacggcgaaatcgctttgatgacaagatgggagaaagaattagataagtacggcattgacgtgctgaattttttaacagcagagagcaatgaccggatggcggcgtttattcaagccaatcccgcgaggtttaccggatttgcatatcatcctttggaacaaaaggatgcgtatgaggagctgaaaagagcggttgaagagctcggtctgaaaggatataaactgttcgggccgctgacagacatcgagtttcatgatccgtcgctgaaaaagctgtggacgtatctggctgacaaaagactgcctgtattaattcacttcggacttttagggagagcggggggcattgtcagccatcgcaacatcaacccgctctccatctatcgcgtcgcgagagagtatgctgatataccgttcatcattccgcatttcggcgccggatattatcaggaactgctgcagctgtgctggagctgcccgaatgtgtatattgacacgtccggctcaaatcagtggatgaggtggatgccgtaccggcttgatttggaaattctgtttcgaaagacatctgaattaatcggtgctgaacggatcatcttcgggacggattcgaacggatttccgagaggatatgtatacagatatcttcaggagcaggtgaggacctgccgggaaatcaatatgcgggaagaagatatagaaaacattttcggcaacaacgcgcagacattattgaaaatcgcccggaaagaaaaggaagtaaatacgtgatacagccgatgcgctctttggcaggtttatgccggaaggcgcatttttaattcatacaaaaaacagttgacaagtcggaataatttgaattaacatgatattcaaatttaaaaacaaacgggttgccgatcggaccgccgaaggctcccatctctgcaagcaatcggagatgggggcctttttgtttttcgatcgcatgcggcagaaagagaggggaagacagatggctgtaaccatcagcatacaagaaaaagcttttgagcatgaaggccggaaaacgccggtgctgaatgatattgagctgtcaattgcatcgggagaatttttgactgtcatcggaccgagcggatgcggcaaaagcacgcttttaaaattgattgccggtcttgataccgattataaaggctctgtcgcaataaacggccgcaatgtgtcgggaccgggcatccggcagggatttatctttcaggagcaccggctgtttccctggctgacggtaaaacaaaacatcgctgccgatctcaatatgaacgacccggccgttcggaaaaaagtggatgatctgattgaggttgtcaggctgcagggagcggagaacgcttatccgcgcgaattatccggcggcatgtcgcagcgggttgccatcgccagagcccttttgcgtgagccggaggtgctgcttttagatgaaccgttcggggcgcttgacgcttttacgagaaaacatttgcaggatgtgctgcttgatatatggcgcgagaaaaaaacgacgatgattcttgtcacgcatgatattgatgaatccgtctatttaggcgataagctggcgatcctcagggcaaagcccggccggctgcacagcctgatgccgattcagcttccgcatccgcgcaatcggacgtcagcggattttcaggccgtccggcagaaggtgctttctgaatttgagaaaacggaagacctccggtttgcggatgggtccggaatatagaagggacgaagcgaagtgaaaaaaatcatcattcttttagccgcagcagtcatgatgtcagccggatgcagtgcagacgggacaggagggggcgggaaaacggtgaaagaaatccggatcggcatccagcagagtttaagcccgcttctcattgccaaggaaaaaggctggtttgaagaggccttcaaaaaagacggaataaaagtaaaatgggtcgaattccaaagcggtcctccgcaatttgaaggtcttgccgccgataagcttgatttttcccaggtcggcaattcaccggtcatttccggtcaggcggcgggaattgattttaaagagatcgggctgtctcaggacgggttaaaggcaaacggcattctcgtaaacaagggcagcgggattcagagcctgaaagaattgaaaggtaaaaaaatcgccgtagccaaaggcagcagcggctttgattttctctataaagctttagataaagcggggctttccgccgatgacgtcaccatcatccagcttcagcccgatgaggcggtttccgcttttgaaaacaaatcagttgacgcatggtccatttgggagccgtatttgtcgattgaaacgctgcagcacggggcggaaatattggcgaacggagaaagcacagatttatattctcccggtttcacattagtcagaacgggattttccaaagaacacccggatgaggttgtccgttttctgaaagtgttcaataaagcagttacatggcaaaaggaacacaaagatgaagccgtctccttatatgcgaaaatcaaacatcttgatccgaaagtcgtcagaaacgtgcttaacaatactgagcctctcaatgaaccgatcgatgatgatattgtcaaagcccagcaggaaaccgctgattttcaatatcgaacaaaagcgattcataagaaaattcatgtaaaagacgttgtcgacaattcatttattaaaaaagcgcttgaaacgggggatggcaagtaatgaaagcagaagcatcaacggctgccggcgcaataagccaatcagaaaagaaagctctggcaagatcccggaagtattcataccaatggatgaaagggattgtactcccggctgcggtcatcgcagtatggcagtttatcgcaagtctgggcatcgtctcggccgcggtgctctcgtcgcctgtcgtcatcttgcagacgtttcaggaacttcttctttcaggtgagctttggggtcatttagagatcagtttataccgggcggctgccggatttctgcttggcgcgggcctcggacttgtttccgggctgctggtcggtttttcaaagcggacggaagcataccttgatccgtctctgcaaatgctcaggacggttccgcacttggccgtgactcctctgttcattttgtggttcggatttgatgagacatctaaaattctgctgatcgcattgggggctttttttcccgtatacattaatacgtttctcggaatccgcagtgtggacgcgaagctgtttgacgtcgcgcgggtgctggaatttaattggtatcagcagatgacgaaattaattcttccggcatctctcccgaatatcctgctcggcatcaggctctccctaggcattgcgtggctcggtctcgtggtggcggaactgatgggatcgagcgagggcgtcggttatatgattatggatgccagacaattttcacagacaaataaggtgtttgtcggcattatcatttttgcggctgtcggcaagctgacagatgcattggtcagaatgctcgaacggaaactattaaaatggcggaacagttatgaagggtaacctattaaaaaaggagagattcatatggagattctttggtttattccgacgcatggtgacggccggtatttagggacgcaaacgggagggagaacggcggatcatctttattttaagcaagtggcacaggcggcggacagactcgggtatacgggggttctgctgccgacggggagatcatgcgaagacccgtggctgacggctgccgctttagcgggggaaacgagtgacttgaaatttttagtggcggtccggccgggactgatgcagccgtctgtcgccgcgagaatggcgtcgacaatggaccggctgtcagacggccgtttgctcgtaaatgtcgtagcgggcggagatccttatgaactggcgggagacggcatgtttatcagccacgatgaacgttataaggcgactgaagaatttttaaccgtctggcgcggactcatgcggggcgaaacggtgacatatgaaggggaccatatcaaggtggaaaacagcaacctcctgttcccgccaaaacagtctccgcatccgccattatatttcggcggttcatcacaggcgggaattgaggctgctgcgaaacatacagatgtctatttaacatggggagagccgccggagcaggtaaaagaaaagattgaaaccgttaaaaaacaggctgccaaggaaggaaggacgatgcgttttggcatcagacttcacgtgattgtccgggagactgaggaagaggcatgggaagcggctgaacgattaatcagccacttagacgaagagacaattgcgaaagcgcaggctgcgctccggcgcgctgattcatcgggacaaaaacggatggccgatcttcataacggtgaccgctcgaagcttgagatcagcccgaatctctgggccggcatcggactggtcagaggcggagcgggcacggcgcttgtcggtgatccgcagactgtcgctgatcgaattttagagtatcaggcactcggcattgagtcgtttatcttttcaggctatccgcatctggaagaagcttattatctggctgaactcgtgtttccgcttctgccgtttcagaatgaacggactaacaagcttgagcgcagagtgggtgaagcaatgggaaacgaccattttgcaagaggaaataaagcgacagtctgatgacgtcgcaaggcggatcattgacggcgggcgctttctgcggattcatttccggggaaatgccggcagtgaaggcgggtattcacccgcctttttaagcgcttagcttgcacgatgctcatctggatgatatgatacaaaacgtaattattacgatttgttaggagtgctgaaatggcaaaaaaatcaaaagtaatcaaagagctcaagcggcagaagcttgttgaacaatatgcggacatccgaagagaattaaaggcaaaaggcgactgggaagcgctgagcaaactgccgcgtgattctgctccggccaggcttcataaccgctgtacggtgacggggcggccccgcggatatatgagaaaatttaaactgtccagaatcgcattcagggagctggcccataaaggccgggttcccggggtgaaaaaagcgagctggtaacataaaaaactccggatctgtcatgaaccggagtttttgccgtgcttatgaaaagtgaaaacataagccaaatgctgaatcatcatcagaatgaaaatcaaaagaatcggaaaaaaaggtagatgcggctgaatcagcggataaaacaaaagcagaacggctgcggccggcaatgagaagtaaacggcgatatacgaggaacggcaagctttagccgtcatcattcgttctctttcatcctgttcctcaaattcatcgggcactagcctatgctttttgccgtttcgttttttcttttcggcatagatatacaatgcggcacaaacggtaaacagcagaaacggagtgatattcagctcaaatgcaccgctcccctccgtttggaaaaactgagcgatccgcggcgccgcttccataaaggaaataagcgtccagcaggccaatccgtagagtgcaaggtgaaaacacgcttttcttttcaaactcattttttctcctcctccagccagaaaacttcctccatcggcagggagaaagcccggcagatgttaagcgccaataagagtgaaggcacataatctcctttttcaatcgctgcaatcgtctgtctggtggctccggcttcttttccgagcgtttcctgagaatagccgaatctggctctcagctcttttactttatttttcatcatcagggcgtacctcaagttttcttcttttttatattgtatgagattcttaacaaaatgtaaacctaacttaacatgtggacgaaaaaagaatttttttcgacaaattttttaacattcccttgacgaaaaaaaaatatacatgtaatattagaaacatcaaatcggtactgacaaaaaactttgatgcgggtgtagtttagtggtaaaacctcagccttccaagctgatgtcgtgagttcgattctcatcacccgctccatacatacgttattaacgcagtgtttcgtttctctgataaacgaagtattgcgtttttttatgtgaaaaaagacacgaaggcgtgtctttttatgaaagccaagagacggtatgcgtgcctccgtgaatttgttcaaacattttggttaaagatgatagcagctcatccgccgcgtcggcatgaaatgaaggcgggaaaaagatcagctgcagcattttctttgtgccgattgttacagggcgggtgttgatatgtccggtaaggccgccgaaaatgccgccagagtcggagaaagcaagtacgtgttctttttctccgattgtaatcgaaatcggttcatctatttctgcggcgtcatacgccatgataggcaatgaatatttcaaggagaaaaaaagtatggtatcatgggctgaattcacactttcaatgaatcgttcccgggaaatatcgccgagcataagctccatcggcgttttttgtcctgaaaaggcgggactgagctgttccattatacacgcccactctttaacaaaaggctgctcatctataccgccgtcagcataatcaaagtaaagagattcttgaaataaacggaggcggcctttcagcatttgcggagcaggcccgacttcgatctgttcatataagacggctgccgctttgatccccggcacccgttcagcaataagtggatctaaactgatgttcaagtgtgttcactccatttcgggatgataaaactctattatacccgtgcgggagcctgatcacaaagaaaggaggctgtgcaaaaaatgaatattcataaactgaaagaggaattaatcgaatacgccaaaagcatcggagttgacaaaatcgggtttacaacggctgatacgttcgacagtctgcgggaccggctgattcttcaggaatcactcggctatttatccggttttgaagagccggatattgaaaaacgggttactccgtctttgcttctcccgaaagccaaatcaatcgtcgccatcgcccttgcttatccttccaaaatgaaagatgcgccgaggagcacgagggacgggcggcgcggcattttttgcagagcttcctgggggaaggattatcatgatgtgctgcgggaaaagcttgatctgctggagaattttctccaaagcaaacatgaggatatccgcacaaagtcaatggtggatacaggagaattgtccgacagggccgtggctgaacgggcgggaatcggcttcagcgccaaaaactgcatgatcaccacgcctgaatacggttcttacgtctatctggctgaaatgatcaccaatctgccctttgaaccggatgtgccgattgaagatatgtgcggtacgtgcacaaaatgtctagacgcgtgtccgaccggcgccctcgtcaatcccggacagcttaacgcccagcgctgtatttcgttcctgacccagacaaagggatttttgccggatgagttccgcacgaaaatcggaaaccgtctgtatggctgtgacacgtgccagacggtctgtccgattaataaggggaaagattttcatcttcatccgcagatggagcctgatccggaaatcgcaaagccgctgttaaagccgcttttgaccataagcaaccgcgaattcaaagaaaaattcggacatgtatcgggatcatggcgcggcaagaagccgatacagcggaatgcgattttagctttggctcattttaaagatgcctcgtctcttccggaattaacggccttgatgcaccaagatccgcgccccgtcatcaggggtacggccgcctgggccatcgggaaaatcggtgatcctgattatgcggaggaattagaaaaagcgcttcaaaaggagcaggatgaagacgccatacgggaaattgaaaagggactggagctgttatcggtttctgagaagactaaaaccggccggtcctgacatatgtatagagaaaaagcacttggccggagttcaagtgttttttctttataaaatcgtatggtgggtggagcgcttgaagcatattattgaagatttagcggaggcccggcttcattatttaatcaacggaactgagatgaggcagaatgggcaggccggcgatcttgaggtcctgacgagaaaaaaagagctgtttgaaaaacggaaagttgatatcgtgaaagcgaaggcaaaagccgtcattgtcaaaagcagtcttgaggacgacggcacgttatgtgtcatgtacacgattcatttcgaatatttgtgcaaggagcatgacggacacctttacttagaagagcagattgaggaacggactgcatttctctatgatgagcttttgattaaagaccgggaagtaaagaaaaaaccggctggattttctgacggaaacagcgtaattgaatatgagcggagtgaacgggaagatttcgggcgggcgtttcaatacgaccgtctggctgccgtgcagtacgcggagaagttttggaataaacgaaatcccgcttataaaaatttcagcgataattgcaccaattttatttcccaatgtttacatgccggaaaagcaccgatgcgggggcatccgaacagaggctcaggctggtggatgaaggcaagctcgtggagctacagctggacggtcgcgcattcgatgaagatgtatctggcccaatccaaggcagggcttcgcgcagtgcaagtatcaagagctgaagaactgatgcccggagatatcatttgctatgattttgaaggagacggccgttttaatcatacggcgatcgtggtcgcaaaagataaaagcaatatgccgctcgtcaatgcccaaacgtatgacagcaggatgagatattggtcatatgaggattcaacggcgtatactccttccatcagatatgcgttttttcatattacggatgatacgacaaaagagtaattaatgatataatggtgggcggaataaaaaacagaggtgaacatcgtggcattacatgtcgttttatatcaacccgaaatcccggccaatacgggaaatatcgcacgtacttgtgcggcaacagacacaacgcttcatttgatccgcccgctcggattctcaaccgatgataaaatgctgaagcgcgccggactcgattattgggagttcgtcaacgtcgtatatcatgattcattggaagagttatttgaagcatatgaaaacggaaagtttttcttcattacaaaattcggtcaaaagccgcacacatcatttgattactcaaatacggaggaagactttttcttcgtattcggcagagaaacgagcggacttccgaaagaattgatcgaaaacaatatggaccgctgcctgcgtctgccgatgaccgagcatgtgagatcattaaatctgtccaacacggccgcgattcttgtatatgaagcgctgcgccagcaaaattacagagatttgacgtgagaaaaaacgcccgcatccgggcgtttttttattgaataaaaaagacgggcagcagcggtttacggcatttttatatttccgggcttaacaacgtaacagtgttatgttacaatacgttcatcgaaggagctggattcatggaggaacaactgatttctaaaaaagaattgctggaagaaacatcaatttcatacgggcagctgtaccggtggaaacggaaaaatttaattcctgaagaatggtttatccgaaaatcgacgtttacaggccaggaaacattttttccgagagcggaaatattaaaacgcatctcaaaaatacaggaaatgaaagaaaatctgtctctggatgaaatgagagaaatgctgtctccgcaaatgactgatgtcaatataacgtctgcggaactgcttcaaaagggactgatttcaaaagccgcgctgcaagtttatggcgaagacggcgtgacattcacgtcccgcgcgctgctgtctttatatgtgcttgaagggcttttgcaatcgggcaatatcagccttgaggaaggaaaattggcggcgggggtgctgaagacgtatgaggcttccgagctgaaagcgaatacggagcttgtcatgctccgaaagctcggcgtaacgacgtgcttcatcgcagacgcggaacatattttatttgaaccgactgtcaaagtggttgaacgggtggcgcttgctgcggcatcggaagaattaaaaacgaaatggatgcaggaggaccatcaatggaagtaacagataaattaatcattaacggttcgggaagttcaaaaggaggccgttttcatacagtggagatcaacgggagcggcacggtgtcaggtgatgtggagtgcacgagccttttgtttaacggcagcggaaaaacagacggacatgtcaagacgcaaacactgacaatcagcggttcggggaaaatttccggcagtgccgaagctgaatccatccgtatcaacggaacgggtgtcattaaaggtgatgtcaaaacggagcggctgaacgtcgcgggattttcatctttcggcggcggtgtgaaagctgatgatattttcatatccgggaaagccgggattgaaggtgattgcgagacagagacattccgttcggaaggcaaatgcaagatcggcggcctgctgaatgccgatgaagtcagtatgaagctggctgcgggagaaagtcatgtgaaagaaatcggctgccgccatttgaaagtgatgagcagaaagagcgtgcttacgcgttttaagctgatgccggccccggtgctgacagcagagctgattgagggtgacatcattgaattggcggacacgaacgcgaagacagtccgcggaaatcatgtgcggatcggcgcgggctgcaccattgggacggtggaatacagcggcgattttacatgtgatcctaccgctttggttaacaaagtcgtgaaacgataggaggagctgcaatggaaacgacaaaaaaattgagtcatttaaaaatgtacggagccggacacgcttccggcggttcctaccaaaatgtaagcattaaaggggaaggaactgtcggcgaaggacttcaaagcgaacgctgccggatattcggcacgggactttttctcggagatgccgagatcagcaggctgaaaattttcggagagcatgaagttgcaggagatttatcagcacattcagcaaatgtgatcggcacattgaaagtcggcggctccatgcgttttgccaggatgaggctgaagggacttgctgaaattggcggcggggccgcgggagaacagtgtcatataaaaggcagtctcaccgtcggcggcgattgcgagacggagctgcttcatgtaacaggatgtatcaatgtggcgggattgttaaacgcaggggacgtaaacatccatttgcgttatgaccgaagccgcgtgaaagaaatcggcggcacatcgattaccgtcagacggaaacccggttttcttaaacggaaagccggcatgctttctgctgaattgatcgaaggagacgcaatttacctcgaatccacggaagcggacatcgtcagagggaagcgtgtggaaatcggcccgggctgcaaaatcggaaaaatcgagtatcaaacaagctgtaagtctcatgaaaaatcaactgtccaagaacatattcaaatatgaaacattgttatgttgtacaggaaagggtgctcttcataaagagcacccttttgccgttatttgttttcaggtttgctgtcgtaacccgcagtaaaaatggatactaaaaaagtgagaatgaccccaagtaaaatgatcgttttcatcatgtctcctcctctttgcttttccatttgatgtccgagtctggatgaaactgtatttctttcattatgaacggtgcaccggacccttgtcaatgacggccttataacgtctttatttttaagaaacgaaaagcatgtattatcacgtcaccgcatagattgtaacaaagtaccttatttctagtgcattaaccatgatagaggaggttcttatggatatattaaagaaaattgaaaagtacagagaggaagagcagcgtctcaaatgggaagggacgttcgctgattatttggagatcataaaagaaaatccattggtcgcgcagtctgctcattctcgcgtttttaatatgataaaagacagcggaatcgaggaggatgacgggaaaaagacatacagctttttctcgagggagctgttcggccttgaggaatctctggaacggctcgtggaggaatactttcacccggctgccaagcggctcgatgtaagaaaacggattttactattgatgggacctgtcagcggcggaaagtcaactcttgtcaccatgctgaaaaaagggcttgaagcctactcattgacagataacggcgctgtttacgccattaaaggctgcccgatgcatgaagatcctctccatctcattccccatcatctgcgcgacgacttctacagagaatacggcatcagaattgagggcagcctttctccgcttaatgtcatgcggcttgaagaagaatacggcggcagaattgaggatgttaaagttgaacgtatattcttctcggaggataaacgtaccggaatcggaaccttcagcccgtctgacccgaaatcacaggatatcgccgatttgacggggagcattgatttttctacgattgccgaatacggttcggaatcagatccgcgcgcttatcggtttgacggtgaattaaataaagcgaaccgcggaatgatggaatttcaggaaatgctgaaatgcgatgaaaaatttctgtggcaccttctgtcactcacgcaggaagggaatttcaaagccggacggtttgcgctcatctcagccgacgaattggttgttgcgcatacgaacgaaacggagtaccgctcgtttattgccaataagaaaaacgaagcccttcactccaggatcatcgtgatgcctgttccttataatttaaaggtgtcagaggaagaacggatttatgaaaaaatgatttctgaaagtgatgtttctgacgtacacatcgcccccatacattaaaagtggccgcgatgttttctattttgacccggctgaaggaaccgaaccgctctgatattgatctcgtcaaaaaaatgaggctctatgacggagaaagcgttgaaggttacaattccgttgatctggaggatatgaagaaggaattccatgatgaaggaatgagcggtatcgacccgcgctatgtcatcaaccgcatttcctcaacgattatcagaaaaaatatggaatccatcaattcgcttgacgtgctgcgttccttaaaagaaggactcgaccagcatccgtccatctccgccgaggacaaagagcggtatatgaattttatttccgccgccaggaaagagtacgatgacatcgccaaaaaggaagtgcagaaggcgttcgtttattcatatgaagaatccgcgaaaactctcatggacaattatttagataatgtggaagcgtactgcaataaaaataagcttcgcgatccgctgacgggtgaagaaatgaatcctgacgaaaaactgatgagatccattgaagagcagatcggcatttcagaaaacgccaaaaaagcgttccgcgaagaaatcttaatccgcatatccgcctatgcaagaaaaggaaaacgctttgactataattcgcacgaaagactccgcgaagcgattcagaaaaagctgttcgcagacttaaaagatgtagtgaaaattacgacctccaccaaaacgccggatgaacagcagcttaaaaaggtcaatgaggtagtggcaaggttaatagatgaacacggctataattcgactagcgctaatgaactgctgaagtatgtcggaagcttgttaaaccgctgatatttgatttcattgagaggcccgtctgtaaaaggacgggttcttttgtctgtttttcgcaattgtttgtcaattggagagtccggccggcataagataaaaataaatcttttcgccggacttgtttcataaacaggaccaagccggaatacacatgtaaaacgaccataacggttaaggaggggaattcatgtcccgtaatgacagcggaaattttttgatttcagaggaagactggtccctccatcgcaaaggctttgacgaccagcagcgccaccaaaagaaagtgcaggaagcgataaaaaacaaccttccggaccttgtcactgaggaaagcattattatgtccaacggaaaagatgttgtgaaaatcccgattcgttcgcttgatgaatataaaatccgttataactatgataaaaataaacatgtcggccaaggcgacggcgacagcgaagtcggcgatgtcgtcgcaagagacggcgcagataaaaagcagggcgccggaaaaggccagggagcaggcgatcaggcaggcgaggattattatgaagcggaagtttcattgatggatctggaagaagcgctgtttcaggaattagaactgccgaatctgcagcaaaaggaaagggacaatatcgtccataccgatatcgagttcaatgatatccggaaaaccgggctgacagggaatatcgataagaaaaggacgatgctgtcggcctataaacgaaacgccatgacaggcaagccgtcgttttaccctatttatccggaagatctgaaatacaaaacatggaatgatgtgacgaagccggaatcgaaagctgtcgttttagccatgatggatacaagcggttcgatgggcgtatgggaaaagtatatggcgaggagtttctttttttggatgacacgatttttacggacaaagtatgaaacggttgatatcgaatttatcgcccaccatacggaagcgaaggttgtgtcggaagaagattttttctcgaaaggcgagagcggaggcaccatctgttcctccgtttaccggaagtctcttgaattaattgatgaaaaatatgaccccgcccgctacaacatctatccgtttcatttttcagacggagataacctgacttcggataacgcccggtgcgtaaagctcgtcaatgacatcatgaaaaaatcgaatctgttctgttacggtgaggtcaatcaatataacaggcattccaccctcatgtccgcctataaaaatgtcaaagatgataaatttaaatactacatcctgaaacagaaatcggacgtatttcaagcgctgaaaagcttttttaaaaatgaggaagccggtataagcaaagcatcgtattaaatataaagccgagtgaagaatcgtgcggccgcggttcttcacccggcttttttaaattaaaaataaagagaaaaaacggcataaaaaaaatccttaaaaaatgaaacttttctctttacaaaccttctttcatttattaatattttatcttgtgaactattattaagggaatgaggtgaaaatacggtgattgaatcagagctcgctttgctcagttttgaacaactgtttgatacttccagatcgatttacaaaaagcagaaaatgattctggagacagtgcttgaaccttttgatattacagtgctgcagtatctgctgatgttcaaaatacataagagcaaaagcacgcagctttcaaggctggctttgtcgcttgatctgaaaccggcgtctgtcacgagaatgaccgatattctgtataagcgccgcctaatggttcggagcgactatcacgacgaccggcgtgttgttatgattcagttaaccgaagagggggaagaacttctaaagaaagctgctgttcaatatgccgaaaaagcggcggtcttataccggcagctcaataccgctgaactgcagtacctgcgcaagcttgcggaaagtttaacgaagcttgcaaacggctgtgcagtgaaaaacggaaaataaaaaaatccccacatatttttatcatcattccacaaaatgatagaggaagaaacgaaaggagaaaacaaaatgaacagaggacgtttaattctgaccaacattatcggtttgattgttgttcttgcaattataggcggaggtgcttactactattatcaaagcacacactatgtaaaaaccgatgaagcgaaagttgccggcgacatggctgctatcacagctcctgctgcgggtaaagtaactgactggaaccttgatgaggggaaagaagtaagcaaaaacgacgtggttgcaaaaattaaaggacagcaaaatgctgacgtaaaagccatcatggatggaacaatcgtgaaaaacgaagtgaaaaacggccaaatggtgcaagccggtacgacaattgcccaggaaattgacatgaaacacctttacatcactgcaaacattaaagaaacagacattagagacattgaagtaggaaacaaagtagacgtaattgttgacggcgatcctaatacaacatttgacggaacagtagaagaaatcggttatgcgacaaattcaacatttgatatgctgccttcttcaaactcaagcggcaactacactaaagtaacgcaaaaagttcctgttaaaatttcactcagcaacccatctgacaaggtgcttcctggtatgaacgcatctgtaaaaatctctgaataatacagatcagtcatcaaaccatgaagggaggttgtcttaggtggctaaatcagataatcaagtaaaaagtcctaaaacattgcttattgtgcttatggccgggttattcctggcgatcttgaaccaaacgcttcttaacgtggcgatgccgcacttaatgaccgagttcggtgtgagtgcgacgacgattcagtggcttacgaccggatacatgctggtcaacggtgttttgattccgttatctgcgttcttaatcacccggttcggacagagaagcctctttctcgtagccatgttctgttttacagcgggaacgttagtctgcggaatcgcgcctaacttctcaaccatgctgatcggccggttaattcaggcggtcggcggcggtatcctgcagccgctggtcatgacaaccattctgcttatcttcccgcctgaaagcagggggaaaggaatggggattttcggtcttgcgatgatgtttgctccggcggtcggaccgactctatccggctggatcatcgagcattacacatggcgcattatgttctacggccttgttccgatcggggcaatcgttattatcatagcgtttttcctctttaagaacttggtggaaccgcaaaaaatcaaactcgacagcttgggtgcgattctatctattgtcggattcgcctcattgctttacggagtcagtgaagcgggcagcgacggctggggagatccgatcgtgctgtctaccgtcattgtcggtgtcatcgcgattgccgcgtttgtcattcagcaattgcgctctgaaaaaccgatgcttgacttccgggtatttaaatatgatattttctcactttccagtgtcattaatatcattattaccgttgcgctttacacaggaatgttcctgcttccgatttacctgcagaacttagtcggctttacggcgctgcaatcgggtctcttgctattgccgggcgcgattgtcatgctgatcatgtcgccgatttccggtattctgtttgacaaaattggtccgagaccgcttgcgattatcgggctggtcatcacggtcgcaacgacattccagtacacaaaattgacaattgacacaccttacacgcacatcatgcttgtctatgccatccgcgcattcggtatgtcactgttaatgatgcctgttatgacagccggaatgaaccagcttccggcacggttgaacagccacggcacggcgatgagcaacacgctccgccagatcagcggatcaatcggaacaagtttgatcacaacgatttatacgaaccgtacgacaatgcattattcgcagattgcggataaaacaagcacggctgatccaagcttcatgcagtcgttccaaagcgcggtttcgaatttaatggtcaacatgaacatgtcgcttgatgcggcgaaacaaaccgtttattcatatctctacaaaacagcttcactcaattccaacgttatggggattaatgacgcgtttatgtgggcgacgatctttgcggttatcggcgtagtcctgagtctgttcttgcgtgacgtgcggaaagacaaacagcgggcgaagaaaaaagaggagctgtcattgcttccggcccctaaagaagtgaaggaatcttaatcatctgaatgggaggtttcctgaatgaaaatttacgtagtgtacgatagtgaaggcgaacacacaaaacatcttgctgaagccattgccgagggcgcacgagaaaacgctgaggctgaagtcctgatcgaccatgtcgatcaagcagacatccgcaagctgaaagacatggatgccattatctggggatgcccgggacactttggcaccatcagttcaggcttaaaagcgtggatcgacagactcggctatctgtgggctgaaggcgagctgattgataaagtcggcgctgtattctgtacgacggcgacaacacacggcggattagaaatgaccatgcacaatctgatcactcctatgtttcaccaaggcatgattgttgtcggtcttcccggcaacgttcctgaaaacgcgctgtacggctcttactacggcgcgggcgtcacatgcccggttgacagcgatgtgctgatgacggaagaaggccttcaattaggccgtgcgcttggcagacgtgtcagccaggtcactggtaatctaactgccggacgacagtaaggagagggttatatggccattattatagcggttattgctgctgtcattgtgattgcacttcttatcaccttcaatgtccgcagcacttctgcaggacaggatgtcaaagaagaaaagagagaagcgatcggcactacagccgaacagccggaaaagcatgatccggccgaggagcgctcagccgagcatgctcccgtcgttgtaaaatctgaatctccccgtgagaaaaagaatacaatgggcgatgatgtgtaccgtcaggcgcttcagaagtttaagacttctgagacggatcaggaaccaaacgatcctgatagcggcggcaaaatgcaggatagcagctatcgtgatgcgctgctctccttaaaaaacaaaaagaagtaattgaaaaggcaaatccgcgtaagagcggatttgtcttttttttattgaagatattgtaatacgtgatgatctagtgtactatgttactcatacacttgatccgaatggagagagaaagaatgacatcgtttttaggtttgctgaaaaaagatgcgaaagtttcatggatttggctcgcggtgtggctttgcggcatgatttgctgggcgttttcagcccacgtcatcgctgcccgtcagaaagaaccgctcgtcattttcggcttttttacggcaatggggttttttcaatttcttgtagcgccgctttttatgtattatcaccttcataaagaaggaaaaaaccagctgtggctttacaatccgaatgggggattttatctgctggcttccaagctgacggcctcactgctgtatcagttgatcgggcagctggcgctgacgggttacggcatttggatgtaccggatgctttctgcaaaaggagtgctggaacacaccattcccctggccggcacattaaccgggctgaatgcttacctgctgatcagttcagcgtacttatctgtgatcgtggccgtattttggactgtttttcactcattaaaacattttcccgtcctccgttgggggatctgcatcgtgcttgcgtttgtctggacctatattgacgataaaatcattacgcctttcacttcatctcaacatgatttatggccggtaaaagtgtatgcgaattttcattttcattatacgaaattgtccggatggacgatggagctgaaagccgtccacatttcgcttttcagctttctggcagtgatcgtgcttgcagcgctctgtctcgcgctggcctctatactgctgaatcgaaaggttgaggtgtaatgatggagaatgaatttcagtcatccaagcccatttatctgcagattgccgatcgtatatattaccggctgatccgaagtgagctttcaccgggggacaaactgccgtccgtaagggagatggccgtacagatgaaagtgaatccgaacacgatacaaagaacgtacagtgaaatggaaaggctggggatcgtggagacgagaagaggacagggaacctttatagcggaaagatccgatctgaaagcagagctgaaagacaggctgacaaaagacgttttcaaacgctttattcaggaaatggcggagctggggttatctcctgaggaaatgctcgaggggatcaaacaatatgcggaggaagcaaacgatgaatcttgattttgaacgcgtaacaaaaaaatacggccgcaggatcgcggtcagcgatgtatcattttcattgtctccgggtaaaatctacggaattttagggccgaacggaagcggtaaatcaacaacgcttaaaatgcttgcagggcttgcttttccgacatcgggcgccgtccggatgggagagtgcaaagtaagcaggaacatgctgtttcgtacggcttatttaaccgaacatgatatgttttccgcccggacgaccgtcggtgatatgctcacgttttatcattcgcaattcccggattttcagctggaaaaagcacataacctattagcggaaatgaatctttcagcgaagcagaagttaaaagagctgtccaaaggcagccggggcaggctgaaaatcgttttggccctgtcgagaaaagcatcggtcattctgctggatgagccgttttcaggtcttgatccggcggtcagggagtcgattgtcaacagtctcgtatcttatattgattttgacagtcagatcgtcgtcatcgccacgcatgagatcggcgagattgagacgctgttagacgaagtgatggttttcataaaagggaaaatcgctgaacggcgcgaggtcgaagaaattcgggaacaggaaggaatgtccgtgctgcaatggtatagaaacgtcatgcaggcgcacgaaatagaagggggattctaattggaaacggtattagaactgcaacaggtaaagaaaacgataaaaggacgaacgattattcatgatctgagcttctccgtccgggcgggcgaagtgtttggatttttagggccgaacggagcggggaaaaccactacgatcagaatgatggtcggattaatgaaactgtctaagggagacatcgtaatctgcggggaatccattacgaaaaactatgcaaaagcggtcaggcacgtcggagccatcgtggaaaacccggagctgtacaaattcctgagcggctataaaaatttacagcagtacgcaaggatggtaaaaggcgttacgaaagaaaaaatagatgaggtcatcgagctcgtcgggttgcaggacagaatacatgacaaagtaaaaacctactctctcggaatgagacagcgtctcggcctcgcccaaagcctgctgcataatcctaaggtgctgattctggatgagccgacaaacggcctcgatcccgccggcatcagagaaatcagggaccatctgaaaaagctgacacgtgaaaaaggaatggctgtcatcgtctcaagccatcttctgtcagaaatggagctaatgtgcgatcgaatcggcattctgcaaaaaggagagcttgtcgatattcaaaaagtaagggatgaaggaaaagaggataaagatacatacttcttccatattgaacaaagagaagaggctcttgccgttttgagtcagtttgactgtgtgaagaagacaaacggcattgagatccagctgtccaaacaggaagtgcctgatgtgatatcactgctcgtccgtgaaaacatccgcttatatgaagtgaaaatcatgacaaaatctttggaagaccgtttcttggaaattaccggcgggacgaaagaggaggttcaatatgtttaagctgatctataatgaatggattaaaattttcagccgcgtcggcacgtgggctatgattgtgattttaggcgtttcgatgatcggttttgcgcttctgtcaaaccatttcacctcgaacgaagccaatccgaattggaaacaggagctccaggctgaaaacaaagaaatgaaacagcagatgaaggaaaccggaaatcagacgctcattgataacctgaaacagaatgtcgcgataaatcaataccgtatggatcataacatccccgaggatacagggtacacagtgtggtcatacgtatctgattcttcgatgatgactgttttgaccgggctgtttacgattatcattgccgcaggcatcgtggcgaatgagttcaactgggggacgatcaagctgctggccatccgtccgctcagccgttttcagattttgctttctaaatatatgacagtgctgctgttcggactgctgatgcttgtgattttatttgccggctccgctctgttgggattggtctttttcggtacaggcggagatactgcggctgatgttcatctcgtatacaaagacggccatgtttttgagcaaaatatcatcgctttcctcgctaaaacatatgtctatgaatctgtctccgcttttatgcttgcgacgatggcgtttatgctgtctgcggtattccggaacagttcattagcggtcggattttctatttttctattggttatggggaacacggcgacggtatttcttgctgcgaaatttgaatggaccaaatatattttatttgcgaacacggatttgtcgcaatatatgaacgggactcctttagtagaggggatgacgatgacattttcggttgtgatgcttgtgatttacttcgttatttttctggcgcttgcattcggcgtcttcttaaaacgggatattgccacctgatataaaaaagctgttttgcctttgcaaaacagcttttcgttttagatgaaaaaaacctgccggcgtacaccggcaggtttttttaaacaatttatgcttttgttacgttagcagcttgtggtccgcggtttccttcaacgatttcgaaagaaacagattggccttcttctaaagttttgaagccttcgccttgaatagcagagaagtgaacgaatacatcgtcttgaccttctacttcgatgaatccgaatcctttttcagagttgaaccattttactttaccttctaacatgaaatttcctcctaaagcgacaaacgcttaaattcactattcttgctctaaaacaaacttccaagacgaaaactcttacaaaactttcttcttaaagatagttcgaacaaaaataattacctttactctaccagtaatccgaagaaaaaacaactgctaaatgtaacttttttcgaaataacatgttttaagaggaaaacgctctgatacggaaatctgatttgagaccagaacagcccatttgcagctgataaaaaccgctttgcagcctcttaaggaagcaattgacaaccctttttttaatcggtattgtatgtaatcatgagcccgaataccatggtgcagcttctgtacataaaaatagatagggagtaggtcaacttgaatctgcggcttataaacagtctgtttcttttcattttgatcatgtcacttacttcatgcgattatcctgacgggaaccggaccattactatcggaatcaatgaatctgatcaatcgatctgggagtttgtcgcgaaaaaagccggtgaggaaggattgcagctttctttggtaacgttttcggattatgctgaggccgatttggcacttgccggcggggatctcgacgccaatgcgtttcaatccgttactaattttaaatctttgccgcctcacgtgaaaaagaagctggcccctttaggaacgacatatgcggcatcgctgggggtgtattccaagcaacataaacggctgaaggatataccggacggagcggtcattgccgtgcctgatgaagcggcggccttcggcagggcgctttttctcatgcaggaggccggactgattacattgaaaaagggattcagcggtacggggtcaacggatatgatcaaggacaacccgaagcatctgaccttaaaaacggaaacaaaaaagaacgcctatcaggcggcggaacatgctgacgcagcagttctcagtcaaagcgaggcgaaaaaagcaggatttcatgcggagaaggacgcgctgatccgatcggcgcaaatgaaggaagcgtatattcatctgatcgccgtcagagctgaggataaagatgatgaacggatgcaaaaactcctgtctttgtatcaatcagatgataccgcggcgttgattgaaaaagaatatgagggcagcctgattcccgttttcctgaggggcggctttctcactgaaaagaaagaatgatttcctcttcgggcgatcattcttttttttcagtgctgcacacttgattgcgccctgatgttttcgctttgtacagcatccggtccgcgatcaggggcaatgtctgagggtccggtgtatttgtcggataatgcgcgatgccgagggaaacggtcacgggaattgtatctccgctcgtcagcagaatcgggttcgcgtcaatcgtgtgcctgatttcctctgcgaggtgaagcccttttgtatacgtgcaattgggcataagcacggcaaattcttccccgccgatgcgggctgacgtatgagaactgctgagtaagaacctcaggcgcgcccccagttccttcagcacttggtccccttcataatggccgtattgatcattgatctgcttaaagtgatcaatatccaaataaataagcgcgagctgagacgagggggattgagacgtccgatcgtacagaacgcgcgagacttcctcgaattttctcttattaaaaatccccgtcagaaaatcataattcgcttgaaacttgtattgcttgaacaaaacgcgggcatcggcttcgtgtttgatgatatacagtgacagcattccgcccaagatggaaatgagccaataataaacgagggccccggcaggctgttcaggcataagaaacagcagcgtcaaggtgaaaataacatttgaaaaaagcagcataacgaacgccattttatgatccggcttttttcctctgaggacggccgcagaaagtatcgcaataaccccgacggcggcgatggaaaaaatggcgcttgcattgaaattgatcaggatacggcctgcgacgataatcgcaaaggcggctgccgtagacacccagcctccgtaaagagcggcgatgataatggggatatttctgagatcaatgatggaatcggagtaagaaaagccgaaagcaatcagaaaaacccctaaaagcccgcagaccgtccccttcagtaattgaaacatcggacggtcttctttatacgaaagcgactctttaaaaagaagggtgaacagataattaaatgtgattaaaatcgttaaattaagaaacagttccttcagcataacaatcacccttatataagttactagagaaagggtggaaagaaaagagaaaaatcaataaaaatacatatattgtcaatccttacttgaccgatcggaattgatataatatagtgttaaaggataatgagcaagggagtgtttacctgttttggagaatttatttgtagtcttacatgtttttattatgcttttgcttatagcaggtctgtttgtcatgcaaaaaaaacacgtttccttttctaaacgtgtctttaccgcgctcggactaggcattgtattcggttttgcactgcaattgatttacgggccggcatcacatatcgtgacacaaacggccgattggtttaatatcgccggcggcggttatgtcaaattgcttcagatgatcgtcatgccgctagtctttatttctattctcggcgcatttacgaagctgaaactgacccataacatcgggaaaatcagcggactgatcatcggaattttgatcgccacgacagcaattgccgcggcagtcggaattgtttcggcgctttcttttgatctgaaagccgtccatatcgaccagggaagcaccgagttatcaagaggccaggagctgcagcaaaaatctgaggatatgacggccaaaacgctgcctcagcaaatcgttgagcttctgccgggaaatccgtttcttgatttcacgggagccagaccgacttccaccatcggagtcgttattttcgccgctttcctcggcatcgcttttctgggcgtgaaacggaagcagccggagcacgctgcgacgttcagcggaattgtcgatgcggtatacgcgattattatgcgcgtcgtgacgttaattttaagattgacgccttacggggtattggcgattatgacaaagacgatcgcgacaagcgacatcgacagcattgcgaaactggggatgtttgtgatcgcttcatacgccgcgcttatcgtcatgtttatcgttcacctgctgctgattacgttcagcggtttaaatccgatcacatacgtgaaaaaagcatttcctgtcatggtgtttgcgtttacgtcccgttcaagcgcaggggctttgccgcttaatattaaaacgcaaaaaagcatgggcgtccctgaaggaattgcgaacttcgccggttcattcggtttatcgatcggccaaaacggctgtgccggcatttacccggcgatgctcgcgatgatgattgcgccgacagtagggcaaaacccgtttgaaccgggatttatcatctccgtcatcgccatcgtggcaatcagttcattcggtgtagcaggcgtggggggcggcgcgacatttgcggctctgctcgtcctatccgctttgaacatgcctgtcgcgcttgccgggctgctcatttcaattgagccgttaattgacatggggcgtaccgccttaaatgtcagcggcagtatgaccgcagggctgttaacaagtaaaatgacgaaggaaaccgataccgcggtgtacaatgattcctcaatcgtcattgaagctgaagaagcttaataaaaaagcagatagcgctaaaacgaaaaatccttcatcgttgaacgaatgaaggatttttttcgtttctaatgatttccgggttcaatttcttccagcatattcatcacggtgctgtcatttaaaacatttaccgcgctttcttcgaagtgaatcggctcggtatagtgaggcttcggcgaagtttctttactgcggtctgcctgtccgtccgtatgggatgagccggagtgattgcgggaagtctgctcatgctgctgtccgccggattccccgccgaaagcctgtttgatcagctcggcaggctgcacggagcctgtttgtgaatgccgtgctttgtccgtgtgctgctgtccgccggattccccgccgaaagcctgtttgatcagctcggcaggctgcatggagcctgtttgtgaatgccgtgctttgtccgtgtgctgctgtccgccggattccccgctgaaagcctgttgaatcaggtcagcaggctgcatggagtgtgtaccatctttatgctgcattcggcctgaaaccattccggagattttccggcggatttcgggtgataaagctgcaatcagaatcgatgatccgatcagcagcgctgtcgggctgatgccgcttttttgtctgaacaagttaaatccctcctcattcaattgattacgcttacctttccctatccttctgatatttatccaaaccgctcagaatgcaaacggcgtgcataaatcccgccgaatagaaaaacctatacgtaaagtgagaaaggaggaattcacatgataaaaaaacaagcagttatttctgcccttcttctgccgatgctgattaccgcagggtgcagtatggggaaccagggagaaggaaaacgaaatgacaaccgcacccagaatgtaaattaccgcaacacacctaacgacggtgcgacaaatatgaatacagtgaaccgtcataaccaaaacaccgatcacaatgacaaccgtaacctgagagtggctgataaagccgcagacaaggtgactgatttaaaagaagttaaaaatgcgactgtgatcgttgccggaaacagcgcttatgtagccgttgttctgacaaacggacaaaaaggcgccatcgccaaccatttgaaaaataagattaccgataaggtgaaatcagccgataaacatgtccggactgtatatgtatcagcaaacccggacttcgttgaacgtatgcaaggctacggaaaacgaatccaaaacggccacccggtatccggactgtttgatgaattcggccaaatggtgcagcgtgtattcccaaaccccaataaataaatgaatggaaaagccgcatttgctgcggcttttttattttatctgccgtcacgacccagcgcttctgagcataaagtaaagaatgagatgaaaattaaaggatcggggaggggagcttgtttgcgtgacggcatggggaaacgggcggcattcactctgatcctgtgcggagtccttgtcatattggctgtcagttcagccgtttcagtaagtatgatgtacgtcctgtcaggccaaaacagccgctctgttccgacgaaggaacaagtgactgaacacatgaataaagaaatttacaaacatacagcgatttactatacagcggatgaaaagccgctcttggatctgaccaagcttacgctggaccacgcaaagcgtatcaaccaaatcattgtcggctataaaggagcggcgcctcttgaactcattttcttttcggatgaagctgaaatggagcaatactcaggattgaaaaatgtagtcggtttttattcagagcaggagcagatgatggggctcttgccagaagagaaaaaacagcttttgaaaaaagatgagctggccgttttcatgtataagcaattgattatacatgaatatacacactacgcatttcatcaaaaagcgcggcaattggggacggatacgtctgtatttccgctttggtttcatgaggggctgagcgagtgggttgcgcattatgatgtggtcattgatccgattgcattttccgtcgtgccgtttgatcaattaacgaccgaccgaaaatggcagaaatcgcgtatggaatatgaaacggatgtttatttgcaaagtttctatatgataaaggatttaaccgaaacattcggagaaggcattatcttaaccattatcaataaaaccgccgaaacacaggattttgaaaaaggctttgaagcagctacgaaagaaagcctgaaacaatttgaacatgatttcacaaaagcatatgaaaaaaagaaaacggcattggagagtcagctttccaacgccgtttttttcattaatggaggttttgctgctgctgtcccatttgtcctttaatcggaggcatttgcggctgtccctgcgccggcgcaaatgaattcagcatggtctgcatatcttgtgcattgagctgaggaacctgataataaccgtgtttgttttggtataagaagatttcatacgccatttcgacatattgctgaatttgggcggagagcactcttcttgtgacgggattggtcatttcaagcgagctcatcgtcaagagagaagcttgagctttaatcaggccgagcatatggccgcttattccgagatctttgacatcatttaatgattgattcggttttttcggctgagtcggttttataccgtagacggcctggttctgttcctccatcatatatgtcgacgtttcctgagaaggcttttggccggtcttaaagcattctgccgtcagattatagagtccgagaatgaattgatactggcggtcaagaatgtcggccagctgctgatcctgtataaactgtctgagcatcataaattgatccaaaacgccgactgttccggccagcacttcatgcatatcgaaaagctcatgtcctccgtgattcacttgcggtgaacccggaatcccctgatttactggcggctgctgctgattctgctgctgttccactggttgttttcctccttcatgtcaaatcacatttaagatgtgaaaaaagccgatccgttatacatcaagacttatttcgttacgtggggattatttactattttgcgccagcgaagacaatctttacaaaaaagtgatgtgatttttaagaaaataagctaacgtatttcttagaagacaggggggaaatgaatgaagaaaaaaaggggtttgcgtctttcgtgctgtttgctgacggtttgttttatgatgttcagcgtgaaagatgcggaagcaatcggacaagccggatcactgaatgaagctggaacggataaagcgtataaagaacggcagactgaagactccggccgtatcccgctcagaatcatcagcatgaatgatctgcacggaaaaattgatcagcaatatgagcttgaccttaacggagacggtaaaccggatggcactttcggacggatggactacgccaccgcgtacattaaaaaggcgaaagccgagaaagaacacgcctttgtcgtgcatgcgggcgatatgatcgggggcagctctcccgtgtcagccctttttcaggatgaaccgacagtagaattgatggaagacatcggttttgatgtcggaactgtcggcaatcacgaattcgatgaaggaacgaatgagcttaaacggatcatcaatggaggagatcatccggacggtaaggggacaagcggttatgacggccaagatttcccgctcgtctgcgccaactgtaaattgaagtcaggggagtcctttctgccgccgtatgaaatcaaatacgtttccggaattccggtcgcatttatcggggttgtaaccagatcggcggcaggcatggtcatcccggacggaattaaaaatattacgtttacggatgaggtaaaggccgtcaatgacgccgccgcagacctgaagaaaaaaggaattaaagcaatcgccgtgctcgcccatatgtctgctgaacaaaatggctcagccatcacgggagaatccgcaaagcttgcaagcggaacagactcagagattgacgtgattttcgccgcgcacaatcataaagtcgtaaacggagaaatcaacggcaagctgatcgtgcaggcatttgaatacggaaaagcaatcggaatcgccgatctcgaactagataaagagtcgaaggatatcgtgaaaaaatcagcggaaatccaatatatcgatcaaagtaaaatcaagcctgatccggatgcggcaggcatattaagcaaatatgaagagaaagtgaaaccgattatcagcgaagcggtcggggaagcggcccatgatataacgggcgggtattcaaatgacggcgacacggcgctcggaaatctgattgccgacggtatgaaagcgaagatgaaatccgattttgcgcttatgaatgggggaggcatccgggacggcataaaaaaagggccgatcacatggggagatctttataatgtacagccgttcggcaatgtgctgacgaagcttgaaatcaaaggaaaagatttgcgggagatcatcaacgcgcaaatttctccggtgtacggaccggattacagcatcagcggattttcctatacatggaacccggaaaccggacaagcggcggatgtgaaaatggcggacggtacagacatacagcccgaaaaaggatatacagtaacagtcaatcaatttatggcgacggcagcgggggcaaaatacggtccgatcgggaaactcggcaagaatccggtgacggggcctgaggatttggaagcgacagtagactatgtcaaaagcttttccgcaccgatttcttatcaaaccgacggccgcatccgcacggcatcagccgccgaaacacctgatgacaccggcaatcagccgggaagcggggaaacaccgggcagcaccgggcctgataaaggagaaaaacctcaaacggaaaaacccgctaaaaaaccggatgcagcagaacagcctgatcaaaccaaaaaacctgaacgtcctgtcgtaaaagaagcagcatctgatacagtgcagtcaattcccgaatcccgtacggcgtctgccgcagattcggaacaaagcacagaacagactgaaagcggcacacaaaaaggccgcccattgcctgatacttcagcgggcagccatcagacggcattggccggcctggtgatcacgggtgccggcgtatattggcttttcagaaagaaaaggggaacccgcacacgatgaacaaactgaaacatattccgcttctcgtcatcatcgcaggtgttatcatcacatgttacggaagctggaagatcattgattcacatatgaaaacgaaccaatcgcttgaagaagcaaaaaaagcaacagaacctgtcttggaaaagaacgaaacaaaaagcgctgtgcaggcacagcgcaaaaaagaatttcaccccgaaacgggtgaggcaagcggcattttagaaatccctgaaattgacgctgagctcccgatcgtcgaagggactgacgcagatgatttagcaaaaggcgtcggacattataaggacagctattatcctggcgatcacggccaaattgtgttatccggccacagggacacggtgttccgccggaccggcgaactgaaaaaaggagacagactgaacgtgattttgtcttacggcacgttttcttataaaatcagccgtacaaaaatcgtcagccgggatgatacgtctgtcatcacccttcaacacaagcgggaggaactgatcctgaccacttgctatccgttttcttacattggaaatgcgccgaaacgatatattatatatgccgacccggtttaagaaaaatacgtttcggtaaaatgagccagatcagccggcatcggcgcctcggcaacgatttcttctcctgagatcggatggacgacactgacttttttggcgtgaagcgcctgcctgtgaaacagcgccctgcttccgccgtacaggtcatcgcccgccaacggatggccgatgcttgccatatgcaccctgatttgatgtgttctcccggtttccagttcaagctctgccaatgtaagctgcgcaccgggatgatagcccttcactttgtaatgggtgacggcggcttgtccgccgggtgagacgcgccgtctgacggaatgtgacctgtcgcggccgatcggcgagtcaaccgtgccttttttcggcgtgacttttccttccgccgcggcgatataggtgcgttttaatgttttggtttcgagctgacggtcaaggattgcatgggccaggcggtgtttcgcgaaaacgaccgcgcctgacgtgtcacggtcaagacggtgaacgtggcgcactttcgcttgttcgccgttgatttgaaaatggtaagcgatcaggttgctgagggttccggtctgaccctcttcatttggatgagtcggcattcccgccggcttatttgcaatcagcatatgactgtcctcaaataaaatgtccggctctccgtattcaggaattaccgaagaacccgttttttcctgaagatcaatgaataagcggtctccggttttcagtatgatgttgtttttcggggatgtccgattcacctgaatgcttttttggttcatccattccgttatcacgggttttgacgcctggaattcagatttcaggactgaaaacagccattgtccggcgtgtttttccgtaatcaggagttccagaccgcggtcattttgtttcatatcataaagctccttttcaagcggaaagcggctgtttcaataggaaacacttaccttagctttcgcgtttttttctatgctattcttgataaagattaaggatattcacatggcaagaaaggtgattgatgtgagaattgtgaacgcagcgactgacggacaagaaagcgcgatacaagagctttcctctgaattgtttcaaaatgtctttcctctttatttctccgaactggaaattcagcgctttaaaaaaaggggcgtattgtctttacaaaaccaacgttaccaaggaactttaaaagaagcgtttcaaattatggcttgtctgcaaacggtacatatcatgctgtcaaagccgcaccccgtatatgacgtcaaagagcgggcgctgtttgataaaaattgcgctttgctgaatgaatgcggaatgaattttccctttacctatgatgatttcgagacaggggccggatcagaagcctgcggtcacagaaggctgatctgacgggtataaagagccttttgacaggctcttttttgcttccttgacatgataccacaatttctttcctctaactccctttataatgagtcaaatccccgagcataataaaatgcgaaaggggtgctttacaatgagttcaatcaaacaatcaatgactacccacgtggctaccgtttctcccaaccaaacgatccaggaagcggctgcgctgatgcaccagcataatgtcggagcaattcccgtcgttgacggaggggaattaaaaggaatgctgacagaccgtgatatcgcattgagaacaacggctcaaggccgcgacggccaaacacctgtttcacacgtgatgtcttctcaagttgtatccggaaacccggaaatgagtcttgaagaggcgtcacatctgatggcccaacaccaaatccgccgccttcccattgtcgatcaaaatcatctggtcgggatcgttgcgcttggagacttagcggtcgatcagcgttcaaatgagtctgcgggagcggctctttccaatatttccagtcaaaacacacagtaacggatgaagagagcttgcactcatgcaggctcttctttccgtgagaatgttacattttgaatgcaaaagaaattcacggtatagtgtatacataggtcagtacgtttagctaaaggagctgtaaccattgataaaagcattaatctttgattttgacgggttaattttagatacagaaacccatgaatatgaagtgctgcaggaaatgtttgaggaacacggttcaacattgcctttatccgtctggggaaaggtgatcggaacggcggcggggtttaagccgttcgcatatttagaggagcagctgggaagaaagctcgatcatgatgaactgacggcgatcaggcgcgggcgcttcgaacagcggatgaagacggaaacggcgcgtcccggagtggaggcttatttagccgcggcaaaagaattaggattgaaggtggggctcgcttccagctcagattttaaatgggtgtcgggccatctgaaggaattaggcctgtttgatgaatttgaagtgattcagacggctgacgacgtagaagaagtgaagcccaatccgaagctctatctgaaagctgcggaacatttaggcgttgaaccttctgaatgtcttgcctttgaggattcggtcaacggctcaatcgcagccaaacgcgccggcatgaaatgtgtcatcgtgccgaataaggtaacgagcgccctgttatttgaagaatacgatcacagactggaatcgatggcggaaatggaacttgaattactcttacagcgattgaacgatcaaaacgaaccggcagggggaagcagcattgtctgagaaacttgatctgacccgttttgaaaagaaaatggtcatacggaatatggaagagaaagatatcaacaaaattattgagctgcaaaaggattgttttccggggatggagccgtgggagcctgagcatttaatcagccatctcgcgcactttccggaaggtcagttttgcgccgagtatgaaggggaaattatcggttcatgctcaagcctgatcatcaatttcgatgaatatgatgaccgccacacgtggcaggacattacagacgacggttatatcacgaaccacaacccggacggattgaatctgtacgggattgaggtaatggttcacccggaatacaggcggatgaaaatcggacaccggctgtatgaggcgagaaaagacttggcgagacgattgaatctgaaaagcatcattatcggcgggcggattccgaattatcataagtatgcggaagaaatgacggcgagagcctatgtcgaacaggtgacgcgccatcagatttatgacccggtgctttctttccagctgatgaacggatttacgctcatgcggatcaatccgaattatctcccggatgacaccgcgtccattaaatatgcgacattaatggaatggaacaatgtcgattatctgccgcagtcaaagcgctattacaaatcggcatttccggtgcgcatctgcgtcattcaatatgaaatgaaaaagatttattctttcgaggaatttgccaatcaggttgaatattatgtcgatgtggcttcagatgcgagatctgatttcgcggtattcccggagattttcacgacgcagcttatgtcatttctcgaagagcgttctccgagtctggccattcagaggattaccgaatataccgaggactatatcagcctctttacagatctcgcggtgaaatataatgtgaacattatcggcggctcccacttcgttgaagaagaggggaaaatttataacatcgcctacttattcagacgtgacggcacgattgaaaaacaatataagcttcacattacgccgaatgagcggaaatggtggggcatcagcgccggagacagggtgcgcgtatttgatacggactgcggaaagatcgccattcagatctgttacgatatcgaatttccggagcttgcgagaattgccgcggatcaaggggcgaaaattatctttacgccattctgcactgaagaccgccaaggctatttgcgcgtaaggtactgctctcaggcgagagcggttgaaaaccaaatttacaccgtcatctcaggtacggtcggaaacctgccgcaaacagaaaatatggatattcaatacgcgcagtcagccatttttgctccgtctgattttgaattcgccagagacggaatcgtcggtgaaacgaatccgaatatcgaaatggtcgtgatcggggacgtggaccttgaaatcttaagaaggcagcgtgaaaacggaaccgtgcgccagctgaaagaccggcgcaaagacatttaccggattacgcatctgaaataaaaaaacgcccgccccgcttaagggcgggtttttttataaaaacacttgcaccggccccggtttcgggatatgctcttgtagccctttcgctttctgggagaaagcgtttttttaattgccgccgctttattgactcgcccatgccgcgcctttatattcttattaagaggaaaacttcaccatgagaatcggcgtcagaagccgggcagctttcgatacagtgcaatgatattgaaagggagatgagcggtgtggaacatgtacaaaaaaatcagtcactcaaacaaaaggataaagagctgatttggcacgcgatgaaaggggcggagccggatgacagcataatcgtccaaaaaggggaaggcgcctgggttacggacattgacggcagacggtatttggacggcatgtcaggattgtggtgcgtcaatatcggatacgggagaaaggagcttgccgatgcggcttacagccaattgaaggagcttccttattatccgctgacccaaagccatcaacccgcgattgagcttgcggaaaaactgaatgaatggctcggcggcgattatgtaatcttcttttccaacagcggatcggaagcaaatgaaaccgcgttcaaaattgcccgccaataccacattgaaaacggcgatcacagccgcttcaaattcatctcccggtacagaggctatcacggcaatacgatgggggcgctcgccgctaccggccaggcgcagagaaaatataaatatgagccgctctcacaaggttttttgcacgcggcgccgcctgatctttatcggaatcccggcgatgccgtcacattggaaagcgcgcatgaaatcgaccggatcatgacgtgggagttaagcgaaacgattgccggcgttattatggaaccgattattacaggcggagggatactgatgccccggacgggtatatggcaaaggtagaggacatttgccgccgccacggcgcgcttctgatcagtgatgaagtcatttgcggtttcggccgcacgggagagccgttcggatttcagcattacggcgtttcaccggacatcgtcacaatggcaaaaggcattacgagcgcttatctgccgctgtcggcaacggcagtaaaacgggagatttttgaggcgtattcgggcggtgagccgtacggccgcttccggcacgtgaatacattcggaggcaatccggcagcctgcgcccttgctttgaaaaacctgcaattgatggaggacgaaaatctgatcgcccgctcccgggagcttggagaacggctgctccgtgagcttgagccgctcaaagaacatccggcggtcggcgatgtacggggcaaaggccttcttgccggcattgagctcgtcaaggacaaaatcacgaaggaacccgctgatgccgctcttgtgcagcacgtcatcaccgcgtgcagagaaaaaggcctgcttgtcgggaaaaatggtgatactgtagcgggatataataatgtcattcagctgtcaccgcctttttgcctgtccgacgaggagctctctttcatcatttcgaccgtcaaggaaagcgtgctgagcattgatttttaaagtaaaggagtaaaacatgagttttcacaaccagaagattctaccggctatccggaacatgaagcaattcgatgcatttttagagagtccgttcttatacggcgtcattttagatatacacctcggtcaattaaaaggtgtcgtgaatgaagcgaaaaaacacggaaaacttctgatggttcacgtcgatttaattcacggcattaagcatgacgaatacggtgcggagttcatttgtcaggacatccggcccgcgggcatcatttcgacgagatccgccgtcatcgtcaaagcgaaacaaaagaaaatatacgcgatccagcgtctgtttctcttggatacgagcgccatggaaaaaagcatggaattcgtcggaaagcataagcctgactttatcgaggttctcccgggcatcgttccgactttaatcagagaaattaaagaaatgacggggattccgatttttgccggcggcttcatccgcacggagcaggacgttgaaaacgccttgcaggcaggagccacggccgtgacgacttcagacaccgaactatgggctaaatatgaacattctatgacaaaaaaagattgacaccgcttacacccattgttacaatagacctaggttaatactatgtgatggagacccggagacccacaacagctctttacggaagcaataaagcgtaaagcggtttgttgtgggttttttattctctataactctgtcaaacctgctattttgtcatttaggaggaatgatgatgacagcattttggggagaagtaatcggtacaatgctgcttgttattttcggcggcggcgtttgtgcgggagtcaacttaaagaaatcgctttcataccaatccggatggattgttattgtattcggctggggattgggagtagccatggcggcatatgccgtcggcagcatcagcggcgctcacttgaatccggctttaacgataggccttgcgcttgaaggcagctttccttggaaagacgtccctgtttatattgcgggacagatgatcggagcaatgatcggtgcggttgttgtgtaccttcattatctgccgcattggaaggcgacggatgatccggccgctaaactgggcgttttctcgaccggcccgagtattccccatacatttgggaatatgataagtgaagtcattggtacgtttgtgcttgtgctcggcattttggcaatcggagcgaatgaatttacaaaagggctgaacccgctgattgtcggattcctcatcgttgccatcgggatttctcttggagggacgaccggatatgcgatcaaccctgcgcgggatttggggccgagaatcgctcacgcctttctgccgatcccgaaaaaagggccgtcaaattggaaatatgcctggattcccgtaatcggtccgatcatgggcggtgcgttcggcggcgtattttacaatgccgcgtttaaaggaaatgtgacacctagcttttggtttgtaagcgttataatggttgtagtgcttttcatactctatatttataccaagaaatctcaatcacagaaaacattatcaaattctgaatatatttaaaaaggagagcggcatcatggagacctatattttatcaattgaccaaggcacaacaagttcaagagcgattctttttaataaagaaggaaaaatcgtgcattccgctcaaaaggaattcacacagcatttccctcagccgggctgggtggagcacaatgcgaacgaaatctggggatcggtgctcgccgttatcgcgactgtgatttccgagtccggaatcagcgctgatcaaattgccggcatcggcatcacgaaccaaagggaaacgacggtcgtatgggataaagataccggaaagccggtatacaatgcgattgtgtggcaatcgagacaaacatccggcatttgcgaagagcttcgtgaaaaaggatataatgatacattcagagaaaaaacgggacttttgatcgacccttatttctcaggaacgaaagtcaaatggattcttgacaatgtagaaggcgcgcgggaaaaagcggaaaacggaaatcttctgttcggaacgattgattcatggctcatctggaaaatgtccggaggcgcggcgcacgtaacggattattccaacgcttcaagaacgctgatgtttaatattcatgaattaaaatgggatgacgagctgcttgatattttaggcgtgccgaaatccatgctgccggaagtgaaaccgtcttctcatgtgtacgcgaaaacggttgattatcatttcttcggtaaaaatattccgattgcgggagcggccggagaccagcagtctgcgctgttcggtcaggcgtgctttgaagaaggcatggggaaaaacacatacggcacaggctgctttatgctgatgaataccggagaaaaagccatcacttctgatcacggccttctgacgacaatcgcctggggattagacggaaaagtcgagtatgcgctggaaggaagcatctttgtcgcaggttctgccatccaatggctgagagacggcatgcggatgttccaggattcgaaagaaagcgagacatacgcagagcgtgtggattccgctgacggtgtttatgtcgtgcccgctttcgtcggattgggcacaccgtactgggacagtgacgtgcgcggctcagttttcggcctgacacgcggaacgacgaaggagcattttatccgtgccacgcttgaatctctcgcatatcaggcgaaagatgtgcttgatgccatggaggctgattcaggcatctctttaaaaacattgcgtgtagacggcggagcggtaaaaaataacttcctcatgcagttccagagcgacttgcttgatgtgccggtcgaacgtccggaaattaatgaaacgactgcgctcggtgccgcgtatttagccggaatcgctgtcggctactggaaggacagcactgaaatcgccgatcagtggaaccttgataagcaattcaaaccggaaatggaagatgaaaaacgcgttgaattgtacggcggatggaaaaaagcagtaaatgcagctatggcttttaaataagataaaattatggtatactgaaaacaagttaataggaacggtcctgagatgaggagagaccacagcaccaaagtgatgacatgcgctttggctgttgtggtctctttttctataccgtgacaacaaggaggaagcgtaatgatgaatcaccaattttcaagtttggaacgggatcatatgctggaagacatgactaaaaaacatacgatctgtttattataggcggaggtattacgggtgccggtacggcgcttgacgctgcttcaaggggaatgaaagtcgctttgagcgaaatgcaggatttcgcggccggcacatcaagccgatccacaaagcttgtccacggcggtttgcgttatctgaagcaatttgaagtcaaaatggtggctgaagtcggtaaggaacgcgccatcgtgtacgaaaacggcccgcacgtcacgacgccggaatggatgctgctgccgtttcataaaggcggcacgttcggttcattctctacttcaatcggcctgcgtgtgtatgactatttagcgggagtaaaaaaatcagagcgcagaagcatgctgtctgctaaagaaacgctgcaaaaagagccgctcgtcaaaaaagacggcttaaaaggcggaggctattatgtagagtaccggacggacgatgcgagactgacgattgaagtcatgaaagaagccgttaaattcggtgctgagcctgtcaactattctaaagtgaaagaactgctttatgaaaaaggaaaagttgtcggcgttttaattgaagatctgctgtcaggcaaggaatacaaagtgtacgccaaaaaaatcgtcaatgcgacaggtccgtgggtcgacgaactgagagaaaaagaccacagcaaaagcggaaaacatctccagcacacaaaaggggtccatctcgtattcgaccaatccgtattcccgcttaaacaggcggtgtactttgatacgccggacggccggatggtgttcgccattccgcgtgaaggaaaaacatacgtgggtacgaccgatacggtttacaaacaaaaacttgagcacccgcgcatgacggtgcaggatcgcgattatgtcgtcagctccatcaattatatgttcccggaactgaacattacggcggacgatattgaatcaagctgggccggcctcagaccgcttattcacgaagaagggaaagacccgtctgagatctcccgtaaagatgaaatctggacatctcaatcaggcctgattacgatcgccggaggaaaactgacgggctaccgtaaaatggctgagcacattgtcgatcttgtccgcgaccgcttgaaagaagagggcggccaggacttcggcggctgcaagacgaagacgatgccgatttccggcggacatgtcggcggctctaaaaacttcgagtcatttgtggaagcaaagacaaaagacggcttgaaaatcggtttatcacaggaaaccgctaagcagttagccatcagatacggctctaacgttgaaaatgtattcagccggattgaaggcctgaaagatgaagcggaaaaacgcgagattccggttcacattctggcggaagcggcttacagcatcgaagaagaaatggctgcgacacctgccgatttcttcgtccgcagaacgggaagactgttcttcgacatcaaatgggtgcaaacgtataaaacggccgtgattgattacatgagcgaccgattccaatggaatgacgaaacgaaagaaaaacacactgagtggttaaatacgctgctgcacgacgcggttgttccgctcgaacaataataaccggagggctgtgccgaaaaggcatgagcccttcttttatctttttacataaagcatttggttaagttatcaagtgacacgggcagccgcttcatattaaaatatggtcataagctgaaattataggaggacgaacatgagttggagtaagagttacgaacgctggaatcaggccgaacaattagattcagaattgaaaaaattattggcggacgcagaaggaaacgagcagctgctggaagattttttctacaaaaatcttgagttcggaacaggaggcatgagaggagaaatcgggccgggtacgaacagaatgaacatttacacggtccgcaaagcatccgccggacttgcggcgtatatcgcgaaacagggggaagacgcgaaaaaaagaggggttgcgatcgcatacgactcccgtcataaatctcctgagtttgcgatggaagctgcaaaaacccttgcttcccaaggcattcaaacatacgtctttgatgagctccgcccgacgcctgagctgtcttttgcggtgagaaagctgaacgcttatgccggcatcgtcgtgacggccagccataacccgcctgaatataacggatataaagtgtatggcgatgacggcgcacagctgccgccgaaagaagcggacatcgtcattgcggaagtgaatgccatagaaaatgaattaacgattcaagttgaagatgaacagtcgctgaaagaaaaaggtttgattaaaataatcggtgaagaaattgataaaccgtatactgaaaaactgacttccatctccgtacatcccgagctttcggatgaagtggatgtcagcgtcgtgttcactccgctgcacggcacggcaaataaaccggtgcgccgcggtcttgaagcactcggttacaaaaacgtcaccgtcgtaaaggagcaagagctgccggacccggatttttcaaccgtcaaatcgccgaatccggaagagcacgcggcattcgaatatgccattaagctcggagaagaacaaaatgccgatattctcgtcgctacggacccggatgccgaccgtctcggcattgccgtaaaaaacagcgaaggcaagtacacagtgctgacgggaaaccagacaggcgcgcttttattgcattacctgctttccgagaagaaaaaacagggcacccttcctgaaaacggtgtcgtcatgaaaacgattgtcacgagcgaattgggccgcgctgtcgcttcatcgttcggattagatacggttgacacgctgacaggcttcaaatttatcggtgaaaagatcaaagaatatgaaaaatcaggccaatacacgttccagttcgggtatgaagaaagctacggctacttaatcggcgatttcgcgcgtgacaaagacgcgatccaggctgcgctgttagccgtcgaggtatgcgccttttataaaaagcagggcatgtcgctttatgacgcgctgctgtccatttttaaagaatacggatattaccgtgaaggcttgaagtcattgacgttaaaagggaaacagggagcagagcagatttccgctatcctgacttcattccgaaacgatccgccgaagcagatggccggaaaacaaatcacgcaggctgaagactattcaacgggaaaacggactgtatttgccgatcatcttgaagaagatattgatctgccgaagtcaaatgtcctgaaatatttccttgaagacggctcttggttctgccttcgcccatcaggaacggagccgaaagtgaagttctatttcgccgtgaaggggacttctttacaagacagcgaacagcgtcttgccgcattatctgaagccgtcatgaaaacggtggatggcatagtggaaaaaacgaaataaacaacaaaccgccggaagcgacatccggcggtttttttatacgcctcatccgaaagtatgaggaaaattcatgctgaaaacaaaggaatatacagaaaagaattgatataatatggataattctgattggccggagtgagggaaattgacgaaaacgacggtagaaacgttaaaaacgttaaaagcgattgcggaaaccttaaaccaaaaccacgatttaaaggaagcgcttgataaagtgctccgcgaactgctcagcctgaccggactgcagacagggtggatttttctgattgagccggacgggtcttatacgctcgccgcatccgcttatttaccgcctgctctcggtcagcgggaaaatgcactcatgtgcagcggggaatgctattgtctgaccaaattcagcaatggcggattgacaaaggccgtaaacataatgaattgcaaacggattgaatttgcggaacagacgacgaactgccgcgatacggagggcattacccatcatgcgaccgtaccgcttgaggacggcggccggaagttcggatattgtgcctcacgtgctgacccatatggttcaggatgatcaggataaggaaaaatattatcagctgatcccccgtgaaaaagatgttcttcaagaaatagccaaaggaaaaagcaataaggaaattgcggcggccctgtttatttcagaaaaaacagtgaagacccacgtgtccaacctgctgtcaaagctgaatctttccgatcggacgcaggcggcattgtatgcggtaaaatataatgttttgggaaaggcggtaaaatcatgagcatattagtgatcagcggcacaccgagaaaaaacgggcggacgagaattgccgcttcttatatcagagatcggtttcataccgattttattgatttgagcgaaagtgaactgccgctttataacggtgaagaagaacagaacgagctgccttcagtgcaaaagttaaggcggcaggtgaaaaagtcagcggccgtcgtcttattatctcccgagtatcacagcggcatgagcggcgctttaaaaaacgccatcgattttttaagcagcgatcactgggcatacaaaccggtggccgtcattgccgcggcgggcggaggaaaaggaggcatgaatgcgctggcgaatatgcggacggtcatgcggggcgtctatgcaaatgtcatcccgaaacagctggtcttagacccgattcacatcgacatggagcgccggaccgtatctgaggatatggcggtcagcctgaaagacatgatcgaagagctgaatatgttcacaaacacaagaaatcccggcgtctgacgccgggattgttttatgtcagcatggctaattgatcttcataagcgagctctgtcgcatgatcaatatacccgagaagggaatacagctctttttcaagcacggcatgatcatattcgaaatgatacgcgtgtagaaagtgctcaatacgctttgataataaatcatcttttgtacgaaccatcaaaattaataaattgtcccattgagaccggtgtgtgtaatacaaggctttatcataatcggcatgatccatcttacgcttctcctttcaatgagaagttctccgttagtttatgccgccgaagcccggatgcaacgggggaaaacttggtgtccttatcactgcggcatagcaatatgagggagacataaaataaaaccgcatatccgtctcttctttggacacgctaagattgacaaaaaacgactcaggagaacataaagatgaaatcccttccatttgcgcttgccctcttgttttgcggcattctcattgcctctatcgctgaaaaagggcatacagaacacctcgatccgtcagttgaaaaatgggaacagctcgcatggaaccagcttgaacgtgaatacaagggggccgagcttaccgattattcgtacatgggccgtacaaaagtgaaccgggaacagacgaaagacgtgtttcgcgtaacggtgcaaaccgcaaaagaaacgttttcatcccgtgctgaagtgtatttccatcccgtaacaaaacacgtgatcagcatcaatattttcagactgtaaaaaagctgcacagccttatgcggccgtacagcttatcaggtatcagaagaaacgttttgcgccgaggtagcgctgtttccaataggaattgttcatgctggaaataacgactcccgaatcgttggcattaataaactggccgttcccgagataaataccgacgtgggaaggtccggctttataagttgagaaaaagacaaagtcaccgaccgccggctggctgactgatgtcattgtattccagtagcctgcggctgaaagtctggatacagaagtgaccttattgagaacgtaataaatgaaaccgctgcagtcaaagcctctcggcgtcgttccgccccatacatacggtacgcccagctgagcttttgcggcatcgatcattacattaatcttcgcgcttgttgaacctgtgccgcctgtgctgccggactgattcggtgtcgtgtttgtctgctgcccggtaatcgtcagtttctgtccgatttgaagaacatctgttttcagattgtttttctcgcggatctgctgggctgtcacattgaacttttgggcgatcacccataaagaatccccgcttttcacggtatatgtagtggttttccctgtatttccggactggttcggagctgacggtgaagacgaagagccggaagaagacgttttggtcagcttcagcacttgtccgacccgcagcatgtctgacgtcagtttgttgatgcttctgatttgctgaaccgtcatattgtatgcgtttgcgattttccagagtgagtctccgctttttactgtataggaggacgtttgcgtctggttttgattttggtttgaattgtcttttgacggcgtgtttcccgaagaagacgttccttttgttttcaggacttggtttacgtagatcgtatccgtttttaagttgtttaatactttgagttccgcaatggtcatattgacgctgtttgcgattttccatagtgaatcgccgagttttactttataggtcccggaagatgatgactgctttttgctgctgtttgagctgctgccaggagcggtttttttctgatcggtgcttgaggaaactttccccgtcacttgcagcttctgtccggcgcggattaagtcgcttgtcagaccgttcaattttttcagttcctgtacggacattttaaaatcagatgcgatcagccacagcgagtctccgcttttcactgtatagacgcttttagtcgtgccgctgttctttgaagatggctttttgctgccggaatctgatttgccgttaggaatgttgagcgtctgcccgatagaaagaacggtggattttagatgattcgctgatgtaatggcatccacgcttgtattgtagttttgggcaagcttccataatgaatctccgcttttgaccttaatcgtttgtgcttctgccggtgttacagctaacgcagacccgacgatcgcagatgcagtcaaaccgaccgctaccttttttttcatagtgaatctcccttttcctgcgataatttttctatccccattcgttgcagccgcaaggtgaggatatcagtaatgataatctttatatcggcacttgtctgcaatcgtttatcatattaatagaaatagtccttttttcttatgccggcataaaaaaagaaggaatgcggacattccttcagcttctgagcagtctcataatctcctctttgtttttgaccagatcccttaacgtatatttgtctaaaacggccaggtaagcttgcagggcttcattcagaaggttctttaagttgcaggcgggagatatgatacagagattttttttggagtcaaagcattctacgatgttaaagtcgtcttctgtatgtcgaacgacttctccaatgtttatgtcttccggtgtcattcctaatcgaattccgcctccccggccccggatcgtttcgacatatccgagctggccgagacggtaaatgactttcatgaggtggtttttagagatggaataagtatctgcgatttcttttatgttggaaagttcgtcggaatgtctggaagccaaaaaaatcaaaacgcgtaaagagtaatcggtatagttcgttaatttcatagaatgacctcgaaaaaagagattttgcttctgttacagtctatcatatatgaatctaaaatgaaaaaaaaggaatttgcccccttaactcaaaaaaaacgtgcgctccttctgagcacacgtttttttcgttaagacatcggcggcttacgatcgtcagccgattgatgtttttcaattttgcgatccaattttgcgagataacgggaggcaaattcttttccgccaagaccgaatgaaagtccgaaggcaagcgcgaaaccgcccagaatcagaataaacgcggcatttacgatcgtgtcggcgacaccgagctgatccagcgccataaagattgagagagtgataatggtatatttcgcaagcggcgccaggaatctgaattcctttccgctcagcatgccggcaagcagcctgctgacaagctgtccggccaaaagtccgattccgagaataaatacagcggccagaacattaggcaggtaagcgataataccggttgcgataacgacgagaaattcgagatgaacaagctgcagcgcctctgccgtaaagagcaggacgatgatgatctgaacaatcatgccgaccgtctgagaaagcgtcagcttcggggtgcccgcctgttcaaagcccattttaccgagaagagagtcgaaaccggcccggtgcaggagcccggatacaatgctgctgacccattttccgacccagatgccggcgatgatcagcacaataccgatgatgatattagggagcattgtgaagaccgtgtgcagcatggctgacgccggttcagaaatacccgccacatcaagccggtcaagcgcagagatgatcaccggaatgaaaatcagcacgtagacaatcgttccgatgattgccgacaggctcgtatccttcagataaatagaaagccccatacgtgcggcgagcctttccgttccgatactcgccagaaagtttgtgacgatatcacggacgagacgggcaacaagccagccgattaaaacaatcagcgccgcggcgaataatttcggtataaaggacaaaacgctttgaatcatatttgtaaacggccctgacactccgctgatctggagagcggacaagacgccgggcaggaacaagagcaagacgaagtaaaaaacgattcgtgaagcggccgtaacggatctgctcatctccgcttcttcagacaccattgtccattttctgagccggccgttttcagcgagtttcatgcccgcttttttgacgagatagctgaaaagcgaagcggccgcccagcccacgagcagaatcaagccggcttttaaaacgctcggcacagccgccgttatcgccgacagcatgctgacaaaaggcgaagccacggttgtcagatgcagaatgttaaagaatagaataaaaacgatgattaatgcgataaaataaatgactttactgatgactttttctgaggaatagcgcgccggctttttttcggcgaacagcctgtcgtcgatttttgttttttgcaggcctttgtatacggctttttcaatgattttggcaatgccccagccgataagcaggacgagcagtgcaatgatcagattcgggagtttgctgagatacgtcgtaagcatgtctgctgtattcaagtagaatcgctccttttctttttggggtatggtgtgtgttttacccacttacatataaagcaaacagggcggatgtgccgaaagttttcagtcggaaaccggtctgttatttcatcttttgagaggaggggtcatacattataaataagtccaagtaggggggattcgcttgaacgcggaggagacaaaaggtttacagcgggcaattgaggaaataaccgacattgcaaagggtttcggccttgatttctacccgatgagatatgaaatttgcccggctgaaattatttatacattcggcgcgtacggcatgccgacgagattcagccactggagtttcggcaaacaatttcataagatgaaactccattatgatctcggtttgagcaaaatttatgaacttgtcattaattccaacccttgctacgcttttttgctggacagcaattcgctgatccaaaataaattaattgtagcccatgttcttgcccattgtgattttttcaaaaataactgccgctttcaaaatacgaaccgggacatggttgagagtatggcggctgcggcggagcggattaagcattatgaaagaattcacgggataaaagaggtggagtcctttttagatgccattctggcgattcaggagcatatcgatccgtcgctcgtcaggccgaagctgctgtggagcgtcgatgacgaagaggaggacgaagaagaaaccgcgccatcgccttacgatgatttatggggaatggataagccgaaacaggtgaaaaagaaaagagggaaaaaaccgtttccgccccgtccggaaaaagatattctgctgtttatcgaggaacattcgcgggagcttgaaccgtggcagcgtgacattttaaccatgatgagagaagaaatgctgtatttctggcctcagctggaaacgaaaatcatgaacgaaggctgggcatcctattggcatcagcggattatccgcgagcttgacctgacttcagatgaagccatcgaatttgcgaagctgaacgcaggcgtcgttcagccgtcaaaaacgggaatcaacccgtattatttagggctgaaaatttttgaagacatcgaagagcgttatgacaacccgacagatgaaatgaaaaaaacaggggtaaagcccggttccggccgcgagaaaatgtttgaggtcagggaaattgaatcggacatatcatttatccgcaattatttgacgaaagatctcgttatgcgtgaggatttgtatttattccaaaagcagggcagggactataaagtgatcgacaaagaatggaaggccgtgcgcgaccagctcgtgaacatgcgggtcaacgggggatttccttatctgaccgtcaatgacggggattacctgaagaataatgagctttatattaaacattggtatgagggaattgagcttgatctgaaatatttggagaaagtgctgccgtatctgtaccagctgtggggcaggagcgtgcacatcgaatctgttcttgaagacagagaagtgatgttttcgtatgacggcaaaggagtgcaccggagatatttgtaaaagaagaaaggatgcggggaaatccccgcatccttttttattttccgtgtttcaggatgtgaaagatctttttggcctggtccgtgttgtttaaaagccccgtaaatgactctcttcccggaccgtatgcgtaaacgggaacttcttcgcccgtatgatcgccggttgtccagccgctgtttgttttcgcattaaaaagcttaatgatcgctttgtagacgctcttgtcagcatcctgttttgcggccgtttcgatctgtttaatttccgcttttgaccatttcaggtctgtataacgcgcaagcacggaagatacggatttgcccgctttgatttggtcagccataaatgccggggtttttttggcggcaagaatcggttcaacatgccagtttttatcgtcattcgcgccgatcgtcaatccgccggtggtatgatcagccgtggcaacgacaagcgtatgtttgtcctttttggcaaatgcgatcgctgctttatacgctttttcaaaatccttcatttcactcattgcgccgactatatcattgtcatgtcccgcccagtctatttggcttccttcgaccattaagaagaacccttttttatttttgttcagcctgtcgatcgccgccgttgtcatgtcttctaatgaagggacagcgtttgaccggtcgattgctttgtcgagtccgccatcggcaaacaggccgagaatcttcttgttacggtcctttttcagctcctgttttgatgtcacgtagctgtatcccgcttttttgaaatcctttgttacattgcggtctttacggataaagtttgatttgccgcctccgaggagcacatcgactttttgttttccgttgatgcggtcatcaaagtagctgcttgcgatctcatccatgttctttcgggatttgttatgggctccgaatgccgcaggggtggcgtgggcaatctccgaagttgcgacaagtccggtggatttccctctttgtttcgcttcttcgaggacggatttgacccgctttccttttttatcgactccgatcgccgcgttatacgttttcacgcccgtggccattgccgtgccagccgccgcggaatcggtaatattggaatcaggatcgtcaggataagtcatcatcataccggcgagattggggtcgaatgccgtcagtttcataccatccgaaggctttcctttgttaatgaccgaacggtaggcgttcatatagggtgcgcccattccgtcgccgaccatgaagatgacgtttctgatctcgtttttgtcaggctgtttttttgccgcagcctgttcagagtgctgaaaccccgcgcccgcaatcagaccggctgtcagcacggatacggctgccgccggcagaagttttgatcgaacctgtttaaatagactcattctcactcgtcctcctttaatcgtgtctgcatgtctaatggtagggggtgtttgtaaagagcgcctgttcctcctgtaaatttcaggtgaaacattgttagaaatgtaaattccggtgtaacttatgttttcaagaaagagtgaaaaccattcacttttttgaaaaagacgaggatttttttaacaaggagttatttggaaagtaaactgctttgtttttccaaaatacgaggatcacaggaaaaaaacatgacaaattgactcgtttttcgtcacgtttgaaatcaaattgaaatatttaatacccttaaaaacttttttcaaaaacgaattagtaagaaatttgtcacgggaagtcaagtctatttctagtggaaattgaaccttataataggaaacagataaaaactttaaaaaagagacacataaaatagatagaatcattcagggaggaaaatatgaaaaagcaacttgttacagcaacaacggcagtggttttggggacgactttgtttgcgggcgcggcgtctgcgcaaacgattaaggtaaaaaaaggcgatacattatggggactttcaaatcggtatggaacgtcaattaattccattaaatctgagaacaaattaaaatcggatatcatttacatcggtcagacgctttcgatcaacggtaaatcatcttcaggttcaaattcgggcagcaagtcatcatcgtctacatataaagtcgtaaaaggcgacagcctttggaaaattgcgaataaatataaaatgacggtaaaccaattaaaaagtttaaacggtttaaaaacggacctgatccgcatcggacaagtgcttaaagtaaaaggatcaacttccggttcagcgtcttcaggatcttcgtcatcaaagaagccttcatccagccataatattgcacagacgagcctgaatgtaaacaagctggtttctgatgcgcaatctttaatcggcacgccgtatgtatggggcggaacaacgacttccggctttgactgcagcggatttatctggtacctgttaaacaaacagacgagtgtcggcagaacaagcactgcgggatactggagctcaatgaagagcgtatccagcccgtcaagaggagacttcgtcttctttacaacatatcaagccggtccttcacacatgggtgtatacatcggaaacaacaagttcatccatgccggttctgacggcgtcacaacaagtgatctgaataacagctactggaaaccgcgctacctgggcgcgaaaagattctagcagtgagagaaacccgttcatccgaacgggttttttatttagacggggcagagctccatttgtttcacctaaaaatgaaaatgtgataaaaaatctaaaaaggttttctttttttcattttcatagagggcgatggcgtacgcgcccgcgctcggcatctgggcgaattcgcacggaatttcaatcatgctgcctgcggcgagttcggaccgtaccgctgacagcggcagaaatgagacgcccagcccctctttaataaatcgtttcgtaatatgcgtctgtgtcaccttcattgtcctgacgaaagggaactgtattctgacctggcggagcaaatcatcccaatagtcaggatggttatgggtcaaaagcagatattgtccgaacaggtctttcacttcatccgccttccctgtcccgggttttcggccgggtggcgcgacgaggacaacggggtcattgtacagggggaggcaagtgagggaagatgattgcacctttaagcagctcagtccgatatcggctgagccgtttctgatttgagaggcgatttcttccgattcgaaaatggtgaccgtcatttcggtttctttattgtcctctgtataacgcttcatgacagacgggagaacggtgtcggcgataagcggcgaaacagcgagtgtcagcgtgtgcgagtagccctggcgcaccctgtgcagctccgccatgctgttttcatagtcttccaaaagtctcatggcaaacggcacgtatgcttttccttcttccgtcaattgtattttccggccgctccgctgaaacagcttgcagctgatttctttctctaataattttatatgaacggtgacggtcggctgagataaaaaaagcgtttccgccgtttttctgaaattctcgtattttgccgcggtgacgaaggtgtgaagccatttaaaatccatagatgcactcctctgattaaaagttttaattaattcccttaaaaatattcattattttttaaatattatatttactataataacagaaagaggataagggggaatgaaattgatttatcgtggattgaaagggattacttgtgcagaaacggcgatcagccacattgacggagaaaaggggcatttaatatatcgcggctatgacgcgaaggatatcgcattgcaattcagttttgaagaagcggcgtatctcattttgaacggggcgcttcctgatgagcggcaattgcttgcgtttcaggaagaacttgcagccgagcgcgggcttccgaaacatttgatcggcttactggaaacgcttccggatgaaatggacgacatggcggtgctgagaacggctgtttcaggtttgggcacagattcatttacatatccgcccaagccggaagaagcgattaaactgattgccgtcacaccgacgattattgcgtacagataccgccgtaaacaagggcaggaagcgctgtcacccgaggcgcgatacggacacgttgaaaactatttgtatatgctgacaggcaggcagccgtccgcagcccaaaagaaagcgcttgagacgtatatgattctggcgatggaacacgggatgaatgcatcgactttttcagcgagagtcacggtttcgactgaatcggacttagtgtctgccgtcactgccgcactgggtacgatgaaagggccgctgcacggaggcgcgccttcaggcgtcacgaaaatgcttgaagacatcggggaaaaagaaaatgcagaagcgtatttgacagcgaagcttatgaggggagaacgcctgatgggcttcgggcacagggtgtacaaaacgaaagacccgcgggcggaagcgctgcgcataaaggctgaagaagtggcgggaaatgatccgtcgcttgacttggcgctttatgtggagaaggaagccatccgcttgttagagcaatataagcccggacggaagctgtatacgaatgtggagttttacgcagcggctgtgatgcaggccattgatgtcgacaatgatttatttacgccgaccttttcagcaagcagaatggcaggctggtgcgcacatgtgcttgaacagtccgctgacaacatgatttacagaccgtctgcgaaatacaccggcgcttttcccgaaacggctcagcagctttaattaccggcatatttgtccgtttaactccccgcactgcgtggtatcgtctcagtaataccaattgcaggagtgtgagaatatgaatccgatggacagacagacggaaggacaaaagccgcaggtgcaaaaccgccagcccggcattgagtcagacatggagccaaaaccgctcttggaggatccggatgtaaaagggtcgggcagattaaaaggaaaagtcgccgttattacgggcggagacagcggcatcggcgcagcggctgcgatcgcttacgcgaaggaaggggcggatcttgccatcctgtacctagacgaacatgccgatgccgagagaacgaaaaagcgtgcgagagaataccaggccgattgcctgttaattccgggagacgtcggtgatgaggcgcattgtcagaaggcggtccagcaagtcttagatcactacggaaaaatagatattctcgttaataatgcggctgagcagcatccgcaaaacgggattcttgatattacggctgaacagctggagaagacattccgtacaaacatgttttccatgtttcatatgacaaaagccgtgctgcctcatctcaaaagagggagcgccatcattaatacaacgtcgattaccgcttatcagggagacacatcattgatcgactattcgtgcacgaaaggcggcatcgtttcctttacgcgttcaatggcgatgtcattggccgatcaggggatcagagtaaatgcggtggcacccgggccgatctggaccgccctgattccggcaacgtttactgaagaaaaggtggaaaagcacggtctggacactccgatgggaagaccaggacagcctgcggaacacgcaggagcttatgtgcttctggcttcagacgaatcttcctatatgactgggcagaccattcacgtaaatggaggcaggtttatttcaacataataagcaagtcttatcccgcgcttttaaaaagggcgggatttttatttgattacatatgaatacgatttttaaaaaatagaagccgccagctgaattactaatgttaatatttaacagcggagaatccgctgagttctgttttatgaaaactgaaataatatatagaattttcaaaaaagttattttcatttttatatttttcgctataatatggtgtaggagaaaggaatgatgtgctgaaacatttcatgcgaaaaataagaatttagtcattattgctattgttgtctgaatattctaacatatattgatttacaaggagtgaagcagatgaaggggagcatattcagaaagaaaagcattcaggacctgcttgccgcaacgggcggggaaaagtcgctgaaaagagagttaggggcctttgatttgacacttctggggataggggccatcatcggaacgggaatttttgtattaaccggaacaggcgctgtcacggcggggccggggctgaccgtttcatttgtcatcgccgctcttgcgtgtttatttgcggctttgtcatatgccgaatttgcttcaagcgtcccggtttccggttccgtctacacgtttacttatgcgacactgggtgaacttctcgcatttatcatcggatgggatttaatcttggaatatatgctcgccgtcagcgcggtttcggtcggctggtccggctattttcaatcattcttggcgggcttcggcattcatcttccgaccgcattaacggccgcgccgggatccattaaaggcacggtcacattctttaatctccccgcatttgttatcgtgcttgcgattacattcctcctctacttaggcattaaggaatcgaagcgggtcaataatattatggtcattttgaaggttctggttgttctattgtttatcgccgttgcggccgtatatgtcaaacctcacaactggcagccgtttataccgatggggttcggcggtgttttcagtgccgcggcgctcgttttcttctcttttatcggttttgacgccgtctcttccgccgctgaagaaacgaaaaatccggcgaaggatctgccgaaaggaattatcttttcattaatcgtctgcaccgtgctgtatgtgaccgtatcggcgattatgacgggcgtcgttccgtttgcccgctttgaaggcgttgaccatcccgtgtctctcgtcctgcagatggccggacagaattgggtggccgggattattgatatcggtgcagtgttgggaatgacaacggtgatgctcgtcatgctgtacggccagacgagggtgatgtttgccatgtcccgtgacggtttggtgccgggggcgctttcaaaagtccatccgaagcataaaacgccgcacgtggtgacatgggtgttcggcatcctgtcggcattactcggctcgctcgtcccgcttgatgagctggcgaagctggtgaacatcggcacgcttgccgcgtttgtcctgatttcagtggcggttatcgtattgagaaagaaacagcctgatctgccgagagcttttaaatgtccgggggttccctttattccgatattgtccattctgttctgcgtatttttgattattaaccttggcgccaccaccatattccgtttctttatctggctgatcatcggtctggtgatttatttcttatattcgagaaagcattcgaaattaaacggggatttgtaaggagcggcacccgccgctcctttttatttttcggaataatgaaacatattgaaatgggcttaagttatcgcagtgaataagggataatatagggcggaagggaagtggaaagtcgtgtctgaccaaaaaagggttcaatgggcctcaaaaataggatttattatggccgctgccggttcggcgatcggcctgggagccatttggaagttcccttacgtagcgggtacgaacggaggaggcgctttttttcttgtattcgtcctctttaccgtgcttttaggctatccgcttttgctcggtgaatttattttcggaagacggagccagacaaatgcgattgatgcctacaaacaagccgcgccgaagtcggtatggcacctcacgggttatgtgggtgtggcggcctgttttttagttttgtctttttacagtgttgtcggcgggtggattttgctttatgtgttaaaagctgttacgggttctttatccgggctcactcaggagcagtacggaacggtgttcgggacggtcattgaaaatccgatccagactctcgccgcgcagcttgtatttatgatcttgacagtggcggtcgtcgcaaaaggcgtgcagaaagggattgaacgtgtcagtgcggtgctgatgccggttttattcgtgctgtttctattgctggtgctgcgatcagtcacgctcgatcatgccgttgaggggattagatttttattggttccgcactttgaagatttgacgccggaatccatcctatatgctttaggacaggcgttctttacattaacgctcggcgtttcggtcatggtgacatacagttcgtatctgccgaaaacccaaaaccttccgggatcggcgggttccattgttgtgatgaatgtgctcgtcacgctgtttgcgggactggccatttttccggcggttttttcgttcggatttaaaccggatgaagggcctacactgctgtttaccgtactgccggctgtgtttgaccggctgccgttcggctcgctgttttttatcagctttctggcggtctttttctttgccgcgctgacttcggccttttcgatggtggaaattatcgtagcgactgtcgggaaaggtgatgaaacgaaaaggaagaagctgtcgtggacaagcggtctgctcattttcttagtcggaattccgtcgtgtttatcatacggtgtgctcggtgatgttcatttgttcggaaaaacgttttttgatctagcggatttcacagtgagcaatgtgctgattccgctcggcgctttattaatatcaatcttcatcccgctgaaaataccgaagcgggagctgttcgccgagatgaaaagcggttccgccatcggctatcgtttctttcaggtgtggtatttccttctgaaatacctcgtgccgctggctatcatcgtcgtattgctgcatttaatcggcgttctttcattttaaaaaaacaggcccctgtaaaagggcctgtttttatgtttaaaaaccgaattgcagattcgtatcaacggcaacgatcgtatatacacaaacaatgacgaaaaggttgaggatgacaccgagcagtcccgggcccgtccgtccttttttaataaacagctcaatgatgccgaacggcacggcggccatcgcaaacggcagcatctgataagaatagaaagtcacattgctgatgattgccacgttcaaaagcagcagcgacaaaatcgcggtaccgactgatatccagccgaaaacattatgctctttaaaaattcttaccaattccataattccacctcaccgatgtttgctgcttttactgttttatttttcagcagacgttcgatttcttttgtcggccccgtcacgacagagccgtatacgttcattccgtgatgttcaacatagtcgattcggctgccaagattcatgtctttgcgtttcgatattgcatgcgcccattttttatggcgggacataaattcaagggcattgataaattgttcacggtctgtctgtccttgcgtttcgaaagaggacaccatcttggaatctttcccgggaaatcctaacggctcggcataaggactgtctttcagatttttctccgtttcgaccgcgttccataaaaacttcacatcgtattttttaaaagtagaatatacttgagaagaaggataggcccggtcataagaaagatagacctccgccacgcttccttcaggcaatttttttaatgtctgtccggctttgtcaatcgtgcgttcctttaagccggaaggatgggcaaaataatgctttgcctgtgccgcgtctagatcatagtagttaacggcaggcgatttgaccgtatctaaaaacatttcaatccgttctccgccgacggatttcgtttttgtgccgatctgcttttgcagcggaaactctgtattcatcccaaacagcttcacctggcttttcagtccggaggtatcgacgagtacgttcggcatggtggtcgccaccgtcacggctgcggtttccattaattgattgccggtgctttcttttcctcccaaaccgtaatagaggtagcttcccaaagtgcaaagcggcaaaatcatcaaggtggagatgacggcgagaactgaaatccgcaaatacgatttgcgttttccgtatgacaaaatggccttctgtttttccgggctgatgccgacgtcccattcccggtcgtcctgcatttcgctttcaatcaactcctgatagacttcaagcttttccagctcttcttcaaaggcggccatttcccggtcgctcatttctccatttttgtattggtaaaaacgctttttaaattcttcattcatcattaacacctctattataaagtgctttcagccgctgtctggcacgaaataaaacacttttaaaattagcctctgaaatattcataatatgggatgcttctttgtaattcagttcttttaaataatacagtgttaaggcctcccgataattgtcgggaagttcggacatataccctgtcagcacttccttgatttcaatctgatgagccgggctttgaacagccgtctgaaaaaggctcccaattaagtcatcggaaatggtcacttcctttttatgttttctgacataatctataaacgcatttctcgccacttgaaaaagccatggctttactttgctgtggtcgtaggagtgaatgtgtatgtatgccctcataaaggtttcctgcagcaaatcttcagcgagatgcttgtcttttgtcatggagagcaggaaccggtaaacatcattcatatacatttggtaaatttcatcgatcgtcactgccttttctcccctctatgttatacacgcataagaaaggtttaaagttgcacgttccatgcaaacggcttaaattcattttcacctcatcaaacaccatttctctatagtacccaaaatccgtcataaaagatagagatcggcggaggaaaaatatatttattagtaccaggtaataaaaaatattgttataatagagagagaacacttttgatcattacaacaaaggaagtgcgttatgtataagttttgtgcaaatgccatcaaattcattctttctctgcgcggaggagtcaaagtatacaataaagagaatcttccgtctgataaaggattcgttatcgcgtgcacgcatgcgggctgggtggacgtcctcacgctcggtgtcgggatattgccccatcagattcattatatggcgaaaaaagagctgtttcagaaaaagtggatcggaagttttttaaagaagattcacgcgtttccggttgatcgtgaaaatccgggtccgagcagcattaaaacgccgattaagcttctgaaggaagggaagattgtagggatttttccgagcggcacgagaacttctgaagacgtcccgctgaaaagaggggccgtgaccatcgcccaaatggggaaagcgccgctcgttccggccgcatataaagggccgtctacgggaaaagcgctgtttaaaaagggaaaaatgcggcttatcatcggcgagccgatttttttggaggacttttccgatcttgcgccgaaggagaggcttgcggccatgacagaagagctgaatgccagaattaaagagcttgagaaaaaacttgaacaactgtaaatgaaaaaaagcttgccgtctgtatcagacgcgcaagcttttttgttatgcttctttttgttcggcagtttccagcagttcatcaaacgccagttttttcacttcgatatatgcgacgtggtggccgtcaatttcattaatgataaattcgcagccttcttcgataatcgagtcgtattgttcgacgtcgtatttctgggtaaggaaccagccgccgatggtgtcgacctcgtcattttccaaatggatgccgaggagttcgttcacttgatcaatcaggaccttgccgtcaagcatgtaatggccgtcgccgagtttgcggatttcattgatttcatcgatatcaaattcatcacggatttccccgacgatttcttcaataatgtcttcaacggtgacaagccccgcggttccgccgtattcatccgacagaatcgccatatgaacccgttccttctgcatttttacaagcagatcgtgaatcggtgccgactcaatcacatggatgatcggattgacaaaatccgtaatcggcgagtcgactgatacttcgccgctgatgcaggcggtcagcacttctttaatgttaataacgccgataatattatctttgtcaccctcttcgacagggtaccgggtatatttttcaatctgaatgatatccatcatttcagaaattttgatatcatgcggcagactgacgatttccgtacgcggaatcatgatttcttttgcaagtctgtcgtcaaattcaaagattttgttcacatatttaaattcagactggttgatttcaccgcttttatagctttccgataaaatgatgcgcagctcttcttcagagtgggcaagctcattttcagacaccgtctccagaccgaacgtcttcgttaaaagacgggcggagttgttcagaagccagataaacgggaacatgatgcggtaaaaccaaatgagcggtttcgaaaacagcattgaaacggcttccgctttctggatggcgactgttttcggcgccaattctcccacgaccacgtgtaagaatgtaatgatcgcgtaggcgagaataaatgaaataatatgcgataatgagcttggtacgtttatctttgtgaaaagcgggtgaagcaagcgttcaatcgttgattcgcctaagacaccaagaccgatggaagtcaatgttatgccgagctggcacgccgataaatactcatctaaatgcgtggtcacttttttgacaccgattgcggctttatttccttctgctataagctggtcaacccgtgagcctctgattctgattatcgcaaactcagatgctacgaaaaatgccgtcagcgcgattaaaaccgcgactaaaatcaaattcacaatgtccaattagaaccttcactccttttgggaagatgaaggtaacacctcctgttagtaagataatggtttaacttaacagcagcataaatgattgaagcactgcaagcttttcaggagccagcctttttttcagctgggcgcgctcctctggttcaagcttttcaaaccgattcaagatcccggagatgttttgattcatgtgatcaatttccgatgccagatttccaacatcgtcaggcagggctgaagagggaaactggttctccagtcgatcttttatatcagacagggccaatcgctgctttttacaagcgactataaactttaaccgattaagtgcaagtgtatcgtagtaacgatagttcgaacaagacctgtcaggctttaaaagcccgaggtttgtgtagtaatccaccgtgcgtttcgttacaccggcaagctctgctaattcactgatgcgataagtctcagccccatctaaatccctccccaaccatcacgttatagttatgagaatagtttaatatatgaaggggagtttgcacaagtttattgttttccgtctttctcctgaaacggggcggcaggctgtctgaaaaagcgttgactgcgccatgtaaatctttcataatcattgtaaatagaaacggcagaaaaagacagaagggacagatgacagtggccggtttatcaagggaagtgacacagaacctggagaaaggttcatggatacgcaaactatttgatgaaggcgctcggctgaaaaaagagttcggcgccgataaggtgtttgacttttcaataggaaatccggttgcggagccgcctgaaacgtttaaaaaggcgctttgcgaagcggctgaaacagggcggcacggatacatacaaaaccaagggcttccggaggcgagagaaaaggttgcccgctttttgtcagagcggtttcagaccgagatttccgccaggcatacagttatgacggtcggagccggcggggcgctgaatgtcgcgctgaagagcattttaaacccggaggaagaagtcatccttctttcgccttattttgcggaatataaagcgtatgttgaaaattaccgcggcagacccgtcatctgcccgctgactgactcatttgagattgatattgaagcggttaaaggtgcgatcacaccccgtacgaaaggactgatcgttaatacgccgcataatccgacggggactgtgctcagccagaaaaaccttaacgaattaggcgccttattaaaagaagccgaagagcggaacggccaaagcatatttattttatttgatgaaccgtacagccagctgatctacggagaagagcaggcgaatccgtttcaggcgtatcaccgcgtgattttagtcagttcgttcagtaaagatctcggcattgcgggggaaaggctcgggtatatcgcggcggacgcccaaatgcctgagggcgatcttctgacggatgcgttcgttttctgcaaccggacgctcggctttgtgaacgctccggtcatgatgcagcgcgccgtggcgaaaatggatgatctttcgattgacgctgaaccttacagaaagcggagagaccttatggtggacatcctcacagaagccggcttcgaatttgaaatgccgaaaggaggctttttcgtctttccgaaatcaccgattgaagacgaggtggcgttctgtatgcatgccgcacagaaatacagactattgatcgtacccggcagcggatttggaaaaagcggctatttccgattatctttcagcgtgccttcggaacagatcagacagtcgcgcgatattttcaaagcactgtatcaagatttttcttcatagcttccaacacataaagatgggagaacggacaaatgtcgaggagaaataatggcacatcagacatcagcattacaggaatcggagtcttaaccgcggtcggacaaggcaaggaggcgtttctcgatgcgctcatggaggggcggcacgcctttgatgtgatgaaacgtcccggccggcagaaaggcagttcgtttatcggcgcggagcttagcgaattaacgccgccggacgcgctgtcgaagcgcttgtaccgaagggccgcattatcaggaaagacggcgcttatcgctttatatgaagcgtggcatgacgctcaattagacggcgctgatcacagccgcaccggtctgatcatcggcgggtcgaatatgacgcagcgcgaattgctgcaggcctttgagaaaaacggtgaaacgccgcaatttgtaaatccgacatacgggctttcttttatggatagtgatttgtcggggctttgcacggagcaattcgggataaaagggccggcctttacggtcggcggcgcgtcggcaagcggccaggcggcggttatccaggctgctcaaggaattaaaggaggcctgtttgaccggtgcatcgtgatcggggcgctggccgatctgtcgtacatggagtgtcacgctctccgttctttgggagcgatgggcactgatacatacgctgaacggcctgaagccgcctgccgcccgtttgaccggcatacggacgggtttatattcggagaggcgtgcggggcgattgtgctggagcgcgctgaatctgccgaagagaggggcgcacgatcgtgggccggcttaaagggctgggggatggcttccgatgcgaaccgcaacccgaatccttcagcagagggcgaaatgacggtgatccgccaggcgctggagcgggccggtctttcagcgaaagagatcgattacatcaacccgcacggcaccggttcgccgatcggagataagactgaatgccgggcgctttctgaaagcggcctgtcgcacgcgcggattaatgcgacaaaatcgattaccggacacggtctgagtgcggccggaacggtggaaatcattgctgttctcttgcaaatgcgggaaaacaagcttcatccgatccgaaacttaacggagccgattgacgattcatttcagtgggtgaccgacgggccgagcgcccataccgtacaccatgcgttaagcttaagcatgggattcgggggattaatacggcgctttgtttagaaaatcatttccgaagcagataacggcagccttctttttgaaggctgtttttatatgatgaaaaatctgaaaatgatgaaagaatggagttgtgatacaataaactatacaaatgacaatcatgctttgacttaggaggtggcaggatggggccctctgtgtagtcaatcacccatttcgttcctctcgcttaagaaaaaacgatgaaatcaggaggtgacgtccttatccttcaattcgggataaggtgaaatggacgatattgacagtttgattttaatcggtgtgctcattgcgttaacggcatttttcgtggcgagtgaatttgcgatcgtcagagtgaggagatccagaatcgatcagctcatctcagaaggaaacagacgggcggtgctcgcaaagcgtatcattacggatcttgatgagtatttatccgcctcgcagcttggcattacactcacatccatcgggctcggcgtactgggagagcctgcatttgagcggatgcttcatcctgtgtttcagggtatggggctgccggattctgccgagcatgtgattgcttttgctgcggcgtacgggctgattacgtttttacatgtcgtcgtcggtgagcttgcgcctaaaacggttgcgattcaaaaagcggaaaagctgacgttatggattgccggaccgcttcggttattttacgtgttcatgttcccgtttatttgggtgctgaacggctccgcgagaattctgaccggtttggccggattaaagccggcatctgagcatgaaggctcccactctgaagaagagctgcggatcctgctgtcagaaagtttaaaaaacggagaaatcaatccgtctgaatatacatttgtgaataaaatttttgattttgataatcggatcgccaaggaaatcatgatcccgagaaaagaaatcgcggctgtttccactgatatggacgtgccggaaatgcttgatatgatgctgaaagacaaatatacgcgctggcccgtaacggacggggacaaagacagtgtcatcggcatgatcaatacgaagcatctcttttcagatctgctgtttatgacagaagatgaaaaagcggaagtatccatcatgtcttacgtccgcccggtgattgaagtcatcgagacgatcccgatacacgacctgctgataaaaatgcagagagaacggattcatttggcgatattgtctgatgaatacggcggaacgtccggtcttgtgacgaccgaagacatacttgaagaaatcgtcggcgatatcagagacgaatttgatgaggacgaacagccgcagattcaaaagctgtccgaacgccattatgtgctggacggaaaggttcggatcgatcaggtgaatcatcttctcggcgcagagattgaagaggaagtcgacacgatcggcggtcttgtgctgaaacggaatattgacatttgtgcgggtgagtcgatacaaatcgggggatacactgccctcatattagaaatggacggccggtttattaaacagcttgaactcaaagaagaacagggccgcccgggcggtcaggggacaataaaccgcccgctgcccgtgccggaaacggtcatgcttcataacgcaaccttgagcgaaaaataagctcaaggtttttttaaatggatatcataacaaagccgcaccagaacgccaaaaggcttccggctgctgaaacagcgatgtagagcaggctttcctttatgcggttgttcatcatcagctgcacggcttcaatactgaaggtggaaaaggtcgtaaacgcaccgaaaaagcccgtcgcgatgatgacgccggcagaaggattatccagacccaagccggtgaatatgccgaggctgaaggagccgagcaggttgaccgcagccattccaagcggaatcggaaaaccttttgttctttctgaaattgtcttacccagcagagaccgtaataccgctccgatacccgccgcgataagcatcaggacaatcgtcatggcgtatcatgcccccttccggctgcgtgaagggcaatccgccgtcccaaaaaaatgccggcgtatgcaagagcaagaccagcgaataaagtcgcggcagcataacaaaaagccgctgcgggagacgattgcagcagaaaaatggtttcttttgcgaaggttgacatcgtcgtgaaacctccgcaaaaaccggttcctaaaaaggcggtcaaaagagggcgtttagcccgaatgatgaaataacccgtaataagaccgagtaaaaggcttcccgccgcgttttcgaggaaagtggcacccgggaaagttccgctgtgaatgtgcgcgctcatttcaaagcggagcaatgcgccaagcgcgcctccgataaaaattgcgatgtattgtttcatatcagccatccttagaaataatatccggaaaatcagttacaatgccgtcaactgccatcatttgcagcttttcggccgtcttgtgatttctgaccgtccaggcaaatactttcaggccgtgtttgtgagcggtggaaatcaagaaccgattcaggcgggtatatttaatattgacataatttgcggctgatttgtaagcggccagctggcttttggaaaacatcccgaagctgggtcttgcgataattgcagtcggaacggacggatacatgtcgtgaaaggtctgaatcgacttgagactgaatgattgaacgatagggtgaatggaaaaggtaaacctgcttaacagctggccgactgctttttcaagaccgacttgagaaacgtgccctttcagttcaattaaaaatccgatttcagaatgataacgcttcagaacctcttcgagcaggggaatccgctcccctttaaactcagccccataccagctgccggcgtccagagactgcagcttcttcagcgtaaaatcttttacaaaaccggagccgtccgtcgtccggtcgactttgtcatcatggatgacgacaatctggccgtcttttgtgagctggacgtcaagctcaatgaaatcagcgttcatttcggcagcgatatcaaatgccgcaaatgtattttcgggcgcgtaaccggatgcgccgcgatgagcgatggtatacaagcttgtcagctcccctcatgggcatttctgttattatatcagattcgtatatgcacagcgattcaaactggtgaatgtgcaaaacagtatttttttggaataaagatagtgcttttttcggtttacaatccgcagtgatgatttataatggcaaaaaggaggcgagatcatgggaaaagggagattgaaagtggaagaaagaattaaggccgaaaccgatgctgaaatccaaaaagcgactctcctgaaacagacacaatcaaagaagaaatagtgcctgaccctgttgtatctggctgaaagatgaacgaatgtgtgaaaaaccccggctgtgctctgaggccggggtttttcaggctgcctaaagacattaaaacaagctgatgtccgaatgttttagtataatagattttcgacaagacaaaggagcatatgccatgatgacacaatttcagagcttttttactcttgaccatattttgcagatcagtatcagcatcggaattttagcggcttttctcgttttgagaaaactgtttgtcaaatacttttttcagctcatttacaaattggcgaacaagccgaaaaccgacatattcaaacagattgccgtagcgtttgacaagccggccagatggtttttcgtggcgctgggtctgtttttggcgattgagtattcgccgtttttagacgggcagatggacattgtcaaaaaaatgtaccgctctttgatcatagcgctgatcgcctgggggctttgcaatctgacatcggcgtcttcgtttttatttcataaagtcaatcagcgctttgagcttgatatggatgacattttggcgccgtttttatccaaggtgctgcgctttgtcattctcgcgctcagcgtcagtgtgatcgcgcaggaattcaattatgatgtaaacgggttcgtggccggactcggacttggcggcttggccttcgcgcttgcggctaaagatacgatcagcaattttttcggcggcattatcatcattacggaaaagccgtttacgatcggcgactgggtcgagacgtcatctgtgacggggggcgttgaagatatcacattccgaagcacaaggttccgcacggcgcagggggcgcttgttaccgtacccaattcaacgctgtccatggaagccatcacaaactggacgaggatgacgaagcgccaggtcacgttttccgttcgtgtttcttatgcgacgccgattgatcgtttagagcggtgcatcacaaggctcagggaaatgcttcgtgaacatgaaggcgtgcatgatgatacgattatggttaactttgacgtgtttgcggacagctattacaatctgtttttcaacttttacacaaagaccatcgtctgggcggaaagcctggacgtgcggcaggatatcaaccgccggattattgatatttttgctgaggaaggcgtggagttcgcctatccgggccagaatgtattcgtaaaacagaagagccacgatgatccggttcatgtgaaggatcattccggagaaaaagaacgggcataacaggcgccgttcttttttcatgatatgataaaaagaaaaggcggtggaagagtggaagcgtttataacattgatcaatcaggctgaacgtatcctggtgctgacgggagcgggaatgagcacggaatccggcattcccgattttcgttcggcgggcggtatatggaccgaagacacctccagaatggaagcgatgagcagggaatactttgaacgccgtccgcgtgaattctggcctaaattcaaacagctctttcagatgaaaatgagcggaagctatgagccgaatgccggccatacgtatttggcggatcttgaaaagcggggaaagcaggtagacattttcacgcagaacattgacggactgcataagaaagcgggaagcagcagtgtctatgagcttcacggttcaattcagaccgccgcatgcccccgctgcggagcgcgctacgggctttctcatctgctgaaggacgaagtgccggaatgtacggccgaagtcggtgatcatgcggtatgcggcaccgtattaaagacggatgtcgtgctgttcggcgatctcgttcagcattttgaaaccctttatgaaaagcttgataaagctgatcttcttcttgtgatcggcacttcgcttgaagtggcgccggcaaggtttgtccctgaggatgcgggccggattcccggtttgaagcaagtgatcattaaccttgagccgacatattgcgaccatttatttgatcttgtcatccatgagaagatcggtgaatttgcaaaacggatcagcgccgcgacataaaaaaagccggatcctatacagatccggcttttcttattcatggacgggaatcatttgatccgtcagaacatcaaaggagtagccctgggctttcagtttttggatcaggctcggtaaagcgtgcaccgtcgcaggcagatcgtgcattaaaatgacatgcggcctgctcgtatgaacgctttccaaatatgcgagctgattcaatacttccggcacgtaccgcgcgtttttgtacttccagtcttcactgtctatcgtccagtcccagtacacgaatccgtctttttcgagattcttaatctgggcatccgtcaatgagggtttactgccgtaaggcgtgcggacaagatccgtttttactccagtgattgtctcgagcgtatcgcgtccctgctgcatttcgttcagcggtgatgtcggtgtttgataaaacaggtgattatcgtgcgtcacgccgtgcaggcccagcgcgatcccttcctgcttcgctctttgcacggaatgcttataggctttcatccgcggttcaagcataaaaaaagtggcctttgcgccatttgccttcaatacattcaacagctgttcagtatatggagacggcccgtcgtcgaaggttaaatataccgtttttttccctgggtcacgctctttctgcaaatgtttcattaagacgtcgggagaatcatttttcagccgcaggctttctgcttcatcccgaagctgcccgtttgcggtcacggtgacctgtttgttttttgcggcggaagcggaatatcccattatgacgattaccagaagcagtccgcacaaaactgctaaactcgtaagtttaaaagccaatgaaaacagagaaggggaagcaccttcttttgtgttgcgcataacaatctctccagtagcataagtttctgcataatgccgataacagcggaggcttgcgaagtgccataagttaacagcatatgtatgtcgaatcaagtatacaggaacaaaactggaaaagacatagaaaagatgtcgaataataagattttaagaaaaaaataaactccgcagccggctcgttcagtatgatagaatagttgacaataacagctgagaatgcacatcacggcagataacgattaggagggtttacatgaagacattagtaaacggccagttgattgatcgtgaagaagcggcagttgatattgaggaccgcggatatcaattcggtgacggtgtgtatgaggtcatcagagtgtataacggcgccttattcggtctgcgtgagcatatcgcccgtcttttcagaagcgccgcagaaatcggcatcaccctgccgttctccgcagaggacatagaatgggatctgcaaaagctcgtacaggaaaacaaactcattgacggcggggtctatatacagacgacgagagggaaggcgccgcggaagcaccagtatgacgaaggattggagccgcagacgacggcatacaccttttcagtgaaaaaaccggaaaatgaacaaaaagccggagcgcaggccatcacggcggaagacaaacgctggctgaggtgtgacattaagagtctgaatttactgtataatgtgatgataaaacaaaaagcctatgaagcaggcgcttatgaagccgtgctgataagggacggggcggtcacggaaggaacctcatccaatgtatacgccgtcataaacggcaccgtccggacgcatcctgcaaatgagctgattttaaacggcattacgcggatgaaactgttagagctgatgaaagaaaacgggattgaggtgcgggagaaggctcttaccgaagaggaactcagagatgcggatgaaattttcatctcgtcaaccacgtctgaattaatcccgatcgtaacccttgacggaaaaccggtcggaagcggatcgccgggacctgtagccaaaacgattcaggaggcttttcagtcgcacattcagcaggagctcggcgttcagtcataagctgaaaaaaaggccggaacacatccggcctttttgctccagtcagataaaaagagattcgatatgctgaacgagtacacgggagatcttctcttttgaaagacgatcaggttcaagcatggcatgcagcgccaatccgtcggcgatagcgtacattttctccgcttcggtttctttatcaagattcggtttcagaagcttattttcatccagccagtcaatcaggccgcggatatatgccaagatcccgtcctgctggggttgaaactcttctcccttatgtctggcataagctgtgaaagcgaaccacacctccatttcagccatcgtttcttcatctgtcgggataatttcaagcatcagacgcaccgctttttctttcggcggcagatctttcatggcaacttcgttaattctggcggccgctttttcttttacgagtgtcatcgcataccctaaaagctcatcctgggtggtgaaatagtgcctcagcgcgcctaaagaaagacccgcttcttgggcgatgtttctcactgtcgctccttccattccccgctccaaaatcgtccgccaagtggcttcggctatttgttttcttcttttttcatgatcgattattttaggcatggttccagtgtaacaggaaatattttttcttgcaattttgtaatacagttgtattaaataaaaagcagtgatacaatgcattttagaaaacgataagggggaaccggattgaacgcgattgcttggttgattgtcatttgtgaggctgctttttgggcggctgtcatcttcggattggcggcgcgctatatattcaggcggcaaaagctcggaatgttttttttcgctctcattcctatattggatgccgtactgtttctggcggccgcagctgatttatacagaggggcggcggcgactatggcgcatgcagtggcggccgtttatatcggagtgtctgtcgccttcggaaaaagcatgattcagtgggcggatgagcggttccgctattatgtggtaaaggaaggggcaaaaccggtcaagcggtacggactggattatgccaaacattatgcaaaaggatggggaagacatgtattagcatttgtcatcggcggcgttcttttagccggaacggtatttctcattcaggacgcttcccgcaccgaagcgctcagcggactgttaaagggctggtctgtcgtattgtgcatcgattttttgatcatggcgagtttttttgtaatgccgaaaaaaagaaaaaacagccgggagctgtaaaaaaagcagcttttgattaagctgctttacagaaagaattattttacgatcagcacgggaatatcggatttcgatgacagtttttcactgacgcttccgaataaaagttttttcagcctgttctggtcccggctccccatgacgatcaaatccgccgatatacggtcggcatgctcgataatggcatcagcgggatcaccttctaaaatgtcgatatccccgtcaatctggctgtcgttcatcagcattctcgcttccgcaacgatttcttccgtacggtcttcataaatcatcggatcaggggagattctttccgcctgaagcgggtcaggaacgcttgcaatcccgccgccgatatacgttgccccggctcccggcctcgggggatcaacaatcgtctgggtatcttttgcactgtgggaatgtacgaccgttaaatccgcgtggaacgtttttgaaaggtctatggctttttgaagcgcttttttactatcatcacttccgtcaaaagctgctatcaaccggtctgcgtgaaacatcagcctcatcctttcagtaaaaaaggtttgttttacaatacccgtgcggcagaaatgtaaaacccgcattgacaaaaaaaggatttatttatatgatgaaggaacaatataggaaaaaggaggtatggatcatgtcaaaactaaagcttgtcaactcatcttcagctgaataccggcgtgacttccatacagcttccgttttctgaacatttgcttaaaaacggggcagtcgcgcataaacggcgggtctgtaccttatttataataataagaggcatggagctgaggcttcatgtctttttttatacaaaaaaatgaaagaaagacaggtgtgatgcatgtggcggcattagcgaaaacaatgaaaaacaatccggaaaagcttgagggcggctgattgatgaaaggggatgacggtatttgtttactgtattaaaaaagctcgcgtggttttttaaagcctattggctgcgctatacgacagcgattgttctgttattgattgtgaatgtcattgagatgtttccgcctaaacttctcggtaatgcgatagacgatatgaaggcgggcgtgtttacgaaaagcgggatgctgttttacatatgtgtttttctcgcattaacggcagccgtctatttactgtcttatttttggatgtatcagcttttcggcggggcgaatgtcatggagaaaattctccggtcaaagctgatgggaaggcttcttcaaatgtcaccgccgttttacgagaaatacagaacgggcgatttaatggcgcgggggacaaatgacctgcaggccgtcagtatgacgacgggcttcggggtcttaacgctcgttgattcgacgatgtatatgctgacgatatttttgacaatggggcttctcatcagctggaagctgacatttgccgcgattattccgctgccgataatggcggctgcggtcagcctgtacggaaaaaagatccatgagcggtttacggaagcgcaggatgctttcggatcattaaatgacaaggtgctggagtcggtatccggcgtccgggtcatccgggcatttgtgcaggaaaaaaatgatgtcagccggttcggtgatatgacggcggatgtatatgagaaaaatatgaaggtggcgtttatcgattcactttttgaaccgactgtgaaacttctcgtcggcctcagctatctcataggtctcggctacggcgcttatctcgtttttcaaaaccggctgacgctgggagagctggtatcgtttaacgtgtacctcggaatgatgatctggccgatgtttgcgatcggagaattaatcaatatcatgcagcgcggcaatgcctccttggatcgtgtcaatgagacgctttcctatgagcctgacgtgatcgggcccaagcgccccgccggcatcaaggagcccgggcgtcttgtttttgaacaagtgactttcacgtatccgagcggagcgggaccggcggtttccgatgtatctttttccgtagaaaaagggcagacactcggcatcgtcgggaagacgggaagcggaaagacgacgatcattaagcagctgctgcgtgaatatccgcccggtgcgggagaggtcacgtttacaggcgtcccgattcaggagatcccgcttgaggagctccgcgggtggatcggctatgtgccgcaggatcatattttattttctaagactgtaaaggagaatctgctttacggacggcaggatgcaaacgaagaggaaatcggcggcgcgctgaaagatgcgcattttgaaaacgatatcggcatgctttccgacgggcttgagacgcttgtcggcgagaagggcgtagcgctctcgggcggacaaaagcagcgcatctcaattgcgagagcgcttttgaccgatcctgatattctcatattagatgattcgctttctgccgtagacgcgaaaacggaagccgccatcattgacagcatccgtaaaaaacggcggcataaaacaacgattatcaccacccaccggctctcggcagttgaacacgcagatctcattctcgtcatggacgaaggccgggtgtctgaaagaggcacgcaccgggagctattggcgcagaacggctggtatcgaaaacaatatgagaggcagcagctgtcctctcttgaagaaggggggacgggcgcatgaagaccgggagaagattatggaattacgcgcttcaatataagaagctgctgatatgggcggtcgtcctgctcattattgcggtcggcactgagctgaccggcccgtttatcggaaaaaaaatgattgatgaccacattctcggcattgaaaaaacatgggttaaagcctctgcggacgatccgggcgccgtcaggttccgggggcatgattatgtcagggaggaccggctcaaaccgggggcggataaaaccggagaggcgcacatttatcaagtcggtgcgggctactattttgttgaccgtcccgtcagttttgacggaaaccgttcggtgtctgacggccggctgacaatatcaaacggtaaagaaagcaggtcatatcccgtcattacgttatcaagacaggagatttttgaattttaccgtccggaaataaaaggattgctgacgttgaccgccatttatgcgggattgctcatgttttccgtatgttttcattacggtcagcattatctgctgcagatgggagcgaaccggatcatacagcgcatgaggcaggatgtattttcacacattcagaaaatgccgatccgctactttgataatctgcctgccggaaaagtcgtggcccgtattacgaatgacacagaagcggtgagggatttatatgtaacggtgctgtcgacatttatcacaagcggcgtttatatgctcggcatttttacggcgctgtttatgcttgacgtcaggctggccgccgtttgccttctgattattccgattttaatgatctggtcggttgtgtaccgcaaatatgcatccgtcttcaatcaaaaaatccgttccattaacagtgacatcaatgcgaaaatgaacgagtccattcaaggaatgccgattattcaggcgttccgccgcgagaaggaaacgatgaaggaatttgaagaattgaatgaagctcatttccgctacaaaaacaaaatgctgtccttaaattccctcatgtcccacagtcttgtcaatgtgttgcgcaatctggcgtttgtcgggctgatctggtatttcggaggcgcgagtctgagtgcggccggaattgtttcgatcggtgttttatatgcatttgttgattatttaaaccgtttgttccagccggttacggggattgtcaaccaattttcgaagcttgaattggcccgtgtctctgccgccagagtattcgagcttttacaggaggaggaaacggaagaagaaggcgctcccgcagacagaaaggcggaagggacagtggaattccgcgatgtttcttttggatatcgaaagggagaagaggtgctgaaacacatcagctttacagctgaaaaaggggagacggtcgccctcgtcggccatacggggtccggcaaaagctccatcctgaatcttctgttccgtttttatgatgcccaaaaaggggatatcctgctggacggtaaaagcatatacagcatgtcaaggcaggagctgaggtcgcatatgggcattgtgctgcaagacccgtatcttttctcgggcacgatcggctccaatgtgacactcgatgatcagcgtatttctctggagcaggcggaagaagcgcttcgccaagtcggcgccgcaagccttctgcaatctttgccgaagggcatcagagagcccgtcaccgaaaaaggcggcacactgtcctcaggccagcgtcagctgatttcttttgcaagagcgcttgtgttcgatccggccattttaattttggatgaggcgacggcgcacattgacaccgaaacagaagcggtcattcaaaaagcgctgcaagtggttcaagaagggcgcacgacatttattatcgcccatcggctttccacgatcagacacgcagaccagattctcgtgctggaaaagggccgcatcattgaaaagggaagccatgacgaattaatggcgcaaaaggggcagtaccatcaaatgtatgaattacagaaaggaacggcgaaatccgcggtgtaatcggaaagggtgaatcaaaagattcgcccttttttcattcagtaagccagtcctacccgttttctgacaaactgcgggctgatcagctcgcggtacagaaaatgtgccgtgtctccgactgtgatttcggcgccgtcttcaggaaggcgatcctgttcgaaccggtaaactccggcagcgtctccgtcaggaaggtaggtagggcagatgatcgtccagtcaagatcctctgccagcagcatctcgtatacgcgggcgtgttcctttgcggctcttgttgattttcgttttgattctgccgattcaaaacggtattgatcaggcataagccgtgattgaaggatacccgcggtgccgatcgtaatcagacgctgaacatgatgccgtttcatgccgtctattatatgggtcatagcggctgaaagggtatcgtcaccgtccgtgccgagacagctcacgactgtgtccgctttggaaatcaatcggctgacatcttcccgccgcctcgcattccctgttatgatctgtttttcaggaatgggaaggactgttccggctgatctgacaagagcgaatatttccatgtgtccatgtttctgcgcttcttttataaaagcctgtccgactcttcccgttgctccgagtaaagcgatgttcatgtaaaaaacctcctcgccgctcattatatcattcaaagcagcggggaaaagaatgcctgtgaataaacgggaaatggtgggcaacatattcattgaccaaagaaacacttacgaactgaaacagctcccaattgactgaggcaatgaatgacatgttttccctccttttttcctagggtatgtggaataggaaaaaagggtgacggcataaaagaagacgcggtatcccgcgccttctgtaagccatttattgagttattgtacgccttggccgcccatgttctgctgtgcgaaagatactaaacgtttcgtgatttctcctccgacagaaccgtttgcacgagaagttgtttctccgccaaggtttacgccgaactcagaagcaatttcgtatttcatttggtcgattgcttgagcagcgccgggtactaatagttggtttgaagagttgttgtttgccatttgtatgatctcctttattaagtagtatggttgggtttgctggaattgcaccagccgatgattttcggaatgaaaaccattgccagctcggcttcacccaatgctgtttgccgctttgtactacgtattatggtgaatcaaagggcatctcattcggaaaaccgggtggtaaatagcggaagggaaaagaaaagcccagcctgatgcggctgagcttttagctttcagtcatatatgtgataaagcattaattcgtgcagctcttttacgagagccggctcttcttttcccggatgtgtgtgtccccattcaatgtcaccggacttatggtaaaccccttcgtaatgcgtaccctgccagtaaaatgaaatccgccatccgggcagtttctcttttttgaataacggtttccagctgaagtgcgaaatcatgacgttcacgctccttgtaggaaatgttgatcttgttcattgtagctcatcattctgtgcctgtcccgggtaaaaccaaaaaaagacagcctcaccgccaaagtttttccggggcggtgatggaccgttctgataaataggacgcgtattcaaaatttctccgttttgtcaggtaatcgaccgatctcagcttcggatgggaaaaaatgctgcgcccggggcgggaattggcttcaaacatccaaactttccctgaatgatcgacgccgaggtcaaaaccgatttcgccgataaaaccttcaatgtgctcatttaacacgcggctgaccgccaaggcggctttggaaagtttccgcatcatgccgactctctctcgcggatcgccgtataattcagctaacgtcctgacttctccgccggttgccagatgcgtcgtgatgctgttttcaccggaaatttttgctgcaatggccgtcactgtccatttcccctcggcgtttttattcgtgtgcaccctgaaatcgacggggcgtccatccagccggatcaggtcaatgccttgctgaattaaaaatgcggacgggtcattgttttctttaaatgatttcatgaaggatgccgcatctgaatactctgccgtcaccaccgttttttcctcattcgtgtgtttgacagataagccggcatctgttttttccaccctgtaaatccccgttccgagtgcgccgtctgcaggtttgatatagacggtgtcaaatgtgttgcataacgtctctaacgcctctgcattcgggtgcaggacagattttggaagaagtgaagcggtgagactgtttttttccagaagcttatgaatgtcccatttattaaagaattgcggattaaaccacggaatctgatagtcattcatcagcctctgttttgtctgctgtaaaagcggaactccttccgtttttcggctcgggagcctgtcatatacgacattcggaagcgggacggacgtccgtttccagctgttttctttataaatcagcgcttggacggtgccttcttcccagttgatctgatgagctccgaaaacgaaacaatatccgttcgcctgttcatgaagtgagagcatcttggaaaagaaggctgtacggtctcttaacgggcgggacggcgatgatgtgaacccggctgtgaaaacgccgatcagcggtccgatgtgcaccgtctggccgtgtatgagaaagtcagcccggcttttatacggtatcaacagctcctcaaacaaatcttcagaaaggagcgcgcttttttcaagtgattgagaaaaggctacacggcatttgacaaccttggtcccgaaggcagcggataaaagcccttcccgtttcatggaggaggggagaaacagcgtatttttgctttttttatcgatgccgacaatcatccctttatgattcacgcggtaatactcccttcctgctgtcctgtgactgaagttcgcggaagcgtctcagcggacccgtatacaaatcctctttcgcctccggagccacgcttaaaatagctttccgtcccggctttgaattgacatccaaaagccagatgcgtccgtctttggcataacaaatatcgagccccagctcaaacagcggtccgaaccgttcatcaaggaaataaggaacggattgggtgatcgaaaagacatcatccaataaaacggcctgctgctttctcggaatttcctcaaaccatatgtcaaacttaatcggttctgatcctccgggcaaatgagataaaagaccgttctgataaccccttctgaccgcttttccgaccgtttcccaaacgcctgactccgttttgcgcatgaaaatgcggatgtcgcacggatgccgttctttatcctggatatttaagtaggattgaagcaaatagcggtgctgcagcacttttttgcaccaagacttaaaagacacgtgattggaaaatgattttgtttgtttgttttttccgatatagtaagtggcggtaattgattttttgcctgtttcaagcaggatgatgcctctgcctcccgcgccgaaagcgggcttaagtatacatgctttttccttggctaagtataattgcacctgttcatagcggctgacttcggccgtttcaggaatatagggactgatcagatgatgcttttggagcgcatctgtaaccgtccatttatcaggaagcccccgcccgataaattccgttttcggatattttttcagccattcgacgatcggtttggctttttgcgcttcagcggattttccgtaaaaacagcggtcgtaaatatattcgggaatatcgatttccgtttcgttccactttccgctttgcgggtgatagacgagcgctttcacgcgcaaagaatccggaaatatatcaaacggtgtaaagcgggctaagcgcacattatattgaggcgctctttcagccaattccccggcgtaatcttcttcgtgccggcgggatacagacataaaaccgagtgttgtcatattactactccccctttattcaaaaagccgctgatggaacggcccttccatccaataaatatgctaagcgcatcataaaagatgatctactgtaaagagtacgaaacagcatcttgccttattcctcacaaacaacaattcaggttcttcatttgcccgcatgcccgccagcctctataatacgaatagatatatcatcaagaaaatagaacataagatggaggcagaagaaaaggaatgggcatagcaggaacgtttctatttatgatcgtgatcggagccgcgatcggcgcggtgacgaatcatcttgccattcagatgttatttcgtccgtaccggccgtattacctgttcggaaaacgggttccgtttacgccggggctgatcccgaaaagacgggatgaattggcaaaacaaatggggctcatggtgacgaaccaccttttaaccccggaaggaataaaaaagcggcttttatcagataacgttaaaaaccaggcgcttcttttcgccgaacaattcacgcaaaaaatggccgcttccgaaatgacggtgcacgaagctttggccgccgcgggcatccggaatccgcaggaaaagacggatgcctggattgaccgttttaccgatgaaaagctttcggacctgtaccggaaatatgagcaccgcgccatcaaagactggcttcctgatgagctgcaggaaaagctggatgaaaaaatcccgctggccgcagattatatcctgaagcgtagcattgattattttgagagcgaagaagggaaagacagactcggaaatatgattgacgactttttgaattcccgggggatgctcggcggcatggtgcagatgttcctcggcaattcaagcttggcagaccgtgtgctgcctgagctgttaaagtttttgcgcaatgaggaaacgaaaaagcttctggctgatctgctttctcaagaatggggcaagctcaaatcttatacactttatgaggccgatgaaaagtggaatgcgaaagatctgctgttcagcatgaaaaagcgggctttggccgcacttcaaaccgcgccctttttcgaatgccggctcggtgacatcatctcccgttatgaaggggagattacggggacgtacgcgccgaagctgcttgatgcggcactcggcagtattgccgctcatttggaggatgtgctgaaacggctgcgtcttgaggaagtggtcaaagagcaggttgatcagtttcccgttgaacggctggaagaaatggtgctgtcgatttccaagagagaatttaagatgataacgtatttaggcggtctgctcggcgggataatcggagcaattcaggctttgtttgtcattcttttctaaggaaaacatacgccgatgatgaaagtcgctccgcagtctgttatagtggagtggtatgtccgaaaggaagaaaggagcggttactatggcagttcatttttatgatgcagcatatgatcttgaaaaagctttgcgaaacagtgatgaatacagccgtctgagagggctttatgatcaagtaaacgcagatgaatccgcaaaacgcatgtttgataacttccgcaatgtacagatgcagctgcagcagaaacagatgtcaggtgaagaaatcactcaggaagaggtagagcaggcacaaaaaacggttgctctcgtacagcagcatgaattgatttctcagctgatggaagcggaacagcgcatgagcatgctgatcggcgagttaaacaaaatcattatgaaacctcttgaagagctttacggcagcccgcaataagctccacacccctccatctatgaaatggaggggtttttttattcaacagaaaaatcaagcgaaccttttaccgttccgttaatgatgacagacagagtgtgaattccccgataatgcttgcgggtggttaaatctttaagggaatgacgtttgctgaaggcttttacgtttccgttatccatggcggactccgacatcttaaacaccttgcggctgcggtgcccccttttctttacaaaatcaatcgcgtattcaaccctgactttttgccgggcggctgagcggatctgaaaagaaaaatgtatgcttgttccgatggcggccgtttccgaattcagtgtaaaacgttccaatgaaatccgggaggcgtcttcaaacccgaaaatcgcaagcgcctgtttgtctcctctttttaacagtgtcctgcaggcgtgcttcaaaatccaatccgtgtgcggacagcttccgaaccgctcggctgcggtctgtgccagaagatccggatgggttttggagatgtcattcaggttattcgccacgctttttctgacatataacgagtcatcctgcatcaagcggtccagaacagggagaatcggagaaggatcttcaagaagagccggaatggagattccccacggcaggcgcggtcttgagccctcgctggcaagccttctgacatgttcgtccggatgctccgtccaggaaaggaactctttgaacatccgctcccggtcaagcctgatatacgggcggaccgcaaattcggaagtggaaaaacgagtgaaaaactgaagcgccttcattgattcttcccagtgatccgttccgtactgttggacataatcgggaaaaataatcccggcgagccctgtgaaatggggagctgtctcatataagacgtcaagcgcccgtatgtaatccttcggcagtgtttcatataaagagtctgtgatccggcgcatccgctgttttaacgtcagtccgggccaatcttcctgaaatatcagcgcccggcacttgtcccgctcaaaagccggatacgccgatttgactctgtgcagaagtgcttctgcaaattcttcgttataaatatcttttaatagagacatgacagtcaccgctttttttcttttattatatgcgaatatacgttccttttcaattttatcatacattcagcacagatagttcccctgatttttttagttaaaaaaacccttgttttttaacaatattattgagataataactctgaaagcgcctacacttacagatgatctaaggatacggtcgcctatactgcctggtatgttaaggggtagcaacagagagtaagtgaaacgagcgcatcaacggtcaaataaggggttcctgatatatttcgttaatagaaatgcacattggggagaaggcagcaaatcgatcgtatcccaacaaaacgacagttcaaagtctgcttgaggcaggcttttttgctgcggagaaaaggttgttctaaacaaagagacagggtcatatcctaatgacaagtacagtcatcaaggagggggacttctctgtgtcaaaacaaatgctggcgttaaatatagacggagcgcttcttcgctccaacggcaaacttcatcagacgacaaaggatgccatcgaatacgtcaagaaaaaagggatttacgtcacactggtcacaaaccgccattttcgctccgctcaaaaagtggcgaaaatattaaagctgaatgcaaaattgattacccacagcggcgcatacatttctgaaaaaatagatgagccgttttttgaaaagaaaatatcagaagatcacacgtttaatatcgttcaggtgctcgaaagctatcaatgcaatatccggcttcttcacgaaaaatattcgatcggtaacaagaagaaagtgaactccaatctggtcgggaaaacgatgattcatccgtctgacccgatcttttatccggtgcagtttgtcgaatcattaagtgacctgctccttgatgagccggtttcagcgcccgtcattgaagtgcatgctgaagatggcctgcaggctgatataacggatacgataatgaaagcattcccggccgtcgatgtgatccgcgtcaacggagaaaaactgaacatcgtgcctaaaggggtttcaaaagaaagcggactttcgatggtcgccgctgatctcgggctttcaatggaagaggttgtggctatcggccatcaggaagatgatctgccgatgatcgagctggccggtctcggcgtcgcgatggggaatgcttcaaatgaattaaaaagaaaagcggactgggtgacaaggtcaaatgatgaacagggagtggcttatatgattaaggaatatttccgcatgcagcaccgcaaaggctttctcgataagttccatatgaaacggccgtaatcaagagccgcagacgcgaaacgccggtctgcggctttttcgcggattgattttagcctgttctttctgtacactaaagaaagttttgaatctgaaaaataaggtgatcacattgcaaataaaaatagacggcataacggatgacaggctgcatcgtccgctgcaaaacatcgcgaatttattttttgaagagtgtgttcttacgtacggcgaaacggaggaaccctctgatctcgtcatctcacttgccatttctcaagatgcagacagcgtgtcggtatccggagaaatcaaaggaaccggcgaaaaggaacatcacacgaaaccgcttcttgccggatggagcgaaaaagaagtatttaaacaggtgaaaaacacgctgtcatatgtctacttaaatcttcttcaatcacatacgggcatgacacaaaaatggggaatcttaaccggcatcaggcctactaaacttcttcataaaaagctgcagagcggcctgacaaaagaagaggcgcatgccgatctgaaaaaagactatctgatccatgatgaaaaaatcaatctgatgcaggagattgtcgaccgccagctcgctgcggttcccgatctgtaccgggtcaaagatgaagtcagcatttatatcggcatcccgttctgcccgacgaagtgcgcctactgcacgtttccggcttatgccattcaaggacaggcgggaagagtcggctcctttttatgggggcttcactatgaaatgcagaaaatcggagaatggctgaagcggcatgatatcaaagtgacgaccatttatttcggcggcggcacgccgacaagcattaccgctgaagaaatggatcttttatatgaagaaatggtccgctctttcccggatgtcgcgaatatcagggagattaccgttgaagcgggccgtcccgacacgattacggaggaaaagcttgccgttttaaataagtataagattgacagaatcagcatcaacccgcaatcttatgaaaacgaaacgcttaaggctatcggcagacaccataccgttgaagaaaccatcgaaaaataccatctttcccgcaaacacggcatgaataatatcaacatggacctgatcatcggcctgccgggagaagggacggctgagttcaggcacagtcttgaagaaacggaaaagctgatgcctgaatctttgaccgttcatacgctttcttttaaacgggcgtcagaaatgacgagaaacaagcataagtataaagttgccgacagacaggaagtgtcccgcatgatggatgacgccgtccgctggacaaaagagcacggctatacgccgtactacttgtatcggcagaaaaatattctcggaaaccttgaaaatgtcggctactccttcccgggtcaggaaagcatctacaacattatgattatggaagaagtgcagacgattatcggtatcggctgcggggcggcaagcaaattcattcatccggaaaccggaaaaatcacgcacttcgccaatccgaaagacccgaaatcatataatgaccgattcgagcattatacagaagagaaaatcaaatacttagatgagatgttcgtcaaatctgcattataatatcaaaaacggcacggaatcagcgtgccgtttttttatgtttaaccgtctgtaaaaacgggaaaagatcatcagactgttattcgcaagaggtgcataatatgtatgatgtcataggagcgggaatcgggccgtttaatttagggcttgccgcattgttagaggatatacccggaacagacgctctttttttcgataaaaagaaagaatttgcgtggcatcccggtctattaattaaaggaacggatttacaggtggcgtttctggcggacctggtcacgctcgccgatccgaaaagccgctacacgtttttaaactttctccatgaacatgaccggctgtaccggttttatacgtttaatgaatttgatattccgagacgggaatttaacgactatttaagctgggcggcttcagaaatcaaatcatgccgtttcggctcagaggtaatcggcgtgaaaaatgccggcggacattatgaagtcagcgtcaagaacattgaggacggaagcatcagtgtctatcagacgaagcatttcgtcatggggacggggtctgaaccgcttattcccgcagagattgatgacggagcgcgtcaggacacgatggtcagcacggaatatttgttccggaaagacgagctcgccggcgccgaatcaattacagtggtcggctccggacagagcgccgcggagatcttttctgacttattgcatgatgaacaataccggcgcagccggctgcaatgggtgacacgctccgccggatttcgagaattggaaaccgccaagctcgggcaggaaatgtttacacctgattatgtggaatattttaaccgcctgccttttaaagaacggctgaacacactccctgagctggacggactgcgccacggcattgattctgacacacttgccaccatttacgacgccctgtatcacagatcgatcagcggaggttcgcctgacgtgtatattcagccgatggcggagcttgaaaaaattgaaaagcaaaacgggcgctgtgtactgagctttcatcaatggcagatggatgaaacttttacggccgattcagaaaaagtgatattggcgaccggctttaaacctcatattccggaatggtttacggcaatcgccccgatatcgaatgggaggatgagaaacggtttaaagtgacggccgattcccgtcttgtctttaaggacgacagacggcatcattttttcacattaacgaatcttgatcatgctcacggaacgggcgctacgaatttgaagctgtctgtttacagaaaccaaaaaatcatcaataccattctgggaaaagagcatttctccattaataaaaaaacggcttttcagcaatttcttcccgctcaaaaaaactgacctcttatgaagaggtcagtttttttttatgatttctgcggcttcttttcaggcgtcttccatttgaatacgctgttcagcaggagatatatccgcttcgattctttcgtgagcaaagggccgaagatggccagtatcaaaacatataaggcggcgaaaggtttaagtgaagcggacaggccgccggcgatgccgagatttgcgacgataatggagaattcgccgcgggacacaatggtcagcccgatattggacgatgctttatgagaaagccccgcccggcgcccggcgatcatgccggcgataaagtttccggcaatcgtcagcagaacggcgccgagggcgagccataccgcatctccgagtgaaaacggatcaatgctgaggccgaaactgaagaaaaacatggcgccgaaaaagtcacggaacggcacgacaagatgctcaatcctgtcagaatgggccgtctccgaaaacacgagcccgagcaagagcgcgccgatcgcttcagcgacatgaatcgtttcggaaaagccggcaatgaaaaagagcgcggcgaaaatgacgatgacaaatacctcgtttgaacggatatcaagcagcttgttcagcagaggcggcaatttccgggcggcaatgaaaaacagcagcatatatccgaaagcgatcacgattgacatcagcgcgcccccgacagacgtcgcgtctcccagaacaagcccggaaacgacggataagtaaaccgccagaaagatatcctcaaacataatgatgccgagaatcagctccgtttccggattggccgtgcgctttaagtcgacaagcacctttgcgacaatggcgctggatgatatcgtgatgacgcccgccaatacaagcacttccaaaaaggaaaagcccgtgataaatccgtagatcagccctaaactgaaattaatcagaatataaatcgttccgccggcggcgattgaacgtccggatttgactaattttccgactgagaattcaagcccgaggtaaaagaggaggaacaggacgcccatccgtccgaaaaattcaatcacttcccggctttcgataaacgtcagatcaatgatgcccgcctggggcgcgtgcggcccgacaagcattcctaaaatgatcaggaaggggatgatcgagaatttaattttattggcgatgacactcgcaatggccacaagaactaacgccgtaccgacttcaaatacgagatggtccataaacagatcacactccgtctctggagaggaagtcttggatcagttttttcagatgctttctttcacctgagaggacgagtgtatcgtttgcttcaaggagcgaatcagcccccgggtttaaaaactttttctggtcatgctttatgatggcgataaccgtcacgtcatagttttggcgcacatccagttcgccgagcgtccgccctgccgcttttgcccctttttcaactttaaaccattcgataatcagatcgctgaacgccatttcaatcgattcaagcgcctgcggtttgtacaccatcccgccgataatcgcggcaatctgtcttgcttccgcatcatcaagtgaaatgcttgccagaagctcatcagggtcgcggtcatcaaatctgtaaatttcccgcctgccgtcatcatgaatgatgatcgtcattttttcatgatttctcgtttcgatttcgaattttttcccgatgccgggcagatcgttttctttaatattcataaaaaatccctccggaatatactgtttttacaccgtaaatacagattggcaatgagaaatggtctgatgccggaggtaatttgactggtattgtatcggaatggcgcatgtcctttccattgtggaatcaatgaattgatcaagaggtttgacagataacagggagatcatccgggataacgcaccgtatccttttgacaggccttgcggagcggttttggtttgaaccggcgtctttgccgattccgtttcctgcgggtagaccgaaatttgtacatggctgtctgtttctgtcaccaattgggaaggaagagcgacatccgaaggggggaacagcaccataaaaaagctcagtaacaagctgagtatcacatatttcattatcggtgtttttcccccctttttgttttgtatatcaatttcactatataaaaatgtatgttcagtttcaaatgatatgcatttttcggtatctgttgaccttgaaaaataaaggagtttcgcttcgggggaaggaatatatcatttgaacaaaatatgtaagcggattcaaggagggagtaaacatgcagtatattcgttatgaagaaaagggaaagatcgcagagattgtgctgaaccgtcctgacagttacaacgcgctgaatgaacaaatgctccgggaattggaaaatgcatgcgttatggcagccgacagcgaagcgcttatcgtcctcttgcggggggaaggccggggattttccgcgggcggtgatatccagatgatgacgtcggatcatgattcgggagaatatgaacggctcatgaaaatgattgaatccattacgctgacgctctatgatatgaaaaaaattgtgatagccgccatccacggagccgcggcggggctcgggctgagtttcgcgctgtgcgccgatgtggtgctcgccgaagaaaacgcccgactcgcgatgaatttcatcggcatcggattggttcccgacggaggaggccattatttattaatgagacgcgtcggtgagatcgaagcgaaaaaactgatttggagcggtgaaaaattgccggctgaaaaagcggtgcggctcaagcttgccgacgggctgttcagcggcggccctgcggagggggcacaaccgtatatcgaccgattgctgcatgcgccgctgtcagcgatgattgaaacgaaggctatttatcagagcctccatatcagccggttaaaagacgttttatctcttgaacgaaaggcccaggaaaatatgagaaaaacggatgatcataaagagggcatccgcgcctttttagaaaaacggacgccgcaatttaaccggtaaaatacagaagccggaaagcttctgttatctgtggaataaaatcagctttccggcttcatttaccaagcggtgagtactgttctcaagctttttttcctctaacaaagcctctccggcggccttcgcctccgcctcattatctgcttcgatccgttcatccagcagcgtttctcccgacgcatggaatgcggtcaatacatattgtcccatcatgtcaccccctttatagaatgatattctgataaagaatttaaaatcctccattaatttttacccattattagtatataatgggtcaaggaaggagttggattcgtgcttacaattgaaaatgtaacgaaaacattcggcagctttaccgctgttgacaatttgaacctgcaaatacctgaaagggaaatgttcgggctgctcggcgcaaacggcgcgggaaaaacgacgacctttcggatgattttaggtcttttaagcctgactgacgggcatatcacctggaaagggaagccggtcaattattccatcagtgaaaaaatcggctatctcccggaagaacgggggctgtatccgaaagtgaaggtgagtgaccagcttgtctatctggcgagattaaaaggaatgagcaaaaaagaggcggaaaaagagctcatgacatggctcgaacgcttcggcattacagattacaagaataagaaagtcgaagagctgtcaaaaggaaaccagcagaaaatccagttcatttcggccgtcctgcataagcctgaactgctgattctcgatgaacctttcagcggtcttgatccggtgaatgtcgagctgctgaaagaagcggttatttctttgaaaaacagcggcgtttccatcgttttttcaagccaccgaatggagcatgtggaagaactttgcgagaatttgtgcattctccagaagggaaaacccgtcgttcaaggcaatctgaaagacattaagcggtctttcggcaaaaaaaatgtcaccgttcattcagatgatgacctcagctttttaaaaacgcatgaaggtgtcgtgaaatggaaggaaacaaatgacggaatcagactgcaggtcgcgaatgaaccggtttcgcaggatattttccgggcgctgcaagggaaaggttttatacggaagttcgaattggaagagccgtcactgcatgatatttttatagaaaaggtgggggccgtatatgaataaattttggattatgctgtttcatacatataaaaacaaaatcgcaacaaagtcattcattatttcgaccgccattaccgttttattagtattagcggtgaccaacctgcaatcgattatttccgtgtttcaatcggatgacggcaagcagcaaatcgcggtgattgatgaaacgggcgggctgtacccggcgtttgcaaaacagcttaaagcggcggatacagacaatgatctgcaggcaatggagacgaaggagtccgaaaaagatgccgtaaagcgtgtcaaagacggtgaatgggacggactgtttatcatcagacaggatcaaaaaggaacgataacgggagcatacaaggcgctgaccatttctgatgaatcagcgtataaactgctcaagcaggctttaacccagacgaaaaccgctgtcgaaaccgccaagctcggcatttcggcagaaaaagtcagcagcctctacactccgccggaagtcagcaaagacgcgctggaaaaaggggcgaaatctgaggaagagctcggtcaggtaatggggcttgtatacatcatgctgtttgtcatctacttctcagttatcatgtacgcaagcatgattgcgatggaagtggcgacggaaaaatcgtcccgcgtcatggaaattttaatttcaagcatgccgccgattcagcagatgtttgccaaactgttcggtatcgcgctcgtggggatcacacagtttgcggtgctgattgcagcgggttatctctcactgaagctgaaccctcaaaatgatgcgtcgtcgccgatcagtgcattcctcaattttacggatgttcccgtctcgacgatagtctatgccgtcattttctatttgctcggctattttctttacgcgacgcttgccgcgtttctcggcagtgttgtcagccggatagaggacgtacagcagacgattcagccgatggtttttttggtcgtggcaggttttatgatcgccatgttcggcatcggcaatcctgacgccggttttattaccgttacatcttacattccgtttttcacgccgatgattatgtttttacgcgtcgggatgctcgatatcccgttttggcaggctgcggccgggatcgccctgacactggtcactatcgtgatctttgcggcggtcggcgcgaaaatttacaaaggcggcgttttgatttacggaaacgccagcggattcaaagcgatcaaacaagcgctgcgcatctccaaaaaataaatgaaacagcccggaacagccgggctgtttttttattttacagaacgtgcattcgtataaaaacggtgctaaaataagggtaattcaatctgcagaaaggggagggcgagatggctgatctgacgtttattcatgccgctgacctgcatctggacagcccgttttacggcatttcgaatctgcctgaaccggtatatgcgcgtattaaagaaagcacatttcacagcgtccgccgtctgacggacggggcactccgggagcaggcagatttcgtgctgctttcgggggatctgtttgacgaagccaacagaagtttaaaagcccagctgtttttgagaaaacagtttacgagattacaggaagcgggtatccaagtgttcgtcatattcggcaaccatgatcatttgggcggtaagtggacgccgattgaatggccggaaaatgtacatatattcacctcgggtacaccggaggaaaaatctttctttaaaaacggagagcttgcggcaagcatatacggatgcagctatcaggaaagaagcgtaacggtcaatcaggcggcccgttaccggaaaatgaccggcgcgccttatcatatcggcatgctccacggcatgttatcaggagcggaagggcatgacccgtactgcccgtttacgaaagaagaccttgaaaaaagcggcatggattactgggcgctcggacacattcataaacggcaggttctgtccgcccagcatcccgccgctatttaccccgggaatattcaagcccggcatttaaaagaaaccgggcctaagggatattatctcgtccgggcggcaaacggtgagatgtcttgggaattcaaagaagcgcatgatgtgttatgggaggaaattgatcttgatatctcaggagctgaacatatgacttcacttctgaaagccgcatcggatacattctccggcttgcgcgcggcgggccgcccggcatgtgtcaggctggtgcttcgcggcgcggcgccccgcttttggacggaggcgcccgcaggcatcgcagaggagtttctttccgctttacaggaggaagaggccgaagaggaatgtttcgtctggccgcttgcgcttgaggatcggacggatgaaacagacagcgtgccgcccgatccgttttttaaagggctgcttcaggacatagaacaatgcgcggacatgagcggtgtatttgaagcccttgagcgtcatcccgtatatcggcgtcagatcacttcatttacagatgaagagatactggatattaagcggcaggctcaagccgttttaagacgccagatgaaggagcttcagcgatgaaaataacggcaatgcatatttaccaatacggaaaattttccgaccaaagttttcagctgtcagattctcccgtgcaagtgatctacggattaaatgaagcgggtaaaacaacattgatgtccttcatcaaaagcgtgctgttcggttttccgaaatcaaaaaaatacgaaccgaaaaacggcggggtttacggcggcactgtggaattgaagcatggcgatcacggtgccgtcaaaatcgaacggacaaaaggcgctgccgaaaaagtcagagtgtatacggcttcaggcgaaatcaaggacggagaatggctcaaacagcttctctccgatacagaccgggcgctgtacgaagcgatctattcgttcgatgtattcggactgcaggagattcaagcttttaaccgggacaaaatcggcgagtttctcctgtattcgagcttattcgggtcggaagcggcggcaaagcttgacgggcggctggcaaaagaacttgaaaggatgtataagccgaacgggcggaacccccgcttaaatcaggagttggatacattaaagcggctcagcgcccagctgaaacaggcggaagctgcggaagcgggctatcacagccttctggaagagaaaaaaagcgccggcggccgtttgcaggatgccgaagcacgattgaaagacataactgaagaaatcaaaacagtaaaatcggcgatagaagcaaagccgctcgcagacaaaaaaacagccttggaaagcgaactttcttcttatccggatgcattgaagcaattcccgaaggacgggatgcatcagcttgaaaaatacgaatcgcatctccatccgaaagctgcccgtcttgagggacttcgggcaaaagctgctgaactcaggcggcaggctgagctgctcgctccaaatgaggacttgctgcaaacagagcggcagctgcaggagctttccggcgagcagcatatgtacgaatcgcgcggtgaacagcttgccgccatccaatcacagatccggcagacatctgcccgcgttttgtcaggattgcagcagctcggaagacatgaggaagacggcattctttcactgaacaccgattatgaatatgaatggcggctgcaggaagccgtgcagagcgccggacaggcaagagaaagaaagacacagcttgatgcgattttcgaacaagcgcggctggagctggaagaagccgaacgaaaacatgccttgacgtcggaaaacattttggaccccgctgtcaggaaagaaaaagaagccgctttacaatcatataagcaaacggctgatacagaaggaaacgaatggcaggcacatgtacagcagctggaaaaacagcgcgccaaacaaaaaaagctctttctcggtgcgggcattctgttcattgcgattttcgctatgttaaaggaatggctgcccgccgccctttttaccggcgctctgctgctgtatatgctgtccggcatgcaaaaaccgctgccgtcagaaagaggaggggccggtcacaagaaaaagaagccgacgatctccaaagaagcggctgaccttctgcaggaagagctttggcgtgacggccggcaccggcagcagctgattgcggatcaagccgtgcttgaacagaaagaagcggcatatgaaagagtcatccgccaatatgaagaatgggaggcggaaatggcgccgtctgaaaaacaggcggaactttttatgaaggaactgggtttttcaggaagtccttcccatcttcttgacgcatatcatgtgatgaaagatgtcaaaaaagaaatccttaataagcatgagctgaccattgaagcgggccggctgcaaaagttgcaaagagcatttgaggaccgggtcaaaaagctgagtccttcagacggaagggagctgtccgtaaaagaaagactgcgcgttttgctggtacaggcggaacgggcccgtgaggaagcaaaacgaaagcaggcgctcgaaacggatctgctgcatgcacaagagcaaatgcgtgaattaaacgaagaagtccattactacgaacagcaggtcaaacagcttttcatggcggcaggcgcaaaaaatcgcgaacacttttgtgaactcgccagactgaatgaaagccgccgggaaacagagcggcagctgcgcgaaatcaaaacgcacttgtccggcataggcggaaaacagcttgagccgtatatgagccgcacagtgtccgaacttgaacatacagtcgttcagaaggaaacagagaaaaaaacgcttgaggaaaaaagcgcgcagctccgtgagaaaaccgctttattaacggtgaaacaagagcagctggagtcctcggggcttgtatccgatttaaaacagcagacagaaatgcagaaggagcgcgtgaaaaaaaccgctaaagagtgggccgcattacagacggtcagacacatcatcagggaaaaaatggagcggcataaaaaagtgacgcttccccgtctgttagaaaccgccggtgcattatacggaccgcttacggacggacgttaccataaattgtatttctccgaggcggatgattccattatggtcatgcggaaagacggaactgtgttttcagcaggcgaactgtcacaggcggcatgcgagcagctttatgcggcgatccgttttgcccttgcgtcagagagggaatctgcggtatcacttccgtttttacttgatgacagttttgtccattttgacaggcagcggctggagcggctgtttgatgtgctgaatcagctttcagaaggcgggcggcagatactttatttcacctgccatgagcatgtcagccggtcttttcacagcggacaagtcatgcggctcctgtcataaaagagtttattttcaaaaaagaggtatgtgctatactggtattatgtaagatatggagggagcttttaatagaatggcaaaaggtattatgctgcacgaggtcggcgagcaggtcgatcaatactttctgattaaatcttcgactaagggaatcgcaagcaacggaaaaccattcctgacgttaatgctgcaggaccaatcgggagatatcgaagcgaagctgtgggatgccaagccgactgatgaagtaacgtacgcggcgcagacgatcgtgaaggtgatcggagatgtccatcactatcgcggacgaaaccagcttaagctgagaaacatccggccggccggcgagaacgaaaatgtcagcattgatgattttctggaaacggcgccgattccgaaaaatgaaatgatggaaaccgtcactcaatacatttttgaaatgaaaaatccaaatatccagcggatcacaagacatctggtcaaaaaatatgcggctgagtttatggattacccggcggcggctaaaaaccaccatgagttcgtctccgggctcgcgtatcatgtagtgtccatgctgaacctggcaaaagcgattgccgatctgtatccgtctcttgaccgggatttactgtatgccggagtcattctgcatgatctcggcaaagtaaaagagctttcaggccccgtctccacgacgtacaccgtggaagggaatctgctcgggcacatttcgatcatggtgacagagctttcaaaagcagccgaagagcttcagattgacgctgaagaagtgctgattctgaagcatttgattttaagccatcacggaaaagcggaatggggaagcccgaaaccgccgatggtgaaagaagcggaaattctgcactacattgacaatctggatgcaaaaatgatcatgatggacagagcgctggaacgggtgaagccgggcgaatacacagagcgtgtatttgcgctggaaaaccgttctttctacaaaccgacgttccatcaataagataaaaaggccgattctctatgatcggtcttttttacgttcagctctcataacttgtctttatcaagcatagcttagaataaagactctgggtgaaaaagggaggaaaccgacgtgctattttttccttggtgggtatacctttgcattatcggaattattttcagcgcctataagcttttcacaacagctaaagaagaggaaaagcttgaccagtcgtttattgaaaaagaaggaagggtgtatattgaacggatggaacaggaacgcgagcgccgtatggcggcgcccgcaagtgaaaacacggatgcagaagaaaactccaatcattccatcgcataaaaaaactgtgcggggctcgctgagagcccgcacagttttttttatttagattcagaagaagttgaagtgttaaacgtgtcttttaagtctttgtcttccacttttacgtcagcttttttcatgactttttgaattgccgcctgtacagctgagttgtcgtttaatttctgtttaagaacttcttctttcaactcttttttcatgtcatcatatttgccgcgttcctctgtctttttgatgatatgataaccgaattttgttttgaccggatcgctgacttgtccgactttcagaccgaatgcagctttgctgaatgtttcatccattgactttttatcgaaccagccaaggtcgccgccgttgtcttttgagttgtcagttgaatattctttcgcaagcgtttcaaacttctcgccttttttcagttttttctccacttcgtcagctgtctttttgtcagcgacaagaatgtggctcgcccggattttaccttttaagccgtcgtaatattctttcgtatcagcgtcagtcactttgatgttgtctttcgccgctttttgtgcaagcagttcgtacttcacctgatctttcaggtaatcttcgccgtactgctgtttaagggcgctgtactgatcgccgagctgcgttttgtactctttcagcttgttatcgatttctttatccgatactttgtatttttttgctaatactttttcttgtacgagctgtgtcagcacacttgcgcccgcggtttttttcatattcgtgtagagttcgccttttgttacatttccggcatccgtcttggcaatcacgtcgttgtcgccgctgctgcaagcgctgagagccaggacgctcgttgccgtaatagctgctatcgcgattttcttcattcctttaaacactcctaatcatccaaattaaattgcatatgcgtatcataacatattgtggctttctgtaaaaagattttaaataaagggcattcgtctagtcaaactttttcctgatacatacaaatatattgatcatgaaaaggaggtaatgaaccatgggcggaggatattcaaacggtttcgcactgctcgtagtactgttcatattgcttatcatcgtaggtgcagcttacatttgttaagcgaaacggatcgctttttctaaaagcgatccgttttcttacccgggcgcctaatcgtttcagaagtaaattgcatatgatgtaattggaaaaataaaacgttttgtaggaggtgcttttggagatgggtgaagtatttgcaggcggttttgcattattggttgttctgttcatcttattgatcatcatcggcgcttcttggctttattaagaaaaaaatatggctgtcgggggtcagacctccgtcagccatatttttttgcctgtttacacagtaaaggagatctcgacgaatgaagagatcagtaaaattaaaatagatacattaataaaacggaataccttatcctgccggtcttcaggaatctctctgacaaggcataatgtatttgtgagcctgtttataaaataaagaataaacagggcagccacgataaaatagaataaaatgatgggagattccccctctctctgaactgctcccatattacattaccaaatatttattaaaaaagatagaatgtaacctgaaaaatcagcgggatatcaagactccggcactttttttactaaaatatcaaaaccgtcggattcctggtcaatcagacatgatttgggcgctttgaccaggtgcagcgcaaacagaagatcaggcaggcaataacccgcatgaatgctcgaaatcatataaaagtaatgagcgtgtctcggaaatgccagtccggcataaaacaatagcggcgtaatgaataaaaacgggctgatcgtagaaatcagcatcgtcgttttcggtatgcctttccatgtcggcatccgcaagaagtacattttcatttccttttttctttttttacagatcatcggcaggacatgtatgactttatgtacaaataaagtaacaacgagcagaacacaaaaagcaaacacgtgcccgtcacttaaactgatattcggacgcagcagcccgaatgccaagaagttgcatataaaaaacaggatcataaaacctacagcagtcaataataaacgaaccgcaccataatctttgatcagattaatggttttccagcaattcatcagagtcatccttccgtacaaagatggaatacaatctcaaaataatttactctcttcaggagaaaaaatcaatccttttttaaagaaaaaaaataaccccggaaagggaagaacagaagagctcggtgaaacatggaaatgtacggtttaacctttcttctccattcattatcagctaaaataagattaaagatagaaagaagtgaaacggatggattcaatggatcagcgtatcgggcgtttagaatattacatacaattgctggtgaaaacggtggatatggataagtaccctttttatgcgatgatgattgaaaaagggctgaccgaagaagaaggagaagaggtcgggcggatctgccgcgaattggaggacgagctggagtcgcaaaaagcgcaaggctttgtgacgtttgacaagctccttgcgctttttgcgggacagctgaacgaaaaattagatgttcatgaaacgatttttgctctgtatgagcaggggctttatacagcgctgatggaagaatttattgagataatgaagcactttgattaactgttgatcggttccagctcttcagccgtttcatggacagccgattcgtctgtttttttcttcagccttccgtcttcactatcaaaatcattgtttatgtttgtcaatgatttctcgaatatctccataaaatcttcgccgtaaatgtggcggatgacacaggttaattcttcaacttccggaaacttcccgaataagtggtagatcggctgtgagcctttaaacaccgcgtttctagacgggtcaaactcctcaagcaggctttcgaatacattttccccttcttctgttaactgaatgtacgtgttccgtttatcattcagccgcttggaaaatttcagatatccccgttcttcaagcttttttgaaaagttaaatgcagttgatacgtgcataacgccgaatttggcgatttctgaaatagaagctcctttaagctgataggcaatccataatatatgatgctcattaatattaaggtcgtacggcttcagccaattctgccagtctttctcgatagatttccagagtgctttggacagctgcgccattttttgggtatagattaaagcttcttttagatcgtaaggcggttcaacacgattcaatacagatcacctgcttcacattttcttttcctctattatgccaataaaataaagattaataaagatgaaaatttaagaattttataataaattcttaatccgttgctgtgaaaggctttaaaccgcaaaaaaaagtgcggaacgcaatatgcccgcactttttttggttgtataggatattagttttgtaaggttttctccagctgtctgattttctcttcaatatcagcgatttccttttgaagatcctgctggtgcggcttgatttcctcctgccaccttttaatgctggtctgaagctctccgcctacgtctttaatgacttctgcgctttctttcgccgtttggacaagctggtctttaagcgccattccgtctttttttaaccgtttgattgtgtcctcaattgaattgcaattcgctttgattttgccccgcagctcttttccggatgaaggagccgaaagtaacaccgctgcgcctccgatcaatccgcctacgaaaaggcctgttaaaagggaacgtccgtcagccatttaaaatcaccccgttttttttctcataacttttatcatttttgttcagaagaataaacttctatacatagcttgctttattttagcatattttttaagggaaaaggagggagaaggttgtctgtctttatgattgttttatcttgtatggctcttgtctttgcggcgggcgccgtttattacctgaaactgctcggccaggccgcttcttatccgccgaagcgggtcgtccgccaaaaggccatcgtctgctcagcaggaaccgccctcgcattgttccttatctttttcacaaaacttctcgtataaaacatgctgaaacacattaaaaaacctcttccggccggaagaggtttcggtatgcggttatttcaccgtttcaatcatattggaccgttttaagatcgtctgcacaatcggatgcataatgataatggcgatcgcattcagcgcagccgccggaaggacgaccgcgagcaccaaggcggtgaatccccccggcaggccgacaatcagaagggccagcgccagaaagagcaaaccggagatgaaggtgccggctattgtaatgacggcggcggccgctgttttcacgctctttttcaccaaaagcgccagcgcgagaaacagaaacgccgttaccggtttttcaatgatattcggaagctgtccgcccggaaaagatgtcgtgagtgcggaaatgattcccgttacaatcccgatcatcagcacgttctgcacacggggaaataacagaatacccataaacatcatcacaagcatcatatcgggtttcattccgaataataccggcggcataatggaatgaagcaccgctccgattgccgcaaacagggccataatgactaattcttttgttttcatactaagctctcctctgctaagctttttcgccatccaataatatgctcgtcatttattgcgatggccggaaaaattgatatgcaaacagtatatcaaaggaaccgttatgttagaagaaatttattcgttttcctgctggaactttttcataaactgagccagtttttcacaatcagccaggctgacggcgttgtagatagacgccctgcatcctccgactgagcggtggcctccgagtccggtcattttagccgctttcgcttcttcaacgaattttttcgtgagactgctgtcgcggagggtgaacgtgacgttcatgtgagaacggctgtcttttgcggcatgccccgcgtaaaaaccgccgcttgcgtcgattgtgccgtacaggacgtcggccttttcatgattgcgccgttcagccgcttcgacacctccgttttcagccagccattcaaggacgaggctcagcatataaatcgcaaatgtaggcggcgtattatacagtgaatcggcttttgtatgagtggagtatttcaaaattttagggacgttggcgttttcgttttcaagccatgattttttcatgatgacgaccgtgacgccggacggaccgaggtttttctgggcgccgccatagatgacatcaaacgttttgacatcaatttttctgctcaggatgtcgcttgacatgtcggctacgagcgggattggtgaattcgggaactctttccactgcgttccgaaaatcgtgttattggacgtaagatgcaggtaggcgccgtctttgattcctgtgaggtccgcttccggtatatggttgtggtttgaatctgcgcttgttgccgtgacggatgtgtttccgaacagtttcgcctcggcgagtgctttttcagaccatgcgcccgttacgatgaagtgagccgtttgctccggcgttaaaaagttcatcggcagcatggagaattgaaggcttgcgccgccttgaagaaataaaatatcataatcgtcgggaatatccatcagttctttcagaaggctttttgctttttgatgcaccgcatcatattctttgcttcggtgggacagctccatgacggacatgccggtgtcattgaagttgacaaattctttctgtgctttttgcagcacatccagtggaagggctgcgggtcctgcattgaaattcgttgtacgttccatgtttacgatctctccctgttttccgctttagtgtaagaaataatacaattatcctatcacaattttttgatttttttgatatgaaaaaatataattttatgttttttgtgttgccggacgcaaaaaaacctcatctttaagatgaggcaagccgttttctgacggttgaagcgatctcctgaagatcgtcaggcgtatagtcttcggcgtgggtcttccagacagccccgaaaccgtcgccttttccgtaacgcggaatgatatgcatgtgaaaatggaacaccgattggcccgctttttcaccgttattattgagaatattcagcccgatcggctcgaattcatcgcggatggcgcgtgcgactttcggcaccgcttcgaaatattctttagaaagctcaggcgtaaactcgtacacgttttcgatatgtgttttcggaatcacgagcgtatggccttttgtgacttggctgatatcaagaaacgccacaacatgttcattttcgtatacttttgaagacggaatgtcaccggcaatgattttgcagaaaatacaatcgtccgctttgtgcatagatgggtttcctccctgaaaagaaatatatgtatattctcatcgtaccacaaaaacggtcaaaacaaaaaacaggatgaacggctgcgcgttcaccctgatgcagaagtacgagctttatcacagaaaattaaatatgccttttgtaagcacctcatttgtttttaaaatgaagacttatgggtctgcttaatcattcctgggacaaacacctcatttgattatttcatcatgaatgaagaacatcatcaaagcagtgtgtgaagaaattgtaagcacaggacatgttgattttcatccaactgttctaagacgtcttttataaacacctcattttcagttgattaaagctgtttccttctacatacattatgatgtccgccaaaacgataactatgcacgcttttcacgtgagaaaaaaagggaatcgtttcaaatcagactttatttttggtactatgaagaaaaacgaatcagaaggggagaaattatgtctctgctatcggtaaaagacttaaccggcggttatacgagaaacccggtcttaaaaaatgtttcattcacccttgagccgaaccagattgtcggactcatcggattaaacggcgcgggcaaaagcacgacgatccggcatattatcggattaatggacccgcataaaggctcgatcgagctgaacggcaagacgttttcggaggataaggaaagctaccgctcgcaatttacgtacatccccgaaacgccggtgctgtatgaagaactgacgctcaaagagcatctggagctgacggccatggcgtacggcctttccaaagaaacgcttgaaaaaaggcttcctccgcttttgaaagaattcagaatggaaaaaaggctgaaatggtttcccgctcacttttccaaagggatgaagcagaaggtcatgatcatgtgcgcgtttctcgcggagccctcgctttatatcattgacgagccgtttctcggccttgacccgcttgcgatcaatgcattgctggagcggatggacgccgcgaaaaaagccggatcaagcgtgctgatgtcaacgcatatcctggctacggcagagcgctactgtgacgcattcattattttacataacggcgaagtgcgggcaagcggcacactggaagaactgagagagcagttcggcatgaaagacgcagctcttgatgacttgtatattgaactgacgaaggaagacgccggccatgaataatatgtctactatttggcagtcccggcttgaagagcatataaaggaaaccagaatgtatatgaaatatatgctcaatgatcatctcgtcattgtgctgatcttttttattgccggcgcggcgagctggtacagcaagtgggtcaaagacatccccgttcattttccctctttttgggtgatggcggtgctcttttcatttgtgctgaccggttcatacgtccggacgctgttaaaggaagcggacctcgtgtttctgctgccgcttgaaccgaaaatggggacatactttaagcattcatttaagtacagctatctgtcacagctgtttccgcttattgctctgtctcttgtatgcatgcctctgtttttcgctgtaagtccgggggcgtcgcttgcgtcgtatgccgccgtatttattcagatgctggcggtaaaagcgtggaatcaggccatggagtggcggatgacgtttatgaatgacagaagcatgaaaatgatggatgcggtcatacgctttatctgcaatatgctgcttttatacttcgtcttacagtcgttttatgtgtacgctgccgccgtctacattgtgatggccggcctttatgtgtatttcacatcagccgcaaaacataaatcattaaaatgggaagctcatattgaatatgaattaagaaggaagcagcggttttacagaatcgccaatctgtttaccgatgtgcctcacctgaaaaaacaggcaaaacgccgggcgtatctcgactttttgctcagaatgattccgtttgagcagcggaaaacgttctcctatatgtatgcgcgggcctttctgcgttcaaatgattatctcggcattcaggtcaggctcacgattatttttatcctgattattatgctcgtttccgccaatccgtggatcacggcggcgttaaccgtatttaccgtctttattacgggaatacagcttcttccgctgttcgggcattttcatcatctttctctgcaggagctttacccggtcaatcagaaagcgaagctgcaaagtttcttttcgctgatgaaatcgtcattaaccgtgcaggcgctgctgttctgcgcagcgtcagcctatgccgcgggagtcagcggggtgctgtatgcggccgttgcttcagccgttctgatttttgtgatcatgccatcgtatatgggcggaagattgaaaaagtacggcaagctgtaatcaatcgggtttttgaaacctcaatgaaagaaggagacacagatgaccgacgatcagcagctggtacaggaagcactgcaatggaaagcgcgttttttgcgcaaagattccatgcttgaacgcttttctaaaggaatgcaggcgaaaataaatgagcggattcccgaaaaaattcatgccgtcatcacagaaagcattaaaaaaatgaccgaagcaacaatggcgggttcaaatctggtgaaaagcaagcgggatacaaacggtatgacgcttgctgaaaaagatgctctcgccagacaaaccatcgcatcgtaccaaaaggtcgcggcagctgaaggtatcggtacgggggccggcggaatttttttaggaatggctgattttcctttgctgctatccattaaaatgaaatgtctgttcgatcttgcctccatttacggctatgatgtgaaagacagggatgagcgattgtttttgctgtttatttttcagctggctttctcaagcggtgaacagcggaaacgcatatactcaatgattgaacagtgggattcgaaaaagcatgatgtcgattggagagtttttcagcaggaataccgcgattatctggacgtggtcaaattgtttcagcttttgccggtcgtcggagccgccgtgggcggagcggccaattataaactgctgtcacagctcggtgagacggcaaggcacgtttttcatttaagaattacaacagccggtacgtaatgtaccggctgttttttttatgtcagcgggggtagcttaccgcggcgccgataagcaccttggcggccgtcagcatcgctttttcattaaaatcaaatttcgggtggtgatgaggataaacggtttccgcattttctaaagcggcgcccgtaaagaaaaaagcgccttttgtatgctgcagataataggaaaaatcctctcccgccatctgcggctctccttcaacgactttcgtaacgccgtctgtttccgctgcggctgccgccgcgtgcgccgcttcctcaggatgattgacgacggcgggatagccgcgtttgaaacgatattcataggaagcggagtgcatggaacagattccttttacgacggcttctatttctgcttcgagcaggccgcgcacactttcgtcaaacgagcggacggtgcctgaaatgactgcctgatcggcaatcgcattaaacggattttcagcggtgaacgagcctgctgagatgacggccggctgcaccggatttacccgccggctgacgatatgctgaagagccgtgacgatttgtgagccgattaaaacggcgtccttcgtatcgtgagggatcgcaccgtgaccgcctttgccgatgactttaatcgtaaagccgtcagcggcggccattactgggcccgggcggcataagaccgttccgacgggttcagtcgcccataggtgtgtgccgaaaatggcatcgacatgttcgaggcagccgtcctcaatcattgcttttgctccgccgggagataattcctcagcgtgctggtggatcatcacaaatgaccctttcagtttttcccggttgcggtacagcacttttccggccgcgagcagagccgccgtatggccgtcatgcccgcaggcgtgcatgacgccgggaatttgtgaagcatagggcacatctttttcatcctgtatcggcaaagcgtcaaaatcagctctgagtgccacgaccggtcccggttcaccgccttcaatacaggctgtgacaccgttgcccccgacattcgtccggatggggacgccgagcttttcataaaatgaggcgatgaacgccggtgtttttttctccttaaaggatggctcgggattcatgtgaaggtgacgcctgatttcaaccatttcctcatacagcccgtcaagctgagcgtttaagcttttttgaagtgtcgttaacgtcaaaagcgatgccccctcgtctgcttttcccatgattgtatagaaaatgtcagaagatttcaatctttttgctacgggagaatgatgatggcggcgatggtcgtgacgataagtccggccgcaacagggataaagtttttcctggcaagctcaaacgggtcaactttacaaatagccgcagcgggaatcagtgcccaagggaccaatgttccgcccccgacccagatcgctgaaatctggcccagcgccgttaaaacggccgggtccgtatgaagcgcggcagaaaacagctttgccatcgagcctgcaagagatataccggaaaaccctgacccgtcgagcccggtaatcgcaccgactgcggccagggcgatgccggcgaattctccggacatcggaaaagaatgggacagggccagtccgaggtcattgacgattcccgcagaccctttcggcagcggggtgttcaaaatatttttaaaccccgcgtcaccgagataaaagaaggccgcgatcggaatgacggggccgaatactttaaagccgaattgaaaaccgccgataaaatactcggtgatcttttctaaatgccgctctttatatacaatgaaatgaatgatcaggagaatgccgatcgcggttcctccgacgagtgccgtcgcatcgtttccttggaggcggtatacgatcatgcagataatatcggcgagaaaaacaagcggaatgaaaaccgccaggatcaccctgagttttttcggcagatacatacttgtgtccaaagaaccggagctgtccaaggagaggggggccttcgttttttttcgatcccgcatgatgaggaagaaagcggtgattgtcgtcgttaaccccatgatcaaaacgagcggaatacttgcctgcatgacatcgctcactgggatgcccgcggcatcggccgttaatttcggggccgcctgaatgacgtaatcccccgataaagcgaatccgtggccgaacaggttcatcgccatagccgcagcgatcggagaaaggcccgcccggatcgctgcgggaagcagcacagcgccgatcagcgccaccccgggtgacggccagaaaaaaagagagatggcaaacatcagacagccgataacccaatacgcgacagccggccctttcatcagctttgcaaacggagaaatcatcgcttcattaataccggttttggtcaaaaggccgctcatcgccacgataaaacaaatgataaaaatcgtcggcagcaattctccggcggcatacgtaaagctgtgaaacaggctgctgaccgaagcggagaatgaatgcgtcgtccatagcgcaatcacaaaaatgccggcgagtgaaataaaggttgtatcttttctgagaagcataaaaacgataatggccgcgataaaagcaacataaagcagatgtaccgagtagacgccgatccccaattgaaccactccgtttataaataggattgctacagggtattcataggcgggcggaaggtgcaaagaaggatgcgtaaaatcgggacatcaaaaaagccggagaatctccggcggttttcagtctattgcgtaataagcggttacataagacggacgggaaaaaatagacgtcgtgtcgataccggcagatgttccgcgttttttatgagcttcctgataagagtttgactgctgccaatcctgaaaggctttttcctcttcccacagggtcaaaatgacatacgtatcgccttcgagcggtcttaatacgcggatggctttaaaaccgggttcattttccactttgccggcgcggtttttaaaccggttttcaaacagcggacggccttcctgggtaacggcgatgttgttgaggacggcgtagcccggatttttgatttccccgacgctgtcgatgctttcataggaatggggcgcctgaaaaacggtttctccatttgtttcatgaattaaaaccgcattatcctccccttgcatcagcaccatattctcactcgggtgtttcttggcaatcgtctttaaaaaatcggctgtcccgtatgtaatataaaccttcatatcagccacctcctgcttgctagtatatcaaaagagtggtataagtttctattggcgactcattctgacataattcgaaacaatatttcccatactacaagttaagaaaggcgaggtgacttatgctgaaaaagaaaaaaagattctttattccggctgtaattgcggcggcaaccgcttttctcgcgttaatcggatacattatcattatatttctcggccattatgtcatcgatgaaaagaaattaatactgcacgcatcttcaaaaatcgtcgatcaaaacggtgatgaaatcgcgagcctctatacggaaaatcgtgagccggtatccattcagcaggttccggaagatgtgagagatgcctttatcgccgttgaagataaacggttttacgaacatcacggcattgatgtgaagtctgtcggacgggcggtgttccgggatgttttagcaggcggcaaggtggagggcggaagcacgatcacccagcagctggcgaaaaacatttttctgactcatgataaaacatttttgcgcaagacgaaggaagtcattatcgccatcaatcttgagcgtgattacagcaaggacaagctgcttgaaatgtacctgaaccagctttatttcggccatggcgtttacggcattcaagccgcgtcccactactactttaataaagaagtaaaagatttaaccgttgcagaaggagccgttctggcagcgattccgaaggcgccatctctttattcgccgattcagcatccggataaaaataaagaacggcgcgatacgattcttgcaatgatgaacgatcaaggctatatcagcgccaaggaagccgtcagagcccagggccggacattggggcttaatgtcaagaaaacatcagaaacgccttggtttgacagttatatcgatcttgtcatcaaggaggcggaagaccgttattcgatgtcaggagaacagctgcttcaaggcggttatacgatccggacgtcacttgattccaagctgcagaaaacggcatataccctcatgaaggaaagcggctattttccggggacggatcaggcggcagagggaagcgccgtctttattgataataaaaccggaggcgtgcgcgcggcggtcggcgggcgcgactacgtgacaaaaggatacaacagggttacggcgaagcggcagccgggctcaacgtttaagccgattgccgtatacgggcccgccatgcaggaagacaagttcaaaccgtattcgcttctccaagacaaactgacgtcctacgacgggtatgaaccgaaaaattatgacggacagtacaagggggaagtgacgatgcaggatgcgatcacttacagcataaatgcgcccgctgtctggacattgaagcagatcggcgtggatatgggaaaatcgtatcttgagaaaaacggcatgaacatttctgacaacggactcgcgattgcgctgggcggtctgtctgaaggcgtcactccgcttcagcttgccggagcttatcatacctttgcggcaaacggaatgtatacgaagccattttttatagagaacatcacggacgaagacggagaaacgttatccgggcctaaaaacggcaaaacgcgcgtcttcagcggacagacggcatggaatatgacgagaatgcttcagcaggtcgtaaaagaaggaaccgcttcacaaggcagctatcaaggtgacctggcggggaaaaccggcacgaccacatttaccggcatccccggcgcgacaaaggacgcctggtttgcgggatacactcccggactgacaggagccgtctggatgggctatgacaaaacggataaaacccattatctgaaaggcggcagccaatacccggtcagactctttaaagatatcgtcacaaaagcgggggaaaacggccggacattcaaaaagcctgaaaatgtgaaggaactgggcagcccgattgagctggaggcggtaaaatccctgtcggcccgttatacatttaaggcgatgggactgattacggttcaattaaaatgggatattcaaaaggatgatcgggttgtttaccgaatatatgagaagaaagacggaaaagacaagcttctggattcggtgaaaggaaaaggcagctttgacataccgtacgccaatctgttttcaggggcttcatacaaagtcgttccatttaattcgcagacgaatcaagaaggagagggaacggaatacgttcagccgaagcttttttcttcttaatcatgaattcggcgattttttgaacattaagcctcaattctataccattcagaaaaaacaaggtatagtgtaatgggcgaagaacacgaacgtatggttgcaggaggaaaggtggaaattcagatgagtaaacgagaagcgtttaatgatacgtttttaaaagcggcacggggagaaaaaacaaatcacgtccctgtctggtacatgagacaggcggggaggtctcagccggaataccgcaagctgaaagaaaagtacggcttagtcgaaattacgcatcagcccgagctgtgcgcgtatgtgacgaggctcccggtcgagcagtacggagtggacgctgccattttatataaagatattatgacgcctcttccttatatcggagtggatgttgaaataaaaaacggaatcggcccggtgatcgatcagccggtgcgctctgctgcggatattgaaaagctcggcgaactgaatcccgaacaggatgttccttacgtgctggaaacgatccgattactcgtaaacgaacagctgaatgttccgctcatcggtttttcgggagcgccttttacgctggccagttatatgattgaaggcgggccttctaaaaattacaacaaaacaaaagcgtttatgcacagtatgccgcaagcgtggcaaatgctgatggacaagctcgcggacatgattatcgtttatgtaaaagcgcagattaatgccggcgcaaaagccattcagatttttgattcatgggtcggcgcgctgaaccgcgaagattaccggcagtttataaaaccggtgatggacagaatattccgggagctttcagcagagcaagttccgctgatcatgttcggcgtaggcgcaagccacctggccggggattggcatgaccttcctcttgatgtcgtcggtcttgattggagactcggcatagatgacgccagaaaacaaggcattacaaaaacggttcagggcaatcttgatccgtcgcttcttcttgcgccttgggaagtcatcgagaaaaaagcgaaagcgatacttgatcaaggcatgaaaacggacgggtttattttcaatttagggcacggcgtattccctgatgtcaatccggcaacgctgaaaaagctgacggcgtttgtacatgaatattccgcggccaaaaaaacggaacaatcttcctgagcagatcgttggttataagaagattttcctgtcaaaatcaaggtagacagaccatcaaaagaggtgtttaacaaaatgagcagcaaaaagaaaatgggacttctcgtcatggcttacggaacgccttacaaagaagaagacatagaacgttattatacacatatcagacgcggaagaaagccggagccgcacatgcttcaagacttaaaagacagatatgaagcgatcggaggcatttctccgctggcaaaaatcacgcaggagcaggcggagaagctcgcacagcgtttaaatgaaatccaggacgacgtaacattcaaagtgtacatcggattaaaacatattgaaccgtttattgaagacgcggtggcggacatgcataaagacggccttacagaagctgtcagccttgtgctcgcccctcatttttcaacattcagcgtccagtcatacaacaaacgcgcgaaagaagaagcggagaagctcggcggcttgaccatcaagtctgttgaaagctggtatgatgaaccgaaattcgttgattattgggtcggccaggtgaagaaaacgtatgaatcaatgccgaaagaagaacgggatgacgcgatgctgatcgtctcagcgcacagccttcctgaaaaaattaaagaatacggcgatccgtatcctgaccagctggaggaatccgcaaaactgattgccgaaggcgccggaattaccgattacgcagtcggctggcaaagcgaagggaacacccctgatccgtggctcgggccggatgtgcaggatctcacgcgcgagctgtatcaaaagcatccttataaagcatttgtatacgtgcccgcaggcttcgttgccgatcatttagaggtgctttacgataatgattatgaatgcaaagctgtgaccgaagaagtcggcgcaagctactatcgtccggccatgccgaacgcacagcctgaatttatcgacgcgcttgcagcggtcgtgctgaaagagctggacaagtagaattaaacggtaaagaaggcgataaaaatgagtggcgataaaaaacatctggtcatcatcggcggcggcataacgggactagccgccgccttctacatggaaaaagaaatcaaggaaaaacagctgccgcttgaggtcaccctgatcgaagcgggcccgagagcgggcggcaaaattcagacggcgcataaagacggctacatcattgagcgggggccggattcttttttagaaaggaaaaaaagcgcgccgcagctcgttaaggatttggggcttgagcatctgctcgtcaacaatgcgaccggccagtcttacgtgctcgtcaatgagacgcttcatccgatgccgaagggcgcggtgatgggcattccgaccaaaatcgctccgttcatctccaccggtttattttctgtacccggaaaagcgcgggcggcgcttgactttgtcctgcctgcgagcaaaccgaaggaagatcagtctctgggtgaatttttccgcagacgcgtcggtgacgaagtcgttgagaatttaatagaaccgctattatcagggatttatgccggagatattgataagctgagcctcatgtccacgtttccgcaattctatcagactgagcaaaagcacagaagcctgattctcggtatgaaaaaatcacgtccgcagccttcgggacagcagctgacggccaaaaagcagggccagtttttaacggtgacgacaggacttcaaacgttggtggaggagctggaaaagcagcttacgctgacaaaggtgatgaaaggaacgaaagtcacccatatcggccgcgaggagaaaggatattccgtgacgcttgataatggcaaagtgctctatgcggaaggatgcatagtgacagcccgcataaagccgcggcgaaaatgctttctgatctgccggcggtttcatgtctcaaagatatgcattctacgtccgttgccaacgtcgccttaggttttcctgagggagccgtcaaaatggagcatgaaggtacgggattcgttatctcaagaaacagcgatttctccatcacggcctgcacatggacgaataaaaaatggccgcacgcggcgccggagggcaaaacacttctcagggcgtacgtcggaaaggccggagatgaatccatcgtagatctttcagataacgagatcattaaaatcgtaatggaagatttgaaaaaagtaatgaaaataaatggcgaaccggaaatgacctgtgtgacccgctggaacgaaagcatgccgcaataccatgtcggccataaggagcgcatcaaagagttcagagatgcgctgaaagcttcctatccgggcgtatacgcgacgggcgcgtctttcgaaggggtgggcatccccgactgtatcgaccagggaaaagccgccgtatatgattcactcgcttatttatttgaaacgtaccagcctccgttatcgtaaaacggaggttttttgcatgttcccgttctgtaaagggaacaccaataaagagaaaaaacatttgaatcttctttgcgactgtgataagttatcttatgtacaaaatgactaaaacgttcaaacggtcaatttaacgaggtgggaaacatgtccgtcgatcggaaaaagctcattctggaagcggcaacgaagtcttttacacaattcggctacaaagcaacgacaatggatctggtggcaaagcttgcaaatgtggggaagggaaccatctacacgtttttcaaaaacaaagaagaactgtttgatgatattttcaccactattttaagagaaatgaaggaacacgcagacgaagcgatgaaaccggagctttcatttcacgaaaatgttcaccgggcgcttgtcgcgattttggaattcagaaaaacacaccagctgactattaaaatttttcaggagaacgccgagattggtacaatagccgttcaggatgtcattgcgaaaatggagcgggccattctgtcatacattaaagaaaagatagaaacagccattgaaaacggaagcattaaaccgtgtgatccggaactgaccgcttttgtgatgctcaagctctacatcgcgctgatatttgactgggaaaaaaaccatccgcctcttgaaaaagagacgatcgccgaattgctggaaatgtatgttggtcaaggattatctaaataatagatgatccttcactttttaggtgccgtgaccgttttgtcaaatgagtcagtttgcggaaggaggcaacagggttgaatacaataaaaagccagtggaaagacattgtaacgaacaagaaactgttaatccccatcattgccatattattcgttccgctgatctacagcggagtgtttttgaaggcgtactgggacccgtacggcacggtggatcagctgccggttgtcgttgtcaaccaggataaaggggcggactacgaagggaaacatcttcagatcggtgacgatcttgtgaaagagttaaagaaaaatgataattttgattggcatttttcaaacgatcttgatcaatcgttaaaggacttattaaatgctaaatattatttattggtcgagattcctgaagatttttctaaaaacgccagcacggtaatggataaaaatccgaagaagctggatctgaaatatcatacgaatgccggatcaaactatgtcggcgcgacaatcggcgaaaaggcgatcgacaagctgaaagcctccgtgtcgaaagaagtgacggagcaatacgcaaaagtcatttttgacaattttaaagatattgccaaaggactcggcaaagccagcagcggcgccaagaaaatagacgacggcacgaaaaacgcgaaagacggcagcgccaagctgaaggaaaatttagcgaagcttactgaaagcaccgccaccatcggcgataaaacgcagcagcttgcagacggagcggcgaaagtgacaagcggaattcaaacgcttgacagctctatcgcaaaacttcagagcgcaagcgccgaaattcaagataaatcagggcagattgcttcaggaggaggccaagtggccagcgggctgaaaacgagccttgacgcacaaaagcagctccagcaaaagcttccggatttaacgaatggattaagcgcgttaaacagcaaggcgcaggaagtgtcgcaaaaagcggcggcatttgaagatgcgatcaattcagtcaacctctcagatattgaaaaagcggttggggagcttgagcagactgaaaaggaattgcagcagtttaagaaaaagctttctgatctgaaaaacagcctggatgcccgggatgacgcggtcaaaaaggtgattaaggacagtgatttcttaacggatgagcaaaaagcgaaacttgttcagcttctgaatgagaagcttccgaaggccgaccttccggatttagacaatatcgtcagccagcttccgtccggcggagatatccagcttccggatatgtcagtcataaaaagcgcgctggcagatgtaaaagcgaaggctgatcagctgaaagcactgcctcagtccacatcgaaactgtataacggcgcggcggcggtacaagacgcgattaaccagctgacggctggaactgataaattgtacagcggagcgcagaccgtctttgaaagccaaaacaaattgacggccggtatcggcgaatacaacagcaagttcggacagctcaaatcaggatcagaagcgttagtgtcagggagcggccaggtgtctggcggcttaacgaaactgctggacgcgcaaaacaaaatccatgacggctcgtccaaaattgagcagggtcaagcgtctctcggcaccggtttaagcaagcttttagacggcaccggacaattgtccagccagctgaaagatgcggctgatcaaaccggggacattaagacagatgacaaaacgtacagcatgtttgccgatccggtaaaaacggacgataacgcgattcattccgtgcctaactacggtaccggactgacgccttatattctctctatgggcttgtatgtcggcggattgatgctgacggtcgtattccctctgagtgaagcttcagggcgtccgagaaacggttttgaatggttcctcagcaaattcagcgtcattctgctcgtcggactgattcaatccgttatagtcgccacggttctgttaaaaggaatcgggcttgatgtggaaagcacttggagattctatctctttacgatgattaccagcatcgcgttcctgtcgatgattcaattattggcgacaacgatgggaaatccgggacgctttatcgctgtcatcattctggtgctccagcttggggcaagcggaggaaccttcccgcttgaactcctgccgggattctatcaagtgattcacggggcactgccgatgacttacagcatcaacgggttccgtgccgtcatttcaaatggcgattacggctatatgtggcagcaggcatccattctgttgggcatcgccgttgtcatgatcgcgctgaccatcgtgtattttacggtgcaaagcaaaaaagaacacaaaacggaagaagaaataacagcataagaaaaagaggcgctgagcagatgctcagggcctcttttttttgatttcgattaaaatccccatctcaccaaaagtccggtatacgtcaatccgccgccgaatccgaacaataccagcgtctggccttccgacagtttttttgctttcacagcttcatccaaagcgagaataatagaaaccgatgaagtgttgccgtaatattcaacgcttgtcaatgtccgttcaagcgggaagggcagtttttcacagatggattcgatcatccgcatgttggcgctgtgaggaacgaaccaatccagatcgtcttttgaaaagccggctttttctaaaagggcattgcattcctcaggcacggttctggccgcccatttatatacttcgcgcccgttttgcaccatatttcctccgcctttaagcggctcgccgtttaattctgcgctcagtcccgtgcgatacagcacgtccgcgcttcctcccgctgttccttgcacggctgccaaaaagcccggcgctgattcgtcgcgttccaccaatagggcgcctgcagcatctccgaaaagaacgcaggtcgtccggtcagtataatccgttacctttgataatgtttcaccggcaatgacaatcactttttgatgggaaccggcggtaattaatgcgtctgcgagctgaaggccgtaagtgagtccggcgcatgtggcgttaatatcaagcgctcccgtgtgcggccagccgaagtaagcctgcacgcgtgccgcggtgcttggaaacgcatagtccgccgtcgttgtggcgacaagaatcatatcgacatcatcaagagttccgctgtatcgttctgcaaggtttttcaccgcttccacacacaaatccgatgtgaattcatgttcgccggcaatgcgtctttccttcataccggtgcgctggacgatccattcatcagatgtatcgacgatgcgctctaaatccgcgtttgttaatcggcgtgccggagcatatgtaccgattgctgtaattttagattttgacatgaaaaaatcactcctttatatcagattataacacctgatattattacttggtactaattttaataaaaaaacccaagcagcatccgctgtttggggagcatgagaattttatttgtaaaacgggcttgtgtgaacgattaccaatgacggcagcagcggcggcatgaatgatgatgcttctttttgtctttcttctttttgtctttcttctttttacaagggtcttcttttttctttttacagtgatctttttcttttttacagcaccagaaggctgcaccagaccaatcatcctcaaaccaatcctcaaaccaatcattatgaaaccttttccgcttgtgcggtttacggctgatcatacatttccctcctatgctcatgctcccttcattctatgaaaaaagagcaggaaaagattggacgggttatggatcaaaagagtatattttaagaagaataaaattgataggaggaatgacctgtggaaaatatgaaacatacgatggaactgattaaagaactggtgtcgattccgagtccgacgggcaatacatacgaggttgtcgcctatacagaaagtcttttaaaagaatggggcgtctcctcttacagaaaccgcaaaggcggtctttttgtcacaattcccggccgtgatgacaagaaacacagattgctgacggcgcatgtcgatacgctcggcgcgatggtaaaggaaataaagtcggacggccggctgaagattgacttgatcggcggcttccgatatcactcgattgaaggggaatattgcgagatccaaacttcttccggcaaaacctatacaggcaccatcttaatgcatcagacttcagtgcacgtctacaaggacgccggcaaggcagagcggaatcaggagaatatggaagtccgccttgatgagcctgtccggacgaaggaagagacgtccgatctcggcatcagggtcggcgatttcatctcatttgacccgcgcgtgcagattacgccgagcggctttattaagtcccggcatcttgatgacaaagcgagcgtggctctgctcttgaatttaatccgccgcatcacggaagagaaaatcgaacttccgtatacgacgcattttctgatttctaataatgaagaaatcggctacggcggcaattccaacattcctcctgagaccgtcgaatacttggctgttgatatgggagcgatcggcgacggccagtctacggatgaatataccgtctccatttgcgtgaaggatgcgagcggaccgtaccattatcagctcagaaaacatctggccgggcttgcggagcgctatggcattgattatcagcttgatatttatccgtattacggttctgatgcctcagcagccatccgttcgggccatgacatcgttcacgggctgatcggcccgggaattgacgcttcacacgcttttgaacgcacgcatgaattatcgcttcttaatacggcgaagcttttgcaccggtacgttctatcgccgatggcataaaaaaccctgcgcggaaatcattccgtgcagggttttcattttaacctgaaatggttgtgttttgttctgttttggcgaggctcatgaccttcgcgcctttaacgggatcatactggccttcccattttgacatcacaacggatgccagcgcgtttccggtcagattgacgaccgtgcgggccatgtccataatccggtcaacaccggcgatgaatgcaaggccttctgcaggaatgttgaatgcgcctaatgtcgcaagcaggacgacgaaagaagtcccgggcacggcagccattcctttggaagtgaccatcaagacaagcacaagggtaatctgctgccaaatggacaagtcaatgtggtatacctgagcgaggaataaagcggcgatagattggtacagcacagatccgtctaagttaaaggtatatccgatcggcacaacaaaggaaacaatacctttcggacagccgatcttctccattttttccataacgcgggggagtacggtttcggagcttgacgtactgaacgctaataaaatttcatccttcatataggcgaggaatttgaaaatgtttactccggcaagctttccgacgattccgaatacaacaatgagaaagaaagccaaagctacatacactaaaccgaccagtttaccgagtgaaagcagggaactgagcccaaatttggaaacggtaacaccaatcaacgcaaaaacaccaaacggcgcaactttcatgacgaggttcacaacatggaacatcgcatgagaaacaccttcaaagaaggccaagacaggctttcctttttcaccgattgccgagatgccgagtgcaaacagcacggtaaagcagatgatggcaagcagatctccttcggctaatgattggaagaagtttgtcggtacgatatgcaggaatgtgtctgcgatagatttgttattttgttctttttctgtttcaacatattgactgatatctgtcttttgagcttcatgtatattaacgcctgttcccggatgaaacagattcgccaaagccagcccgagaataatggcaaaagtggtaatgatctcaaaatacaaaatcgttttgaagcctaattttccgacttgttttccgcttcccgcgccggcaacgccgatgattaagctggagacgacaattggaatcactatcattttgattaagcgtaaaaacaaatcgccgataggctgtaaatatgttggaatggcgggattgccgtaccagatgacaccgactacaaccctagtatgagtccgacgaaaatttgcgtcgctagtccaaagcgtaattttttcatagattacctcccgaagaaaaaagtgcaataagtatctaaaaagatagctattagaacaaattataatagaaaagaaaacaatccgtctatagaaaaatatagattgaaaatactgaatcttttaaaacgtacagataattgctaataatggtgaataacgccctattcagaaagtatgatgacggccgaaaaaacgggcgccgcacaacttagaattgtgcggcgccctattgtcacatatccttaattttcaagcagtcattgcacagattaatgtgacactcatactgctcaacaatctcatttccgcattcttcgcatttcttaccgggtaaatttctgaaaaaatccgacatcttttccaacatacccatccctctttcattgttttgtctctacattgtattataacagttttggaaaatcaacggctgttttggcacaatgtttaaaacatgcaatttgtacgaaaaataggtatattggaggaaaggatctttttatcataaacattcggagggtcatatgaaagttacagttattggatgctgcggcgggtttccggccgcaaacgaagcaacttcaggctatctgtttcagtccggcggctattctctgctcgtcgattgcggaagcgccgtattatcaaagctgtttgcctatgttccggcagaagagcttgatgccgtcattttgtcccattatcaccatgatcacatcgctgatatcgggccgcttcaatttgccaaacaggtcggctcctttctcggaaaagggacgcatgcactgccgatttacgggcatgatgctgatatagaacagtttgagcgtcttacatataaaacgcatacgaaaggagtggcctatcagccggaccgcccgctttctgccgggccgttcaccattaccttcctgaaaacggtgcatccggtcacttgttatgcgatgcggattactgacggttcagcttctgttgtgtatacggctgattcaagctaccaggacgcgtttatcccgtttgcggaaaatgccgatctgctgatctgcgagtgcaatttttacgcggaccaggacggcacgtcagccggccatatgaacagtttggaagccggacgtatcgcggaggaggccggagcgggggagctgattctcacacatctgcctcatttcggcgagcaccggaagctgaaagaagaagcggaatccgtgttcgggggcgaagtgacaatcgccgcttccggattgaagtgggagaaataaaggaggagcaccatgttatttatcgacaaccaaaacataaccgacccgaggatcaacctcgcaatcgaggaatattgcgtgaagcatctcgaccctgaacagacatacctgctgttttatgtcaatcagccgtcgattatcatcgggaagaaccaaaacacaatagaagaaatcaatacgaaatacgtagaagataacggaatcatcgtcgtccgcaggctgtcaggaggcggcgcggtttaccatgacctcgggaatctgaatttcagttttatcaccaaggatgacggcgacagcttccacaattttaaaaaattcaccgaacccgttattcaggcgctgcgccagctcggtgtggaagctgaattaagcggccgaaacgacatcgtcgcggacggcagaaaaatttccggcaacgctcaattttcgacgaaagggcgtattttcagccacggaacattaatgctggattccgccattgatcatgtcgtgtcagccttaaaagtgaaaaaagacaaaattgaatcaaaaggcattaagtcaatcagaagccgtgtcgccaacatcagcgagtttcttgatgacaaaatgacggcggacgaattcaaaaaacatctgcttcaccatatttttaatacaaatgatctttccgaagtgccggaatataaactgaccgatgaagactggaaagcgatccggaagatttccgaagagcgctatcaaaactgggactggaatttcggaaggtcgcccgcattcaaccttcagcattcgaaacgttatccggtcggatcgattgatctgcgtcttgaagtgaaaaaaggaatcattcaggactgcaaaattttcggtgatttcttcggtgcgaaagatgtgagtgaagtcgaacaggcgctgaccggaaaacagtatgacagaaccgctatcagggaggcgctggccggaatcgatctgaaacagtatttcggcaaaatagagctggaagatttcctcgagctgatttattagaacatttgccgaacgcatgatttgaatctgcgcccgtttttgtgaaatgatagaaccataatgaatggggagggatcatgatgaaagtatttctcatcggagcaaacgggcagatcggacagcgtctgaccgggctgtttcaaaaagacggcacgcatacgctgcgggcgatggtccggaaagaagagcagaaagaagcgcttcaagccgcgggaacagaagccgttcttgcagatttggaaggaagcacggaagacatcgcgaaagccgctgaaggctgtgacgcgattgtgtttaccgccggatcaggaggaagcaccggatacgataagacgcttctgattgatcttgacggagcggcgaaagcgatagaagcggcaaagaaggccggcatcaagcggttcattatggtaagcgcccttcaggctcataaccgcgacaattggaatgaagcgctgaagccgtattatgccgcaaagcattatgcggataaaattcttgaagcgagcggtctgacgtatacgattatccggccgggcgggttattaaatgatcccggcacgggaaatatcaaagccgcagccgatttagaaagaggctccatttcaagagacgatgtcgccaagaccgttatcgcatcccttgatgaaccgaatacgtatgaaaaagcgttcgatctgacagcgggcggcacgccggtcagtgaagcgctgaaacaattatagtttccggttttacggcactcggggctttttgcccttgagtgtttttctatatttttctataataaaagtgaacgtttattccggataaatgaatgactattcattcattatatttttaaaggggtgggaaaatgaatctggtttccaaattggaagaaacggcatcgcagaaaccggaaaaaccagcttgtctgtttcaagatcagtacatgacgtatgaggagctggcaggtaaaatcaaagcatttgcaaacggcttggaggacaggggactgaaaaaaggggatcatctcgcgctgctgctcggaaatacgcctgattttgttattgcgtttttcggcgcgttaaaagcgggaattgtcgtcatacctgttaatccggcatacacaccttcagaaatcgcatacatgctgaaaaacggcgatgtcaaagcgatcgccggcatcgacctattaattcccgtatttgaaagcctgcacggctcgctgccgctgctggagcatatcattatcagccagacagcagagaacgctccatcgacagaagaccctcaattgcgcttaaaaatgacaacgtttacaaaaatgctccgcccggcggagcgcagcagaacttatccgacattgtccaaagacgatactgccgtcattttatacacctcagggacgaccggaaaaccgaaaggcgccatgctcacccatcagaatcttttctccaatgcaaatgatgtcgccggatacttaggaatgaatgagaaagacaaaattgtggcggcattgccgatgtttcacgttttttgtttaaccgtttgtatgaatgcgcctctgatgagcggagcgtgtgtcttaatcgagccgcaattcagcccggcttctgtgtttaaactgattaaaagccgtcaggcaaccatttttgccggcgttccgacgatgtataactatctgtatcaatacgagcacggcaaggcggaggattttgcgtccgtcagactgtgcatttcaggcggggcctccatgccggtcgctctgttgcagacgtttgaacaaacctttgacgtcaccattctggagggatacggactttctgaagcgtctccggttacttgttttaatccgtttgaccgggggagaaagcccggctcgatcgggacgaatattttacatgtcgaaaataaagtcgtcgatacgctcggacgcgaattgcccgaccatcaagtgggagaattgatcgtgaaagggccgaatgtgatgaaaggctattacaagatgcccgaggagacggagcacgcgctgaaagacggctggctgtacacgggtgatttggcgaagcgcgacgaagacggttatttttatatcgtcgacagaaaaaaagatatgattctcgtcggcggatacaatgtctatccgcgcgaagtagaagaagtgctctacagccatgagggcattaaagaagccgtggtcatcggcgttcctgacgccaaaacgggggaagcggtgcatgcttatatagtgcctgcggacggtgagctgacagagcaggcggttttcgattactgtgaaacacatttggcaaaatataagcggccggcggaagtggtttttcttgatgagattccgaagaacgcgaccgggaagctgctgagaagggcggtccgggacatgcttccgaaatgacggacgaaaagcgaagccgggggcttcgcttttacatgctgatccggtcagctgtgcgattcttccttaatgatgctttgcacaagcttcgtatcatgccgggtcagtttgtaatacgtgtttttatgcttgtacatcatataattgccgctttcgagccacatactgaatgaatcaaaacggtcttcatggtatttgaccgttccgtcgtaatcgggagacacgcttttggtcagtttgacttgttttccttggttcaagatatcgagcatatcttttacattctgcctgtctttaattttgatttctttttttccgttctctgacagaataatcagatctgcgttgcttgatggaaacacatcgccggtccggctgtatacatagaagaaagcaataaccaaaagggcgattactacaataaacgcgattatttttttcatattcatcactccgtcttttagtctttcccgcttcctgttgttccattcttttctgttgtgaaaagattaacatccgtttcggaggcttggttctatttatttgcatttatgcttacaataggagtaagtcataaggctaaggagggagacttccatgcgcaaatggatagcggcagcgggacttgcctatgtgctgtacggcctttttttctattggtatttctttatgacaggagactccgccgtcccggaggccgtaaagggaacgaaagccgatccgtcctcgttcatggacccgggccgcctggcagccgctgaaaacttttcaaatgtaaaggattttttatttttcatcggagcgccgttagattggtttttattttttctgctgctcattacggggcttgcaaaaaaaataaagcattggctggaagcagcggtgcgctttcgggtgctgcaaatcgtaagcttcgtatttgtgatttcactcatcgttacggcggcttcgcttccgcttgagtggatcggatatcgggtttcgcttgcgtatcatatttcgacgcagacagcagcaagctggataagagaccatgtcattgatttctggatcagttttccgctgtttgccgtgtgtgtgcttgtgttttactggctgatcacaaagcatacaaaaaaatggtggttttacgcttggtgtcttactgtgccgtttaccctgtttttgtttttcctgcagccggtcgtgattgatcctttatacaatgatttctatccgctgaaagacaaggagctggaaagcaaaattttgtcgcttgccgacaaggccgacattccggccagccatgtgtatgaagtaaatatgtcggagaaaacgaatgcgctgaatgcgtatgtgacgggcatcggttcgaataagcggatcgttttgtgggatacgacgcttaacaaactgaaggatcgggaaattttgttcattatggggcatgagatggggcactatgtgatgaagcacgtgtacatcggactggccgggtatctgctgctgtcattagccgggttttatatcattgacaagctttataagcggctgtccaaattcttcggccgaatgcttcatataaaggggcctgaagatctggccgccctcccgctgttattgctgctcatatccgttctcagttttgcttctgatccgattacgaacgccgtctcccggtatcaggaaaacgccgccgaccgttacggcatcgagctgaccggaaaccgggaagcggcgattgagacgtttcaggacttggccgatacgggactgagccgggtcaacccgccgtttctcgtcaaaattttcagagggagccacccgtcgatcatggagcggattgaacatgcggaggaagaaaaataataaaaaaaccggcggggccatggccgacgccggttttttatgttttactgagctgccgcctgtacgttgatcagcccttttccatagtagaaagcatcaccaagttttgtagtggtgttttctaaactgctgcggacttgagtgtttgtccagttcgggtgcttagaaagaatcaaagcagccgctccggcaacgtgcggagatgccattgacgtaccattgtacgctccgtatttgtttccaggaagcgtgctttggatagagacgcctggtgccatgacatcaagctcagaacctacgcttgagaaagatgctctttggttgctgctgttaacagcgcctaccgcaatgacagaagggtatttaccagggtagcccactgtgcttgagccgccggaagtgccttcgttaccggctgccgcaaccactacgacgccggaagcaacggctttgtcaactgccgcttttaacgctgcagaaccagaaggtccgccgaggctcatgttaataacgtccatattgtttgcgatcgcccactcaattccgttaatgatccagctgtactggccggaaccgtcagcgccgagaacttttacagcgtaaagagatgcgcttggcgcaacgcctaatacaccgactgagttattaagagctgcaactgtaccggcaacgtgagttccgtgagagttgttatcttggaaaggatttgtttcagaaggaaccatgctggctccgcctgctacctttaaatcaggatgagaagaatcgataccgctgtcgataaccgctactttaacatttgatccggtgaagccttgagagtgcagtgcaggggctttaatctgtgatacgccgtaaggcacggactgcgcgtacgcctgtgcaacgtgatcttcttcaacgtaagcgacgctagggtcttttttcagctcttttacagctttttcatttaatgtagctgaagctgcgtctacatatttgaattgcttttccactttcccgcctttttcagaaatgacatcttttttcttggcggcgctcatcgtgctcattgtctgcttaaatccgacaatatatttcttttccccgtttgatttccctgcagcctgggcagaagtcgtgctgccgaacgccatcgtaaagattaacgctaaagcaaacagcaaactgatccatacctttttgcctctcactctttatccactccttttttcatttgcagaataaccaatagacagattattctgtggattaattgtatagtatggaataatattttagtagacccaatttttttcagtttgttttatttctatttaggtatatcatctctctttcgtttaataggaacccgaaatatttaaattttaatggaaaaaaccgatggaaggacatgagtatttgtacacagccgcaatcgctctcttgtttactgggtcgaacggtttgattccatttttggaagctgaggcaaaaacaggataaatgtcaccttttgttgaatgcagaagtctgatggaaacgaaagcggaatgaaataaagcggccggcatgaatcagtctttgactttcttgagggagaaaagctgtgaaaccattttataaaaataatgataatgaatatcattgatacttatattgtcaatgatataattgcggaaaaacgaaagagcgggaacagatgaaaccaattttcagtatgctgatgatcttatccgttctcttcataacggcatgctcagaacaggaacatgaaaccgccgtcaggcatgatctggggacggcgcatgtggctgcgcacccgcagcgcatcgccgtattgaatgagggctttattgacaccctccatgatctcggtataaagccggcggccgcggcggataaccggaaagagcgaaacgacggcagtccgtccgtcgggcccccgtcacatcccgatttgaaaaaaatcacttcgttaaaacccgatctcatcattgcagactcaagcctgcacagggggatataccatgagctgacaaagatcgctccgacaatcgctttgaaaaatgaagctgcggattatcaggatgcggttgatgctgcccttaccattgaaaaggcggtcggtaaagagggcatcatagagaaacaattgtcggctcaggaagaaaagctgaatgacatcaaaagaaagctggatgcagaaggcggcacgattttattaattgacgctgcaaatggcagcatttccgtaaaggatgaccggtttttcacatcccggcttttgacgctcgcagggtttacatatgcggtccagacggattccggcgggaaatcagacgctatcaaaatgaggcccgggcagcttttgcatatcgatcctgattacatcgtactattggacggtgaggaagaactcgaaaaaaatcacctctggaaacagctgactgccgtaaaaaacggacacgtttaccgcgcggacagggcggtatggacggagcgccggagcattgacggtgcggacgccgtattacatgatcttcagaaaaaaatgctcgccaaaaaggcccaaaactaattcgggcctttttgttatgattctgataggtggctgcttacattgtaatctttgacgcgccacttattttcaattcgttcgatattgctcaggcacgcattgacaagctttgcgttttgtatgccggtatcaccgtcagaaatagcggacaagagggcgtgaatagctgcgccgtgagcgacgatcagtactttttgatcaggaaaccgctcctgaactttcactaaaccggcaagcattctgtctgtcagctcttctgcggtctccatgttcgggtagtttttatccgggtagcgcttcgaccgttccggcaaagacattccttccgcatcaccgtagctccgttctctgaaatcttccatgacgacaatgggaagattcaaaaacccgttaataatgtcagctgtttttctggcccgtttcatcgggctcgagacgatgacatcccattcggacccctttaagtactctcctgtttctttcgcctgacgctctcccgtcgcatttaacggaatatccgatttgccttgaagcttcttttgggcattccaatcagtctctccatgtcttactaaacaaacggcagtcataaagtctccactccgatcattttttatcgatatcatctattatactgccgttacgttaacacttcaaagagaagcgccagtccgactccgcctccgctgccgatcgctgctgctgcgtagcgggcatccgggcgtctttttgcttcataaaaaagccgggtgataagcgccgctccggaagccccgtacggatgcccgacggccagagcgccgccccggacatttattttagaatacggcacttgaagctgctgtgaaaaaacgcatattttgacggcaaacgcctcgttgatttcgtatatatcaatatcatccggtgacaggtcccgttccttcaaaagctttttgacggcataaaccggagctgctgacggataatgcggatggacgccgcttaccgcgcttccgataaaacgcaatcccggctttaaaccgagagaccgcgctttttgttcttccatcacacaaactgccgccgccccgtcagaaattccgcagctgttggccgcggtgacagagcctccggactgaaagacgggtttggcgcgggcgatgagaggccccatgttccgctttttcagcatgttttcgtcagcggcgaatccgtgacaggggagaatttcccggcggtacaagccgtcttcgtgcgctttgacgctccgttcatagctgagaagggcatattcatcctgcatctttctcgttacgccgtaagcctgtgccgtatactcggccgctatgcccatatcaggatcgccgatgtgttcaggagaaaagcgcgcccgggatgagaaaggggaacggctgctgctctccgctcctcccgcgatgtatgtgctccccgcgccggctttaacaaagtggcacgcgaccctcacggcgtccaatccggaaccgcactgcctgtcgatggtcgtaccggacacgctcaaaggaagcccggcggccaaggctgacagccgggcgaggttcccgccgcggcccgtcgcgtttccgatcaggacttcatcaatgtcttcgggcatgttccggctcaaatgtcggatcagcggagctgccaaatcttcggggagacagtcttttaacaggccgttttcccgggcgaaaatcgtccgcttcgcatccgtaattacagcttccattccatcatgtcctttgcctgcttttgtacggcggcacgggcgatctttccgccggctgtttccggtatttctgaaaacagccattttttcgggattttatatgccgccagctgctcgcggcactgtttcttcagttcctttacatttgcatgtccgtcgatcaccgcaacggcgatgctgccccaataatcatcaggaatgccgatgacggccgcttttctgacgcccggacagcggttgagcacacgttctatctcttccgggaatacattcaggccgcctgatacgatcatcccgttttcacgtccttcgatataaagatagccttcacgatcgatatatcccatgtcatcaaccgtcatccagccggaatcatcaggttttgcgccgttgatgtatccggaaaatttcatcgggctgttcacaaaaatcttccccgtttcgcccggcatgcagcgttccccgccgggccggcggatttcgattgtaacattttcaaacggacggcccgccgcgtcaggcttccgggcgctgtcttcaggcgataagaacgccacgaaactcagctcagacgttccgtaaaaatcgtacaaccgtaaatggggatagcgctctgacagcgcttgtttagacgaagcgggccagtctgcaccggaagaaatcaccttgagcggtgtatccggaaacgcctctagtgagagcagggcgtccgtcattgtcggaacggtatatagaacgtcagcttgtctgagccggtctttcattccggccggattgaattttctttgaaggaggacggttccgccgataaacaaagtgctgacggcgccgtataaaaagtgtgacgagcgaagcgtgcccggtaccagcactttgtcatcaggggaaatgccgaattcacgtttcgtacaagaaaagctctccagccacgaacggtgagagcgggtgaaggctttcggcttaccggtcgatcccgaggtgaatccggtataaaagggcaggccggtgtttttgataaaagtgccttccgttttttccgcctcgatcaaaggcccgcattcatcccacaggatgacaggcgttttgatgccgtccagtctgccgctcagccggcggtcacagatgacgaggtcggttttgctgatgtgcagctggtccgcgagttccgccgcagccgagcggggatctaacggaaccgccgtgcagccggcatgcgccgcccctgcgaaaagttgtaaaaatgggatgccgttcggcagtaatattgcaatgttttccggcttatctgaaaggctgccaagccagtttgcggtttggtttactagcctgttccaagtttgataggtgatctgttctgtgtctgtctgaattgcgatccgttccggcgcttgtccggctgtatctgaatatgatgatgtaatcatgatgactaaaatcagcttcctttcgtcggcaaaagccggcttgcttgaagagtttttctgattcttacggctgcgaatgaggctgcggccgctttaagcagatctccgggcacatagatgaggctgagctttacggcagtcaagatatcaatgtgcattataaaagcctgaacgggaatgccgatgacatacaaaaacagcacgccgaacaagaactgtctgataaacaaatgggggacagcagctgagcgaaggccttggatgctgaggctcagcagtaatgccgccagcggatatgcgatgagatatccggcgctcggcccgaaaaaaaccccgaacccgcctcttccgcctgaaaggagaggcgctccgcatgccacaatcagcaaaaaaagcaattggcttaaaaatgccgctttcggtttaaggatgcttcctgataagagcacaccgatcgtctggagcgtaatcggaaccggcgtaaaggataagaaaagcggcggaagcagccccaaaagtcccataatggcggtaaacacggcaatatgcatcatttctgtcaatttcattatgtattcctccagcttatcaaaatatgtttatacaataaagcgagtctttatatatgtcaactctattatattttaagttaacattaaaaagaccggccctttatgaaaaaggccggtcggtttatctttattcttctgtaaggataacaagtgaatcaacggatgatgcaacgtgggaaacggcgcggctgacttcttgaaggccgccgagaaaggcctgcaaatcaacgtcgattttgcctgtctggtctttgctcgttttcatgctttggacgatgtcatcaaacagacggttgatctgcgtcattttttctttcgtttcgcttacaagtccgtttacatctttaatatgtttggacacgatgttgatttgtgtattggtattgttcacgagctctgatacggtggaaacggtttttttcgtatcctctgaaagcttccttacctccgtcgcgacaacggcgaaccctttgccgtgctctccggctctggcggattctattgaagcgttgagtgacaggagattcgtttgctcggcgatccccgtcacgatgccgaagattttttcgatctgctgggcgatgtcattcagcttgtccatttcttcttcaatctgcagaaggctggcgtcgattttattcatctgctgctgctggctttcaagctcttttttcccgccgattgatttttcttcgacatgtacggaagtgacggtgccggcttttgacgcctcggaaatgccctcagatttatcgaccagctcctgcacggctctgctcgtttctgaaaacaaatcagcgagtgatccggatgtttcctggattttctgatgaagacgggctttcttttcctcttgttcgtcacgctggcagttatattcagtctggaatgcttcaaggacgagctgctgttcaagattcaatattttcgtcgtcgctttgatcgcttttaaaagctcatgcaaatccggaatggttgcttcatatatgttcatcatcgacagaagcagatcctgaaacgctcccatataccatttcggttcaaggccgatccgcaagtggatggaagcgatgcgctgtcttttttcaatgaattcatcatcaattgtgccggcgaacatctcatggatatgacgccgtaatgtttttttcaggcgctcgaccgtgctgtggtcgttaatgatcgtcattaatgatttttcgtgatccaggtttcggtaaaaggaatcgacgattgttgagatatgttctttaattaacggctgcagctcttcaagcacatgaagttcttcgtttccgagcctgaccattttcagctgtttttggacatctgcatattgatttgaaagcgcgatgcgtttttttccatcggcttctgaaaaatatgctgtttcttttttgcggtcttttttaaataacaatattagttcccccagatattctctttttctttttatcggtttggaaggaacttgaatgaaggaatctgataaaaatattttaatgcggaaaaaaataaaaccattcgtacagaatggtttagtcaatcttgggtgagacgtttcagcggcttgatggcgggaccttcggcaaccccgccgtcgggtgtgaaccgggacccgtgacatggacagtcccacgtccgttcgccgtcattccattcaacctcacagcctaaatgggtgcatgtcgtatcgacaagatgcagacagcctttttcatctttataggcgccggcccgtttgccgtttaccgttacgatttttccctcccgggcccaagactctcaggcgaagcgtccggcctctcaagtttgcccgagataaggtgtttggccacgtcggcattataggaaatcagttttttcagtccgggatctgcgtggaagcgtgacggaataaacaggccggaaaacgggttctttttgttttgaatatgatcagccaaaagcttcgcggcgagcgctgagcttgtcatgccccattttttaaaaccggtcgccgccaaaatatgttcttcatcgcctgagatcggaccgatgaacggaattttgtcaatggtgacaaggtcttgtgcagaccaatgatatgggatgctttcaactccgattgtgtcttccgcaaattgtttcagcgcttcgtaatgcccggacatttcttttccttggcctgttttgtggctttcaccgccgacaagcaccagtttttcaccgttcaaatcggtgtatcgcagtgatctggacggcttgtctatgctgagatacatcccgtccggatacgcttgtttcggttttaccgcgagtacgtaggatctgctggcatacattctggcggcataaagcccgcctccgtcataaaaaggaaagtgggaagcgcagacaatgtagctgcacttgatgccgtgtctgtttttcgtgaccacttccggctgcggttctttttttatgtcgatcgcagccgtctgttcaaaaatccgcgccccgtttttaacgatctctttgacgagcgccgcaccatataaaagcggatggaattgcgcctgattcttcatggcgaggccgagcctgcaatcaacggggacgggaagttctttcacaagctcgtgttcaataccgagcttggtataagcttcctgctcactgcgcatttttttgacgcctgattctgtattggtgtaaagatatgcgtcttgttcaatcagtctgcagtcaatcgaaaggtccttgatgatctgcttcatgtcttccatggcgcggagatgggcttcgaaatacagccttgcgctggtcaggccgatctgctgaataagatcggcatagatgaaatcatgctgggcggtgatttttgcggtcgtgcccgcggtcgtcccgtttaaaatccggtctgcttcaatgacagcgacacggaaacctcttttcgtcagttcgtatgccgttgtcaggcccgtaattcctccgccgatcaccgcaacgtcacattccgtatcttcagtgagggcgggaaaggaaggaatgtcagctgttgctttccaataggaagccggttcctcgtttgaaaaagtagtcaattcagatttacctcctctgttgtatattcttaatttttccaataagactctgttcatacatgaaattcgtataagatgctcaaattactcataatatagtaattaatgtaaaggagtgatcaaaatggcgaatcagaagaagaaaaccttgccgccgcagcatcaaaaccggcagccgggctttgaatatgtaatggacccgcgccccgtttttgacaaaccgaaagcggcgaaaaaacttgaagggaaaacggcgatcatcacgggcggagacagcgggatcggccgcgccgtatccgttttattcgcaaaggaaggcgctaatgtggtcatcgtttactttgatgagcatcaggatgccgaagagacgaagcaatatgtagaaaaagaaggggcgaagtgtctgctgatcgcaggggatgtcggcgacgaagccttttgcaacgatgtcatccgccaggcgggccaagcctttccttccattgacatcctggtcaacaacgcgggtgagcagcacgtgcagccggggattgagaaaatcacgagccaccagctcatcagaacgtttcagacgaatattttttcaatgttttacttgacgaaagccgcgctccctcacctgaaaagaggaagttcaatcattaatacggcctccattaccgcctataaaggccacaaaacattgattgactattcagcgacaaaaggggcgatcgtcacgtttacaagatctctttcccaatctcttgtcactcagggcatcagggtaaacgcagtggcgccggggccgatctggacgccgctgatcccggcgagcttctcggcgaaggaagtggaagtcttcggctcagacgtgccgatgcagcgcccgggagagcctgttgaagtggcgccgagctatttgtacttagcaagcgatgattcttcctatgtcacgggacagacgattcatgtgaacggcggcaccatcgtaaacggataatgtaaaaaaagccaatccatatggattggcttattcactctgtttgagagcggcatattcttttgaaagcgtgaggaacgcttctttatttttatcatcaagcgccttattaatctgcattgtcagcatggcgatccggcgtttatacaaggattcatcaagcaccatttgaatgtaaatatcggccattgtcacatcgaattcgtttgctttttccgtgttgcgggacttcatgagctcagtgtacgactttttctctttcataaagaatccccccaatgccttttttatagtatatggataacggccggaaaaatcaattaatttttataatctttagataactaatacttggaaatatatcgacatatcctgcaaattgacgaaaaaacgaaaatgatcattgtataaatgaggtgaaatgaaaaagaaaaataatatttaaatagtaatttaagactaaattacagctttaaaaggtgatttttagctatattcaaaaaaaacctgtcgttttccaattacagatgatagattattagtataaattttcaagaaaaggattggaggctgcacatcatgtgccagaaaacacacgcacccttagaaagctacgaagtaaatcgttcaaccatcgctgttttgcctgaggaaatagacggtaaaatggggtcgaaggtcattgaaaaagactgcattctgtatgtcagcatgaagccgattcacatcatcgacagaagctgccgctactttggctccagctatgccgggagaaaagcgggaacatatgaagcgattaaaatttctcacaagccgccgattatggtggacccttcaaatcacatctttttattccctacactttcttctgcaaggcctcaatgcggctggatatctcatgtgcacgttaaagattttcaaccgacggcatttgatgacacagcggtcacgttctcaaacggcaaaacgatggaactggaagtatcctatcattcttttgaaaatcaggtttacagaaccgcctatctcagaaccacttttcaggacaggatgggcagtcatatcccgaagcggcaggaattcatgctgtatccgaaagaagagcggacaagaatgatctacgactttattttgcgggagctgggggagagatattagagaaagctgtgatgtaaagggacgggccctttccttttgggaagggctttttcgatttacatgcccggatagagttgtatcgtgtccgtctgttggctatgatgatgtaaagagtaatgatatttcattttaggagagatgggcatggatgtgtttgcaaaatatgtatcagaaatcgataacccggatcaccgtctcaaagcagaggaaattttgtcgtggacggctgaccaatttccgaacttagaagcgcagatcaagtggaacaaaccgacatttaccgatcacggcacctatatcattatgtttgccgcggcaaaaaatcatttgagcattttacctgaaaaagagacgatggagcattttgccgatgacatcgcccaagccgggtacagcgcttcttcacgcctgttcagaattcggtggactgatccggtgcactatgatctgcttaagaagatcatcgaatttaacatcaaagaaaaagctgaaaatccggggttttggcgttagcggacgtgatgttgaaggaggaagacatggacgttttcaaagactatttatcaagtatcgacagccctgaccatcgtctgcgaatggaggaaatcctgtcgtggacgtctgagcaattcccgggtttaacaccgcagatcaagtggaacacgccgatgtttaccgatcacggcacctttattatcggctttgcggcagcaaagcatcatgtaagtgtttctcccgaagaagctggaattgcgcattttgccgacgacattgcccgtgccggctacagcgctacttcccgtttgttcagaattcaatggactgaaccggtgtattatgagctgcttgaacgcatgattcaatttaatatcaaggataaggcggactgctcagcgttttggcggaaataatgaaagaaatgttaaaaaaacaaccctgaggagggctgtttttttattaaacgtaatccgaaaaataagggatttgcgtatccggcagacccttacgaaacgcacgatgaaagaaatcgtgcgttcaaaattctttatttgacgacagacatgctgacggtgctgcctgacactgtcaatttggcaaaatcctgtgtatcaatcacaggtgtgactgctttattgtcgatcgtgatgttcgtaaaggctgtcgagaagtttgatttgatgtaagggcgctgatcctctgatgtgaccgcgacggtggcgagcgctttccattttgagacagagcctacattggtttgggcgagttctgagatgatgcggccggtgtatccgtcattattcgtgccccaatatgtggcgcgggtattgccgttcagatttttgtaaatggtcagctgtacggtgctgccgggccggaagcctttcgtataagtgaattggctttctccttccagataccggacctggccttgtccctttgaaccgactttcatgatcggtttccatacatgataggtgtcactgtactgaagcccgatatcagcctctgtgcctccggtaaatcctgagtaaatataggctgtcccatttgacacctgaatcgagcttggaagctgaattttcgtgacgagaactgagcccgtgctgttcagataggcccttccgccgattcctttactgagctgggacgccgcttccgccgtattgggactgatcaccccggaatatccgccgtacatgcgccgaatagaacggctgtagtgagaacacccgcaacaagcccttttttcatcatcatttctcctcctatcatcatagtcagatagcgctatcaattcatattataaaaggttttgggaaaaattccataaaagatatacgggcggacgtaaattaaaactattttcctatttatcttgtaaatggagattatttgaactatgatatgttcagtcatacaacatgattcaggaaaggggataggatagaaatgaaaaagacggcagctgtgcttttgtctttcggcctggtgttcggttgttcatacggagcggggcagacggcagaagcgaaaacaaaggtaaaaacgtatcaaaactgtaaggcgctgaataaggtgtataagggcggcgtggccaaatcgtcgaaagtgaaaaacaagggcggcagaacaaagtacaagccgtatgtatcaaaagcgctttataatgcaaataaaagacttgaccgggataaagactatatcgcatgtgagaaataaaaaaacaagcctctctaaagaggcttgtttttttaaatggattcggcggtgacggcggttccgtatccgattaattcggatgtgttctgtcctgcggtcagttcgaaccgcaggccgacgatggcgttcgctccgagctgctccgcctctctgatcagccgctctttcaccgcttttttggagtcttccagcatttcggtatagcttttcaattcgccgccgacgacagattttaagcctgcaagcaaatcttttccgatgtgacgggactggacgatactgcttgtcaccaagccttttacttccgtaatctgttttccggcgacggtttcggtcgttgtcatgatcatgcggctttcccccttcatgtgtcttaccgctattttatcattaagccgccttttcggctgcgctgatttgtttttttctgactgcggcgctgacggcaaacatgacggcaatgttcagaaccagcgcgatgatgcctgtattcatatccttaatgatctgcggaagaaacggaaagagggttccgacggttgattcggtcagcgtaatgaaggccactgttccgaccccggccgttatgccggcaaaagcgccgtggcttgtgatgaaacgccgcttcggcaggctgaataagagggcggggaaaagctgggtgacaaggctgtagcccattaaaagcaaggtgacgatggtatttccgcctttcagcgtaaaatatacggaaatcagcgcgataacgggtacggcgtattttgcgagccgtgagactttttcgtcagtcgtgccgggcagaatggctttgtacacatttttggcgaacagcgtgcttgaggccattaatatcattgaaccgggtacaagcgccgtcaggatgcccgccgatccgatcagcccgacaaaccagggatcaaaggttttcacagacagctttaataaggcgagatccgtgtccgccccttttaaaccgggcacctgcagaatcgccgcaaatccggtaaagatgacaaacagcaggacgagctgataaagaggcatgatgatcgcgtttttccgaaacacccgcggatgctccgccgaataggaagcggcaaaggtatgaggccacatataaaagccgagggcggtcagcaaaaccgttgagctgaaccaggaaacgctctgtccggtttccggcagcgtgagaaaaccgggttttgcggcgtcaatttgtttgaacatctccgtaaacccgccgtaataatgaatgggcagataaatacctaaatacaggacgatgcctaaaatcatgatatctttgacgacggatatccacgctgaaccgtggattcctgaaatcatcacataaatcgtgatggagacagcgccgatccagacagcggcggagggcggaatctgtccgtatgacgttgctgaaacaattaatccgagccctttcagctgcaggacgagataggggatgagggatgcgatgccgacgagcgatacgagaatgccgaggagcgggctgttgtattttgaaatgaaaaaatctgattgcgacatcagtttgtgttgtttggcgtaagtccacacggctggcagaagccaatatgacaaaatgtaggcaaggcagccgtacgcgataatataaaaggcggggcctccttttccgtaagcccatccgcttccgccgaggaatgtaaaggtcgtgtatatttctcccgccattaataaaaagacaaacatcgtgccgaagccgcgtccgcccaccgtccattgttcaaggtccatatgttttccttttcgggcccggattccgagatatacacaaaacaggagcacggcggccattacgggaaatgctgcattcattccgtctcacccgccttgttttctttgtccaatttgtaaacggcggccatcagaacggaagtcagcaccgcccagatgacgacatatgcgagaatgaaaggcattccgaaaacataaggcgtcacccggttggcaaatggaatgccggcgagaattccgaaaaagggcagggcggcgagaacatgaatcagtttcataacattcctccttttcattgaaaacagcgtgtcccgattataaagaaaatcatgtcgaatgtatagtgtgaatagtctgaattttattttttgaaaaggaaaagcaggcccggctgctttttaaatggtcgcaagagacaggtaatattccaataaggcggtgacctgttcccgtattctcgggttgaaataacggtgtttttcttcatagccgttaatggtgcatatataaagcgtaaatgcttcgtctctttccgcttcgtatattttaattttacgctttcttaactcttttcgaacatcactcaaatccttttgtgctaattttaaagagcagctgataagctgtttatagggttgttttaatttgaacgggcacgaatcaagcgcttcgaggtcccggttcaggatggcggccgccatgggcagaaacagccctttttcgatgagatcgcgggtgccgctccgaatgtcaggcataaatactccttctttcttaaaaaagagaacgtttgttcttattttatactcgcttacacgatatttcaagacggaaaatctcgtaaacattttcgttttttggagataatgtgtagaataaggatagacaaactcgttaaggagtataaacgttggagcattttttatcatatttgactgaggaacagctgacggaatggttccaaagctatagagctttcggcccggcggctgcggctgtattgccttttattgaagcgtttcttccgtttttgccgctcgttgtatttgtggtggcgaatacgaatgcatttggtttgtgggaaggtttttttctgtcatggctcgggtctgcgtcaggatcgatgctgatgttttatgccgtccgccgtttcggacagaaaagagctttcggtttcatccgcaggcatcagaccataaggcggatgatgctctgggttgagcggcacggtttcggtccgctgtttattttactttgcttcccctttacgccgtccgctgcggttcatatcgttgccggtctgtcacgggtgggggcgctgcagtttatatcagcagccgcgatggggaaaatggttatgatctttatgatcagttttatcgggtatgatcttcacgcactcattacacagcctttcaggatggcgggcgccataatggtgatcgcggtgctgtggtatgccggaaagcatatcgaacggcgtttacagacgagaatcagtcagcatgagaaagacggagggagacaggaatcttgaaaaaacgattttggtttatagccggcgtgcttatcgttgttttggccatacaattaaagaatgccatttttattgattataaagtcgaaggaatcagcatgaatccgacctttaaacaaggaaatgagctgatggtcaacaagttttcccatcgttacaaaacgatccgccgtttcgatattgttctgtttaaaggcccgcaccgcaaagtgctgatcaaacgtgtcatcgggctccccggcgagtcaatcgcatacagggaggatcagctgtatgtgaatggaaaacgggtggcggaaccgtttttaaaaccgttaaagtcatcattgtccgccgggagccatgtgactggtgattatacgctgaaggaaacgaccgggcgcaaaagcataccgaagggacaatactttgttattggcgacaaccgcatatacagcctcgacagccgtcatttcggtccgattaaggataaagacattgtcggagtcatcagtgaatcagacgccaagtgaacggcgtctttttttcggaaatgattgtcaaaaagcggaggaaagactataatgaaaattgttacgcgcgaaacaaaaaaggaggtgttttatttttcatatttttgttacgcgcgcaacaaaaatatgaaagagggctgatgaaatgaaaacacaggctgccattatcgggggaggtccggtcgggcttatgcttgcatcagaactggcgctggccggagtgaaaacgactgtcattgaacgattgaagaagacgatgccgtattccaaagcgcttatcatgcatccgcgcacacttgagctttttgccatgagaggcatattggaacgcttcttggaaaaagggacgaaggtgtcttccggccatttttccatgctggatacacggctggatttttctcggctggatacgaagcagaattattcgttaatgctgccacaggcagaaacggagcggatgttggaggagtatgcatcaagtctcggcgcagacatcatccgcggggcggaagcggtggctgtcacccagacggatgacggagtggagacggtgttccgggacgaaagcggaatccgcactcttcacagcttatatgccgcgggtacagacggagcggggagcattgtccggaaacaggcgggcatcgctttttcgggcactgatgccgacttaacaggaaccctttgtgatgccgctttgaaacatccgcccgaatcttcctttttttcaacgtgccggctggagggatcggttgtgattatccctcttacggacggacttttccgtgtcctcatcgtttctccgcatgtcccgcaaaagcggaaggaagagcgggtcaccgaagatgagctgaaagaagacctgcggcggatatgcggcactgatttcggattgagtgatccggtatggatgtcgcggttcggcaatgccgagcgtcaggctgagcagtaccgctccggccggatttttgtggccggggatgcggcgcacattcattttcccgcaggcggccaaggcctgaatacggggcttcaggatgccgtcaatctcggctggaagctggcggcgcaaatgaagggaaaagcggcgcctcatcttctggacagctatcatcaggaaaggcacagcacaggaaaagaagtgctgcacaatatcaaaacgcagataaagctcatggattttaccgagtcggggatggcattaagagaaacgatgaccgctttgctggattttcaggagtccaaccgtttattggcgggaaaagtatccgcgcttgatctgcattatgaaccggatgcggagctgccgccgcataccctgaacggaaaacgcctgccggatatcgaactgacccttcatgacgggcggccggcccggctgtatgattttctccgcaagggcggctttgtgcttctgtcattaagagggagcattcccgccggtattgatacggacagcgtggcggcagtcagggcggagcttgctgaaacacgtgccgattggaatgacgtccacaccgttttaatccggccggacggccatgcggcatgggcagccggcggctcgggacgtgaagcggaagaagccgttctggccggtttggagagatggggattattcatctgataacctttttatgcgcctgtgtgattgtttcttatgtaacaaaacgttatagtaaaagaaacaatcaatacggaagggtgactcagcagttggacagaagacagccagaccatgcaaaacacatgattcttgaagggctgaccgatatttttcacgagcaggagaggtgtcaggaggatatcagggcgtcgttggccggacggatggatgaactccgcgaaggaaacgggaaaaaattacaattgaccttgacggaaattcacattttgtcgtgtatcggagatcatgaaccgatcaatgtcacgtcaatagcggaaaaaatgaagacgacaaagccgaccgtgtcgagaagctgcgcgaagtttttggaagccggctttctgcgcagaacccggctgagtgacaataaaaaagaagtctatttccggctgactcctgccgggaaagagctgcattcccttcatcatgaatatcatgaattgataaaacagcggctcttggcgtttttagaccgctatacagatgaagaactgttatttgctgaacggctgttccgtgatctgtcagcaaactggcggtctgtaaatggcggcggagagctgttcaaataaaaaacacgcatatggatgcgtgttttttattcggatcatgttcctctttctgcccggcctctttcgccgtgtgcccgtttcagctgagaaaggtggtgcagcagccgatagaagggcggaagcatggcgatgacgagaacgatccggatgacctgaaccgcgacgacgaaagtcgagtcttcgtgcagggtgatcgaagtcgccgccatctcggcgatcccgccgggagaaaaggcgagaacagatgtaatcatggagatgcccgttaatttagaaaccgcaaccgcgctcagaatcatggcggcgattaatccgacggaagaaataaatccgacggtcagcactctcgtcacaccggtgaacatgcttttgtacatttttgatccgattgtggcgccgagaaaaatttgtgacagctggttcgcttccggcggccaccaggccagcatgtctttgcccgccaaggcggacacgccgatttccgcagcagcaacgccgatcatgctgccgagcagccaaggggcggggaatttcagccgttttgcgcctttacttgcaagccaggcagctaaaataaatccggccgttaacaagacgggaataaggcccggatgtgaagctcctgctgaaacggctccggctgatgtctgagccgcaccgttttgtttggtaaataagaaaatgacgagaaacggtattgtcatgacgaccaaaaggacgcgcgtcagctgaataaggcttacaatcgcggtgtttgcgccgacttcctgggcgatacccggcatggcggataaaccgcccggcgccgttcctacaaagcttgtcatcatgtccgtccggctgaaccgaaagagcacatatccggaaacaagcgccatcacgatagagaaaatcagcatgaagcctaccggaagccaatgctcccgtaaaaccgacagaacggacaggttcaatttctggccgagttcgatgccgaggatcatttgtcccgccgcaagccatctgcggtgaatccctcttctgtcaggcgccatgaacagccagccgggcctcgtcatggagaggatgcagccggcggcaagcgttccgagcatccaggcgatcgacatccctgtaagcgaaagaagaaacccccctgccgcactgatgagaataaaccagatatccgtaaggagatgtttgtctttcttcaatgaaaacccttcttcctgaaacattcatattaaattgttaagctcgttaaccttactattactatagtatagattttgagataaataaataatgaattatttctcataatccattcatttttcttatcgaaaacataaaaaaagctccggagatgggtgagtgcaccctactccgaaacctcgcccgcttttcctttccacacaagcgtcaatcccagaccgagaaataaaaccacacctgcgaacagaaacgggaagtgaatattcatatcaaataaaataccgcccagagccgggccgaaaatggtgcccaaactcgtgtatgttgagttcataccggcaacaaacccctgctgatttcctgcgatcttcgatagataagtagtcagtgccgggcgcagtaaatcaaacgcaaggaaaatgatgcaggtgacagcgagcacgggcaaaaaccctgacatcaccgtagaaacgaaagccagcacagcgccgatgatcagacaaagctgaatgacttttttctccccgaggaagttgacaagtctgccgaacgcgagcacttgaatgaggactgccacaatggagctgaacgtaataataatggcgatatcctttggcgtgaagccgaatttatggtttgtaaataagctgaataccgtttcgtacgccgacagcccgaatgccaaaacaaaaacgatgataaaggcgatcaagtagcttggatgaatcgactttttcaaatcttttaagaaggttgattctttggcgctttccatctgctttgcgcgttcttctttagttaacggctctttcagcataaagacagaggaaatcactgcgataaatgcaattcccgccgcaaagaaaaacggcatacgaacgccgtgatcggcaataaatcctcctatgccgggcccgatgataaaccctgtgctgatggcggcagatacatagcccatcgccttcgatctttcctgcaccgtcgtaatatctgcgacatacgctgtaacggcgggcatgataaaagcggcactgatgccccccagcacccttgcgaaatataaaatggagacatgtgtgcccaatccgaaggtcagctcggataatgcgaacaaaaacagtccggcgagaatcatgatttttctgccgaaacggtcaacccatctccccgcaatgggagatgcaattaattgcgcgacggcgaaggcagcgacaaggtatcccattgtgctgcccgtcaagtgcatcacattcataaacagcggcataacgggaatgatcaatccgatgcctaaaaacgcaataaatatgttgcttaataagatgatgagtacagccttttgttctctgatcggtttttgcatgttgtttctcctttgtcagctgtcattcagtttatcagcgttgatcgacccgtgaataaacacggagatggcttctttttgcaattcgattctttgctgaatggtatcgtttttatataacacatctaaaccgtagaagacggatagcaggatttttacttttgattcgacatgatgaatggaccagcttccgtcttgatttccttcttctaagatctctctcatcacatcgtcatattcaatatcaattttgttgagccgctttacgacctcctctgacgtaaacgcactcgcataaaactcttcacttgctctcataagcgggtaattgatgctcatccggctgagcagctccgcaaagcccgtcagcttttcggcagcatctttcagatcagcttccatttccctccacgtctcgatcatcacgcggtgatcctcttccatgatatgaagaaacagaaactcttttcctttaaaatggtgataaagattgcctttactgatctcggccgcctctaaaatatcccgaatcgatgtttctgaatatcctttttttgcaaataagtcacgcgaagcggatacgagcctgttcttcgtcttttcgctctttccggcaccgccttttgtatttgtcacttcacacagatcctttccgcctcattcatatcgttgtcccggcaaagcggggctcggttcgtttaaaaccgaccagttggtttattttattataaagggtttttgctgactatacaatgaagaagttatccattgtttagtggaagtataaaaacggctcgaaaaataaaccccattctctcctgttgaaagaacggggtttgccgtctatgactcccagcggggagcgtctgaatcgttattttccggtatttacctcggtgtagcttgtgttcggcgagtttgataccgttccccctgtatggtggaaaggagagtgggccatatcgtataaaaaccagacggcatgacgctgctcgtcaaatgccgtgcgggcaaataaccgtttcgcttccggatgcaccgctctatcggatgcctgtaaataaaaatcattcgttttctgctcatcataaaacgccgccctcagtccttctctgtatgtgtgcggacaatgctccgtctgtttcggcgtcaactgttttccggtaattgacgtatacagtgaagagaaagcgtgcatgtggcgcacttcttcctctctgatatgttcgattcgtcttctgatttctgcggtcggcgctttttcggctaatattgagtagcaaatcacagcgctgtattcaccgtttatggattttaccagatcctttataagcacagaatcgtcactgcagatggctgtataatgaaaaaaattctcgtgcattggactcacccccggatgtttatagggtattatacggcggcagcccgtgacatgtgcggatgtcatttttattcttgatccagcggcgatgtaatatggtcgtcgtatgtgtcgacaaaaagccggccgttgcttccgcgcacagcgtatacgacgtcttccggtttgaggtttctcttatccaattcttctctcagccatttttccgatacgtggttttcttccagatttttcattaccagccggccgtccataatcagctcaacggcaaagttcttttcatgtccggcaaagatgccgagatcctgtcttgtaacgggcgcaaattccggtttgacctccactgacatgctgccgtttgtttcaatgatggcagtctgaacctgagaaatgtcaaatacatcattttcacgaagctgctggttcaagtagtcgagggtatagcgcatctttttcatattatgctcaagtatttttccgttttgaatgataatggtcggtttgcctgcaaagaaacccctggcagttctgtttttcatagaaagatatgcgacaagataaatgataaccacaaaaatcgtgtaagcactgacagtaaaatgaatcggcagttttgtattaaacgacagattggctgtgatggcgccgagcgagatggccgcaatgaaatcaaaaagcgtcatctgtgaaatggtttgttttccgagtatacgggcgccgataaacagaatgctgaacgacagaatcgttcgcacaatcacttcgggatattctgacatcatatttaatcctttttttctttaatttggtcaaaaacgatatgttttaaaacagtcatcccgtttttaccagcagatgagattggtcattttcgtcaactttcgataaaatgtagaaagataaaaagagagggtcttctaatttgggtgttgagtttttagtaggcagatcggggagtgggaaaacgaggctgattatcgacagcattcaagatgaactgcgccgggagccgttcgggaaaccgatcatttttctagtcccggatcaaatgacgtttttaatggaatatgagcttgctaaaacgccggatatcggaggcatgatacgcgctcaagtgttcagtttttcgcgtttggcgtggcgcgtgcttcagcataccgggggcatgaaccgtccgtttgtgacgacgacgggtgtgcagatgcttttaaggaaactgattgaagaacataagcacgattttaaagtgtatcaaaaagcgagtgacaaagccggattcactgagcaggtggaacggatgctgacagagtttaagcgatactgtattgagcctgaagacgtccgccgcatggcggaaagcggaacggcgtcagagtatcgcggagagcggatgctgtctgaaaaacttcatgacttaggcattttatatcagcagatggaaagaagcctcgccggacactatctgcattcggaggactatttgacgctgctcgctcagcagattcctttggcggacgttgtaaaaggcgcccgtgtttacgtcgacggattctatcaatttacgccgcaggaattaagggtgctggagcagctgatcatgcatgctgaacatgtcacattctcgctgacggcggacagcccttcggcggaacaggcaccggatgagctcgatctgttcagaatgacgggaagcacatactataagctttatcagacggcaaaggaattgaatgccgatatttcctgcaaggaactgcatggcacgaagcggcatcggcatgtgccggagcttgcctgtatagagtcgcagtacgatgtgcgtcccgccgccgcgtataccggcggacaggaagcttttaccgtcatgcaggcgcaaaacagaagagctgagctcgaaggtattgcccgggaaattcaatcgcttgtccgggacggaggataccggtacaaagatatggcgattctcatccgtcagccggaagattataaagatttgctgaaggaagtgtttgccgattacgggcttccttattttattgacggaaaagcttctatgcagcatcacccgcttattgaattcatccgttcaagcctggatgtcgtgaaggggaactggagatatgaagcggtgttccgctgtgcgaaaaccgaactgttattcccgcttgatcagccggagcagaaaataagagagcaggtagatcagcttgaaaattactgtatcgcctacggcattaaaggggagcgctggacgaacggcgagcggtttgtatacaggcgcttcgtatcgctcgatgaggatttcgcgcagacggatcaggaaatcgagatggaacacatgctgaatgagacgagagagtggatagctgcaccccttatccggctgcagaaccggatgaaaaaagcgaaaacggttcaaagcatggcggaggctctttatctctttttggaagataccgatgttcccctgaagctggaccggaaaaggcagcgggccgaagaggccggaaacatgatcgaagcgcagcagcacggccaggcgtgggatgccgttatccagcttctcgaggagtttgccggcatgatgggtgaagatgaaatatctttggcgctgttccagcaaatgcttgaaacgggaacggaatcgcttcatttttctttaattcctcctgcgcttgaccaagtatttgtagggaatatggatctctcaagaatatacggcacgtcctgcacattcgtcatcggggccaatgacggcgttcttccggcgcgcccggatgaaaacggcgtgctgtctgatgatgaccgggagtggctgaaagcggtcggagtggagctgtcttccgcggggcgtgagcggctgcttgatgagcattttctcatctatatggcgctgtcgagtccgtctgaccgtctttatgtgtcatacccgattgccgatgcggaaggaaaaacgctcctgccgtcaatcgttgtaaacaggcttggcgagctgtttcccgatcatcaggaaaagctgtcagcggctgatcccgagcaggtaagcgaagaagagcagcttcagtatctcgtcaataaacaggtggctcagacgtatacggcaagtcagctcaggctgtggacaagagagtacgagatcagtgacgtatggtggagcgcatacaatgtgctgatgaaagagtctgatcaccagcgtgcgaaaaagctgttttcaagcctatttttccgcaatgaggcgaagcgtcttgaacggcctgtttcgcgccagctttacggcgagcatattaaaggaagcgtttcccggatggaggcgtttaatgcctgccagttttctcattttgcatctcacgggctgcaattaaaagagcggcagtttttcaagctggaagcgccggatatcggccagctgtttcactccagtctgaagctgatttcagaccggcttcgtgagcagaagctggaatggcgcgatctgacgaaagatcagtgccggaatttctcctatgaagcggtggaacggcttgcgccaaagctgcaaaaagagattctgctcagctcaaacagacacttttacgtgaaggaaaaactgcagaagatcgtcacgcgtgtttctggcatattaagcgagcatgcgaaggcgagcggtttcgtcccggtcggtcttgaactcggtttcggcggaagcggaccgctgcctccgctcactttcacgctgaaaaacggctgtacgatggaactcgtcggacggatcgaccgcgtggataaagcggaaagttcaaaaggcctgctgctgagaatcgttgattataaatcaagcgacagggggcttgatctggctgaggtgtattacgggctcgctctgcaaatgctcacatatcttgacttatcgattacacattctgcggattggctcggcatgaaagcgaccccggcaggcgttttgtatttccatatccatgatccgatgattcaggccagtctgccgatggggcttgatgaaatcgagcaggaaattttcaagaaatttaaaatgaaaggccttctcctcggtgaccgggaggcgatcagcctgatggacacgactttggaggaagggcgttcaaatatcgtcaatgccggtttgaaaaaggacgggtctttaagatccgactcagcggcggtcagcgaacaggactttcatctgctgacagaccacgtgcggcggacatttgaacaggcgggcgaagcgataacggacgggcttgtgtccattaccccgtataagctgaaagataagacgccttgtacgtactgtgcgtttaaatcggtttgccagtttgatgagtcgcttaaggaaaatgaataccgcagcctgaaagcggaaaaagacggcaccatactggattggctgaaaaaggaggcggatgatgatgcaaattcctaaaccgaaagacagcatatggacggatgaccaatggagcgccatcgtttcttccggccgcgatattcttgtcgctgccgcagccggatcaggtaaaacggccgtgctcgtggaacggatgatcagaaagataaccgcggaggaagatcctgttgatgttgacaggctccttgtggtgacctttacaaacgcctcagcagcggagatgaagcatcggatcgctgaagcattagaaaaagagctcgccaaaaatccgggatctctgcatatcagacggcagctctctctattaaatcgggcgagcatttcgacgcttcactctttctgtctgcaagtgcttaaaaaatattattatatgattgatcttgaccccggttttcgcatggctgaccagacggaaggcgaattgctcggagacgaagtgcttgatgagctgtttgaagatgaatacgcaaaagggaatcaggcgttttttgagcttgcagacagatatacgacagacaggcatgatctggatcttcaagaccttgtcaaacgggtgtacgagtattcccggtcgcatcctgacccggaagcgtggctgcagagctttgtccgcttgtatgacgtgacggaagaaagcaaaatggaagagcttccgttttaccagtatgtgagagaagatgcggaaatggcgctcttcggggcaaaacaaaagcttgagaaggcgcttgaactgacaaaagcgcccggcgggccggccccgcgcgctggtaattttctggatgaccttcagcagatagaagagctgatcagctgccggcatgacttcgatgcgctgtatgaacgggtccccgcagtctcatttaagcgggcgaagccggtaaagggtgatgaatttgacaaagcgcttttggacgaagcgaccgatttgcgaaacggcgcgaagaaactgatcgaaaagttaaagaccgattactttacaagaagtccgcaagatcacttgaagagtttaacagatatgaagcctgtcatcgaaacgctcgttcagctcgtgatatcgtacggaaaacgatttgaagcggcgaaacaagaaaaatcaattattgatttctcagatttggaacattactgcctggcgattctaactgcggttgatgaagaaggccggcgggtgccgagcgaagcggccgtttattatcaagaccagtttcatgaagttctggttgatgaatatcaagataccaatcttgtgcaggagtctatcctgcagcttgtgaaaagcggggatgaagaggcgggaaatctgtttatggtaggcgacgttaaacaatcgatctaccgtttcagacttgctgagccgctgctgtttctcgggaaatataaaaggtttacagaaagcggggaaggcgcggggcagaaaattgacctgaaccaaaatttccgcagccgttccgatattttggacagtacgaatttcttgtttaagcagctgatgggcggaaaaatcggcgaagtggactacgatgaacaggcggcattgaagctcggcgcatcgtatccgccgaatgacgcggcaaaaacggaactgctgctgattgacagcgctgatgacgcagacagctccgaggatgccgaagactttgaaaccgtgcattgggaagcgaaagcgatagccggggagatccgaaagcttgtctcgtctccgtttaaggtctatgacgggaaaacaaaaacacaccggaatatccagtaccgggatatcgtgattttgctgcgctccatgccgtgggcgccgcaattaatggaagagctgaaaaaccagggcattccggtgtacgccaatttgacgtcgggttactttgaagccgtggaggtggctgcggcgctttcagtcttgaaggtgattgataatccgtatcaggatattccgcttgcttccgtgctgcgctcgcccatcgtcggctgtgacgaaaatgaacttgcgctgatacgccttgaaaagaaaaaagcgccgttttatgaagcgctgaaagcatatatagcgaacggtgacaggcatgatgaactgtatcaaaaactgagaaccttttatgacagtctgcaaaagtggcggtcattttcgacgaatcattcggtgtctgagctgatttgggaagtataccgcgataccggatattttgactatgcaggcggcatgcccggcggaaagcagcgccaggccaatctgcgcgtcttgtatgaccgggcgcgctcgtacgaagcgacggcgttccgcgggttattccgctttttgcggtttattgaacggatgcaggagcgcggcgatgatctggggaccgcccgtgcgctcagcgagcaggaggatgtcgttcggctgatgacgatccacagcagcaaaggacttgaatttcccgtcgttttcaccgctggactcggcagaagttttaatatgatggatctcaacaaatcatacctgcttgataaagagctcggtttcggcacgaagtatattcatccggaactcagaatcagctatccgactcttccgcttgtggcgatgaagaaaaagatgcgcagagagctcttatccgaagaattgcgcgtattgtatgtggcgctgaccagagcgaaggaaaagctgtttctcgtcggttcctgcaaaaaccgggaaaaacagctggccaaatggcaggcccaagcagaccgggctgattggcttctttctgaattcgaccgctatcaggcgtcatcttatttggactttatcgggccggcgctcatccgccaccgtgacatggaggcgcacaggacgccgggactttcttcgtctgaggatatcgcgcgcgacccgtcgcgttttcacatccggatgctgcagcaaagtgaattgctggaagagaatccaaaagaacgtgctgaagaaaagagcaaacgtctcaaggcgatacagcagggcgagccgattcctggttcgttttcatttgatgatcaggcgcgccgtctgcttaaatgggaatatccgtaccgagagctgacggctatcagaacgaagcagtcagtttctgagctgaagagaaagcaagagtacgaggatgaatacagcggccgctctctcatcaaaccgtcaggagacacgcttttatacaggcgtcccggttttatgatgaaaaaagggctgacagccgccgaaaaagggacggcgatgcatacggtgatgcagcacataccgctgacgcacattccgactgccgaagaagcagagcggacggtccggatgctttacgaaaaagagctgctgacagaagagcagcaggaagccattgatatagaagaaattgtccggtttttcggaactgaaatcggtaaagaccttctcggggcgctgcggattgaccgggaagtgccgttcagtatggcgcttccggccggcgaggtgtacaaggatgccgaaacggccggtgaaccgctgctcgtgcaagggattattgactgcctctacgaaactgcggacggtctctatttgctggactataaaacagatcggatagaggggaaattccggaatggatttgaaggcgcggctccgattctgcaaaaaagatatgaaacacaaatcgaattgtatacaaaagcggttgaacaaattacaaaaacgaaagtgaaagggcgtgcgctctatttcttcgatggaggtcacgttcttacactgtaacgagatccgaagctcctttttggagcggatctttttttctatcaaaaagtgaggtgaatgcggtatgcgcattttacatacagctgactggcacctcggcaaaacgctggaaggcagaagccggctgagcgagcaggccgaagtactggaagagctgaataccattgtcaaggaagaaaacattgatgcggtcattatggcgggggatgtattcgatacggtcaacccgcctgcgctcgctgaacaattgtattacgaaagtctttccgcgctttctgacggcggaaaacgcccggttgtcgtcattgccggaaaccatgacaatcccgacaggctggcggcggcttctccgttaacaaatgagcgcggcattcatttaatcggctatccgcggacagaacccgtccatattgaggtgccgtcggcggacgagctgttagccgtagccgcgctggcatatccgtcagaggcgagattaaacgaagtgctttctgatacgtttgaggaaaagcttcttcgcgatcattacgatgtgaaaatcagagaggcgtttgctcacatgtgcggactgtgccggaacgatgccgtgaaaatcgcggcgagccacatttatgtcgcggggggaaatcagaccgattcagagcgtccgattgaagtcgggggcgcctacacggtcgccgctgacagcctgccggctgatgcggcttacgtggctctcggccatctccaccgtccgcaaacgatcaagcgcgccaagacggctgcccgttattcaggctctccgctcgcatacagcttttcggaagccggttatgccaaatcggtgacagtggtagaagcgaagcccggcggagaagcgaagtgggaagagattttcctgtcttccggtaaaccgctcgtcaaatggaaagcgcaggggctgagcgaggttcacggctggcttgatgaagggcgtgaccggaatgcctggatcgatcttgatatccatttgacggatcagctttctctcgaggaaattcatcggctgagaaaggcgcatcccggctttatccatatcaggccggtttttgaagaaaaagagaccgaaaatgaccggattgaagtgaaacacacatcaattgaggatcgatttaagaagttttatgaaaaacaaacgggcggcggcgtgccggatgaggagatggtcaagctgtttttagagcttgcgtcagcagatgatgaggaggatgcgacatgaagccgattctgttaacgataaaagggctccacagcttcagggaggaacagaccattgattttgccggactgtcaggagccggggtgttcgggattttcgggccgaccggaagcggaaaatcgtcgatccttgatgccatgacactcgctttatacggaaaagtggagcgcgccgcaaataatacgcacggcattctgaatcatgccgaagatcagcttgccgtctcatttacattcgcgcttcaatccggccaccgggtttcctacaaggtcgagcgcgtttttaagagaacggatgaaacgaaagtaaaaaccgccctctgccggctgattgaaatcaaagacgaacaaacggtgctggccgataaagcgaatgaagtgaacaaaaaggtagaggagcttcttggcctgaccattgacgactttacaagagccgtcgtgctgccgcaaggaaagtttgccgagtttctgtcgcttaaaggcgcggaaagaagacatatgctccagcgtctgtttaatctggaacagtacggggacaggcttgtcaaaaaattgcggcggcgggcgcaggaagcggcagcgaaaaaaaatgaaatgctggccgaacaatccggcctcggagacgcaggagaagatgcgctgaagcaggctgaacagcagtttcacgaagcgaacgaacggcttgaagcagctgagaagaaacgggtccgggcaaaagagcgttttgaaaatcaccaggaaatttggaacttgcagacagaaagagatgaatatgagcgccgggagaaaaagcttgaggaaagacgcccgtacatcacggatttgactgagcgtcttaaagaggcggaaacagctctcgcccttgagccgtacgcagaccgctgcaccgaagccgtccgccggaagcagcgagccgaacaggaacacgaactggccaaacggaaatcagaggcggaaaccgtttcatttacccggcaaaatgaagcctatgaagcatggcgcgcccataaggccgaacaggagccgaaacttgtcaaggaagaagagctgtatcaaagactttcagccattgaacaaaaactgcttgaagcgaaaaaagaagcggaaaaaacaaatgcggagcacagcaaaaaagaggaagaatacgaagccgcctcgaaacagctggccgcagtgaaagaccgcctgacccgcggccaaaacaggcagaatgagctgaaagaagagctgaaagcagttcaagtgaccgcagatgaacggaaaaaatgccagaccgcagcacagctggcggcaggctttcagcagacacaggaacaaatcacgaaagagcgggccaatctgacaacgcagctgaaaaacgtggagaagctcaacggagaaagcgagtcgctcacagcgaaagcgaaaacggaagaggaagacattacgcgcgcttatcaaacgctgcaaaccgtttaccatatggtctgtgaaacggaacgttcactgaaagccgcagccgaacgggctgaaaaaacgcaagccgatctccgcaggcgctcagaggaagcgagaacggctgcattaacaaaagaattatcggaaaaactgatcgaaggaaagccttgtcctgtatgcggctcgacgcagcatgaccgcccgcgttccgctcatgaaacattctcgcctgataccgctgtgcaggaacatttgcagcaggtggaagcactgctttctgaggcggcggctctttctcaggaagtgctgacagccaaggttgcattagaagaacagtcggggcgttttaccgaagaatgtccgtttctgcaaagcgcccgggttccggagctggaagccgcttcttccatcagcggacgcccgcttgatgaagcgttcagcgccgtccgcttggaatggaaacaaatgaaacaggatatgctgtcggtaaaagagaaggtcgcaagactgatcagcgcgcatcagcagacggtaaaacaagctgagcagcttgccgaacgaatccgctacgaggaaaaagaagccgaccgtctcagacattcattagaagagcttgaatcgctgtcagaaagccgattgaatcagtacaacgaagtctgcggtcatattccgccaaaccggattgacgcctggcaggcttcgatagatgagaaggacaggcaggcagaagaatgtgagaagcgcattgaaacaagcatcgcattcctcaaggaacatgaagaggagaaagaacgcctgcaggagatgaagcatcggcttgaacgggaacggctcgagcttcactatgcgtctgagcgcctgcagcaggtgattgacggatatgaacaagagctcggaacagcagctgaagaaacatcaatttccgcaaagcttgaagcggtgcggcaggaattacagctgttaaaatcaaaagaacagtccctattcgatgcgctgaagcaggcgcagcaatcgctgaatgacgcaaaaggccgggaatcagggagtctcatgtcactcagggatgctgaggcctctcttgagaaagcgcaaaacgactggcgcgtgaggtcaaaagacaccgggtttaccgaaccggaccaagttaaaaaaagtctgcttccgcaagggcgtgcagaggaaatgaaaaaagaaattgatgagtttctggacacctcaaaacagctatcggcaaatatcagccgtgttactgataaattagccgagcgccggatatcggaggaagaatggacagcatccgtttctctgctgaagcaggcagaggctgagtcaggcgccgccatggaggaaaaaggagcacaggcaaaagccttcgcggttatgcaaaaacagcataagcgctttaaagagattgaagccgaactgaaaaactggcagacacagattgacaggcttgataagctccagtctgtatgtaaaggcaatacattcgtcgaatttttagcggaagaacagctggaaagcgtggctcgggacgcctctgcccgtctcggagcgctgacaaggcagcggtatgccatattagtcgattcagaaggcggtttcgtcatgcgtgatgacgcgaacggaggcgtcaaacggcccgtatcaagcctttccggcggggagacgtttctgacatcgctgtcgcttgcgctggccttgtccgcccagattcagctgcgggggcaatacccgctgcaattctttttcttagatgaaggattcgggactcttgaccaagggctcttagacaccgttgtcacagcgctcgaaaagctgcaatcggacaacttatccgtcggagtgatcagccatgtgcaggagctgagagcgcgtctgccgaaaaaattaatcgttcatccgtccgaaccgggcgggaaaggcacccgggtcacattggagatcatgtagaaaggagaaggaattatggccgattctgccgagggtacatgtgaattatgcggccgccattatgtgcggctgacggagcaccacttaacgcctaaggaagaaggcgggacattccttccgaccgcaatgctctgcatcccttgtcataaacaggttcacgcgctctatacgaatcaggagcttgcggcaaggctcgcgggaatagaagagctgcggcgtgacccgaaactcgcgcggtttgtgaaatggatcagaaaacagccgccggaaaagcttgtaaaaacaaaaaaagcaaatgaacgaaaataacgctgaaccaaaagcagccctcttctgaaagagcggctgctttttaggcgtttccgaccacattttgatcgctgacatcggggtctatatagtttgtcgcattgacaacgttgtttaataacaggaaatctccggtattgcctgctcccgaaccgagcgcagatttagaagagctttttggagaaaggtaaaaggaatcaccaaagtttacgactccgcccgatatggaattgatagctataggtccggtaattgctggcataaacgacaccctttatagaagtctcaccgtcattatatgtcagggctgctgtgattgtgagcttggcgtgaagatctgcctaatatgtttcagccgcgaatctcccagaacgaccgacgtcgatccgatttgaaccacggacgctgacgataccccttgaactttcacattccttacccgaattgaaggattttcatggcagaatgcgctttggactcccgtttccggtaacggcatgacggccggctgccgaaagatctggtattcttttttgttaaatgagccttcatcatctctgtatacagcaagactgcgctgatcggccaatactttgatccgcatattgatttcattcgtatcgcctgcttgaaagacactcgcaatcccgactgaattgattttggcgttccggaggcgtgaaatgcgctttaacattattccggcgccagcggcacataaggcccgataataagagattccggaggcgtgtcaaagatggaagacagatagacggaatcggtgtcgccgattaataataaggaagaactggatacaccagtagaccggatgtcgccgacttcaatattccggttaatcactgtaaaaatcatgacggatcatcacctttcatttcaccaggtatgtgtttaataaagtgctcgacggccctgacaatatcacgcttcacatgttcggcaatctgctcggcatattgcgcgggcgccgtattttcttctttcgggacatgggacagataatactgaatccggctgtccatctgctttctgatatcttcaataatatgatatttgttcgtttcgtccagcctgctctcatactgagtttcgagctgctctaaaagcgcggggatttcttcattcaggtacatatcgacgttttgacggatttgctgcatttgctggcccgcctgttcctgctgcatcattccgacctgcggagatgtctggccgacttcgaagttttgcacggcattcggatcagtcggattcaatccgatattcagcgttccttccagccgttcaattttcagctgatcaaatttatactcgagccgatcgattcttgtagaaggctgctgcttcagcgttgaaatttcattttggaattctttcagctgccgttcgagctcctgaatctgctgcgcctgctgctggacgaaagaatttaaattctgcaggtaggatgaaacggattgatcatacatgacattcacctcgcgtctcgtttccttcattaaaactaccggcttggcggctggagcggtacaaatgatgaggtgccgggacctccccctgttgttacagcctgctgccccgcggtgacaggcggcgccggctcaacataactccctgtgttgtacagattggaaagagatttaattgaaccggcgcttccgatttgcagtatggaggaattgctgacagattctacacgcatgtaattgatatggatcgactgattgacgtaaaaattcatacggcgcctcctttatgcgtttcctgccatcggctgatcgattacatcattatcgtacacattcgttgaattcctgtaattcgtcagtgtgagattgtctccggtattgaagctgcccgctccggcaaatgtcttaacctctgcttttggagaaatggtgatgcagtcgcctatatgaacgactccgctcgtaccgacggcattaattttaaacgctccgacaattgcgggcatacgagcacatccttttcgtgaagattttcatgactgcactccaggagcttatctgggctgcctgcctaaaatagcttatgacaaatgcacatttttgtgagcggaaaaaactttagacgtaaaaaacaccggcgctttacagatgccgggtcttatacataaatgatacagatttatatacatatcacgtttatgagaaagcctcttttctttcgcggccgtgctgaatctgtgcggccgggttcggcccgctgtctttcgtttgttggatgagcccgccccggcacccgtttaaaaggctgtccagctcctggctgcacctgatggtctccgtcgcattgattccgaatttttgcgctgtctcgaataaagttaatcttttttcttcaattttgttcatcgtgtgatctccaattctcgattattttggaaaacataggatgataatagtataacccattttggccaagaaggttttatttcgtcaatatgactaaaaaagtgacaatttttgatactcttttacacttattttcagcctgtttaaaagagggatttcccgcccggaggaagaatacataaaggaatgccatttaaaaatgatgggggattaacatgaaatttgcaacaggggaactgaacagccgaaaatttgtcggtctgattattgatgatgacaaaatcttagatctgcaaaaggctgaaaaaaaattgtttgaacttgagacgattccgggttcgctgatcgagtgcattcaaaaaggagataagttcgtcgcgcatgccggacagcttgcggaatgggcgaaaaaaccgaatgacgagtcgggttcatttatgtatgcgctgtctgacgtaaagctttgcgcgcctattccgagaccttcaaagaacgtgatctgcatcgggaaaaattatcgtgatcatgccgttgaaatggggagtgaggcggatataccggagcatcccatggtttttacgaaagccccggctgccgttacaggccacggagaaacagtgaacagccacttggatgtaacggagcagcttgattatgaaggggagcttgcggtaatcatatcaaaaagcggatcgcacatctccaaagaacatgcgcttgatcatatattcggctatacaattgtaaatgatatcacagcgcgcgatctgcagaaaaaacataaacagttttttatcggcaaaagcctcgatacgacatgtccgatgggcccggtcattgtacataagtcggccgtcagtgatccgcaaagcctgaaagttgaaacgcgggtgaacggagaactgcgccaatcaggatcaacgggtgacatgatttttccgatagctgaattaattgagacgctgtcaaaagggatgacgcttgaagccggtgacattatagcgacgggaacgccgtccggtgtcggaaaagggtttaagccgccgaaatttttaaagccgggggaccgcattgacattacaattgaaccgatcggcacgctgtcgaaccaaatcggataattgtgtgtctttcgcacgattgataatgctccgagcggcttgttgtggtaccataaatgaggcagattgatctgatagggggaattgaacataatgacacattggcatattacttcatgggtcgttgcgcttatcctggtgtttgtcagctacgggctgtacggtgccggaaaagcgaagggcgcaaaaattacgcatatgattctgcgcttattctacattattattattctgaccggagctgagctttttgtccgttttgcgaattggaacggagagtacgcaggaaaaatgctgctcggcatcattaccatcggactgatggaaatgctcgtcatccgcaagaaaaaaggcaaatcaaccggcggactgtggatcggttttattatcgtgctcgtcctgacggtgctgctgggccttcacttgccgatcggttttcacgtattttaatcaatcgcttgaaaaacccggatgcatccgggttttttttagttgcgcaactgggccgctgaatgagaaatgccgtgttgatgaggcgaaagagatgtccaggatgccaaaagcgtcaatcactcttgttgccgcaaaagctacggctgtgaagggtaaaagcaaacgccggccgtcaatcagcgtgaaaaacaaagctgaatacatcaggcggcacctatttaaaaggtgccgcctgtttgttacgcggtgccgtcttgtcttgccgctgaatacataatggagcgccgcccgtcagatgccgtccattcaaatctgtcgtgtttacccgagctgccgcggtgatgctgcagggcgcattgtgcgtcatccgccgagaagtgataaaacgaaacgccttcaccggaaaacagcgcctgattataggaaaatacgcaatcatatacagacaggccgaacccgtgcagatggctgagaaacagcagaaacgtttcatcgtccagcgaatcgagcaaggttaacagcggccgtttgaccgccttttcataacggatttcttccccgccgagcagggggatggtgtctgcgccgatttcggccgaaccgccgcaaatccgtgccggctgccatctgccgtcgcgtttcatcaatacgtctgcgtttccgagactgtctgcaagcaggatatcgccttcatcgttttcgacgaggcagatgccgtcctctatcatcagtgtgccgcgcccccatttgtttttttctgagaaaagctgttttcgtttcataaccgtgcccgtctcctttgtttgtttcttctcttccgttctttccaaatcgggcttgtctcatacaactcttagtgggacaaatcaactatctgcgtttctttgcataaactgggtaaagtgctgatagaaacgaatttgaaaccgacagaaacgggattggagctgatatcacatgtgtggaattgcgggttgggtcgattttcaaaagcagctcgtccaagagaaacatattatgaacaatatgatagacactctttcaaaacgagggcctgatgattcaaacgtctggggagagccccatgttttattcggacataaaagactttcggtcgttgacattgaaggcggccgccagccgatggcctgcacgcatcaagaggaaacgtacaccatcatttataatggcgagctgtataacacggaggaattgcggaaggagcttcaggcgaggggccaccgttttgagaggacctctgatacagaagtgctgctgcacagctatattgagtggcgggaggagtgcgtggaccgcttgaacggtattttcgcttttgccatctgggatgaaaagcgaaagcggctcttcggggcaagagaccggctcggcgtcaagccgtttttttataaagaacacggctcttcctttctgtttgggtcggaattgaaagccattcttgctcatcctgatgtgaaagcccgcacagacagcggcggacttgcggaagtattcggactcgggccgtccagaactccgggctgcggggtgtttaaaggaattcacgaggtgcgtcccgcccatgcgttcactttctcaaaggacggtttgtccatatggcgttattggaatgtaaagagcgaaaagcatacagacagcttcgatgaaaccgccgctcacattcggtacttatttcaggatgcagtgacacgccagctcgtatctgacgtgccggtttgcacgtttttatcaggggggcttgattcgagcgcgataaccgcgatagccgccgctcattttgagaaacaaggaagagatccccttcatacttattcaattgattatgaggagaacagcaaattttttaaagcgagcgcctttcagccgaatgatgacggcccgtggatcgataaaatgacaaatgcattcggcacacagcatcataagtgcgtgattacgcaggatcagctggttgaacatctggaggaatccgttctcgtcagagacctgccgggcatggctgatgttgattcatcgctattatggttctgccgggaaattaaaaaagattttgtcgtgagcctttccggagaatgcgcggacgaaattttcggcggatatccgtggtttcacaccgcggcagaagaagacggatttccttggatgaggtcgactgaggagagggtcacgctcttggatgaaaagtggcaaaaacggctgaatcttagagaatacgtgaatgcgagatatgaagaaaccattgcggaaacgccgctgttagacggtgagacgggaacagataaagcgagacggcagctgttctacttaaatatgctttggtttatgaccaatctgctcgaccgcaaagaccgcatgagcatgggcgcaagtcttgaagtacgggtgccgttcgccgaccacagacttgtggaatacgtttggaatattccttgggaaatgaaaatgcatggcagccgggaaaaaggcattttgcggaaagcgcttgaaggactgcttcctgaagatattttgtaccgcaaaaaaagcccttatccgaaaacgcatcacccgaaatacacgcagggggtcacagaatggctgaaaacgattttacaacagaaagattccgtgcttcacaccctgcttgacagaaagaagctggaaatgctgctggagacagaaggttcatcttttcaggtgccgtggttcggccagctgatgaaaggcccgcagctgatcgcccatcttgcccagatccatacatggtttgaggcgtaccgtatcgatatagaagaataacagtgccgcgaccggtttccgctgaaggatatcggtctttttattgtgaaacatatggtacactaaaaaacagaggagtgataccatgaccgaatacgaaacatgcgcccatcttgccgaggtgcactttcctttatataaacggactttctcatccctgccgccaaaaaacaggcgggccgcatgggcggtgcttgctttgtttcacgaagctgatcggcttgatatgcaggaacttgggggatttgaacaggcggcacaagactttctgaacggggcacgcgccgacggctttttgtgggaggcgctcactgatgtgcggcagcaatttgcacttgaagaagagccgttgcgtgagtttatcgccggccacatctctgacagagaaaaagtaacgtatcaagagtttgatgacctgctgatgtacgcgggccaaacaggcggagccctcggcctgcttctgctgccggtttgcgcgcgccggaaccaagagaaactccgccatgcagccgtttcattaggagcagccattcagctgacccgggtgcttctgagggtccatacggatgagtggtcgaaaaagcgtctcccgcgccaggtgatgatgcaattcggctatacggaagaagagctggagagccataccgtcaacaaagcttttatgaatgtatgggagtacatcgcattcgaggccgaggcgtatttcgaggaggcgtctgaagagctggagctgtttccgttatactcaagacccgccgttaccggtttgctggcacattaccggtcagagctcggtgacatgagaaaacggctttcgcaggcataaaaaaacgcccggcttcttaacgaagctcggggcgtttatgcaatccctttttgaatccaaatccgcgaccgccatcttctgtacataagaatgcctctgacccattcatccgcgataaatgaaatccagatgcccataagccccaatccgaaatggatgccgaacagataagcgagaggcagtccgataccccacatggaaatcatcgccatgtagacggggaattttgcatctccggcagcccgcagcgagttgatgataatgacattaaatgaacggccgggctcaagaatgatcgtcatggcgatcagcatgctcgccgtcgcaataatgtcagggctgcttgtgaaaattccgatcagctgctttgaaaacaaggtcatgatcacggatgtcaaagcggcaatgccaagcgcccagtacagacttttcatgcagcggtcataagcgtcgtcaaaccgtttggcgccgatatatctgccgatcaaaatctgtgtgccctggctgatcgccgttccgaacagcaggataaacatggtgatgttttgtgtataaacctttgttgtaagcgcctgagcgcccataatggcgataaaataagtgacaaccatttgtgaaatgttataagacagctgttcgccggcagacggaatcccgattttcaggagtttccgcaagtgctctttatggacgtgaaaaatcttttgccatgtcagaccgagtccgatgcgttttttgacgatcacaatcatcgcgatgagcccgatgatccgcgcaaaggacgttgacatcgcaacaccggcgacgcctaacaccggaaggccgagcggcccgaaaatgacaagaaagtttccgccaatatttaaaatattcatcccgatcgtaacgaacatcgtatccttcgtatgaccgtagctttttaaaatggcgctgaacgtcataatcaaagcctgaatgaaggacagcccgccgaccacctgcaaaaagactttggcatccggcatcaattcattggaaagacccatcacatgaagcagcggaacggccgcaaaaaatatggcggcgctgatggcgagactgatgacaaagttcgctcctattgatacataagccacttcctgcgcctcttttttctgtttagatcctaaaaactgtgaaatcacaattgtcgtacccgttgcgataaagctgaacatcacgataattaaatttaaaatctgattgctgacacccacggccgccacactgttgtcagagtattggctaagcataagagtgtcggcgtttcccataaacatatataatgaaacctcaataaatatcggccaagtcagcgcgtataatgagagtttgtgatcagaggattgtttgaatgcagcccgttttaaaatcgcttgtttcatttcttttaacccctttcctgaaaaaatcaacgtttaaaagtgtacctccattttcttataataaaaagggagagaaacgaaacttcttgcaaaaatccgacttaaaaaggagggccggaaatatgtcctttctcgagttcacagtccctccgttcccggtctttatcgctgcgggagaaggagtgttcaaaaaaggcgaaacccatgtgagacgggtcttcccggtgtttgatctgctgtatgtgaaagaaggcgtcctctacattacagaagacgaaaacgccttttccgttgaagcgggagaatatattctgctttctcccgggcttgaacattacggaacaaaaggcagtgaagaaacgacatcctattcgtggcttcattttgaaggagcggattatgaggtgacggaaaccaccgggaacaactggtcggagctgaggcgaaaaaaagggagctttgaagagccgtcccgctaccgcttgtccctgccgcaaaaagggaaggtgagacgcccgcagtttatggccgggcaattcagtgtgctgacagatgaaagcgccgagaactccgacctgccgctcagaaagcagattctgtttgaagagctgctgctccatcttcagaaagaagcgttccaaatcccgtccgcaaaggaaagagtcgcatgggaggccgcccggtacctgcaggagcactatcaggagaaaacaaccatcaaagcgctctcttcggcacttcattacaaccaagactacgtgacccgctgcatgcagcaggtgctcggcgtcacgcccggccagtatacgaacaaagtcagaatgacggaggcgaaacgtcttttgtccgcaaccaatgacaaaatgggggcgatcgcggacgccatcggcatggaggacccaacctatttttccaaactgtttaaacagattgaaggcatttcgccgcttgaataccgcaaattcgtaagccggaaaacggactgacctaataccagagaacagaagagggatcggtaagcatgaaaatgacaatttacgacgtggccgaaaaagcgggcgtctccatctcgaccgtctcgcgggtcatcaacaatacggggaggatcagtgacaaaacccgccggatggtgctccgtgtcatggaggagatggactatcatccgaatgttcacgcatccgctttgacgggcaaaaagacgaatatgatcggcctgatcaccccggacatttcaaacccgtttttcggggaactggcgaaaagcattgaagacagcgccggtgtacttgggtttcatatcattatctgcagcaccgattatcagcctgaaaaagaaacgaagtatttttcgatgctgcggcagaagcaggcggacggcattatattcgcgacgggacttgatcatgatgacagcgtcacggcgcttgatgatattgtgaaatcgggcatcccgcttgcgatgattacgcaggataaaccgctcgcgccgatggacgtcgtcattatcgatgactttctcggcggctatacggcggctgagcatctcatatctttaggccatgaaagaatcgcctgtatcgtcggaaacggttcgaccacgggtgaaagagacagaatcaaaggttttcaaaaagcgctgcgggaagcggggatgacactagatgaatcgctgatcataccgacggaatattcgctggaaagcggaaaacaggcagcgggcgagctgtttgacagagaccttccgaccgccgttttcgcctttaatgatgtcttgtcatgtgcggcgatacaggcggcgcgctcccggggcattcgggtgccggaagacttgtccgtcatcggctttgacaataccattctcgctgaaatgacggcaccgccgctcacgacgatttctcagccgatccgcgaaatggggcggcgtgtcgttgaacttctcattgatgagattcaagggaagaaaaaaacaaaaagcaaaatcattttatctccggaactcgtcatcaggcattctacggcaccggtaaaaacgcgccctcagcgataaggcgcgtttttttctgtgaaaaacattgtcaaacgagcgaaaagcattgtaaaattaaaacagcttttgagaaagcgcttgcgcaaatactgcggattgcaagcaaagaaagcaaacagcttgagttgtaaataaagcgctttcaaaataatgatttctgtttaataagagaaaccgcttgcgccattacggcatgcggcctcaagaaaaaaggagcggtgatagatgacagatcaagtcaggtgtgcggtgctgggattaggacgattagggtattttcatgcgaagcatttagccggcgaagtgcggggagccgagcttgcggccgtctgtgacccgatgaaggggaaggcggaagcgtgtgcgaaagaattaggaatcgccaaatggacggagaatccgtatgaactgctggaagatctcacgattgacgccgtcatcattgtcacgccgacaagcacacatgcggaaatgatcatgaaggcggctgaaaacggcaagcacatctttgttgaaaagccgctcaccctgagtcttgaggaatcgataaaagtcatgaaaaaaatcgaagaaacggacgtcatctgccaggtcggttttatgaggcggtttgatccggcatacgccgacgcgaaaagaagaatcgacgccggggaaatcggcagacccatttattataaaggatttacaagagatcaaggcgcaccgcccgcggaatttatcaaacatagcggagggcttttcattgactgctcgattcatgattacgacatcgcgagatatctcatgaatgccgaggttacgtctgtcagcgggcacgggaggattttaaagcacccgttcatggaggagtgcggcgatgtcgatcaggcattaacatatcttgagtttgattcgggcgcggccggcgatgtggaggcaagccgaaattctccgtacggccatgacatccgcgcggaaattatcgggacggagggaagcattttagtcggcacgctgcggaaaagccatgtcaccattttaacggagtcaggcagcagctacgaaattattccggattttcaagcccgctttaaagacgcttaccgtctggagcttgagcactttgccgaatgtgtgaaaaaaggggaaacgccgattgtgacagacatcgatgccgcgattaacttaaaaatcgggatcgccgcgacggaatcttttaaaaccggaaggcctgtaaagcttaccccgggcgcccccggctatgccggattatgatagattcgaagtaaaaaagcaaaggcccggcatgcctttgcttttttataattcatatgagaaaaaaatgtagtcagtcggcacgcctttatagcccatttggtgaagcatcgcgcttatattgccgcgatggtatgtgccgtgattcacaatatgccggatcacatcggcatatgtcgtccgaagcgttcccatgcgcggatgagaaatggagatcgggccttccatgttctccgattctcttaaaaattcgctgtattctttgtccagttcagtcattctatgttcaatcgcctcaaaatctccgtcaagcttttcaaattgatcaaactgcgagacgatttgttcgtaagtttctctgtaaagcacgtgaagccaagtgtaatcagcccggcatatatgcacaagcacggcgttcaaagtcggaaaaacactatccagttcctgctgtaagcttgccgcgggcagggtcttcagatgctgaataacttgctcattggcccatctatggtagtgatacagctttaaaatgtctgacattccaattccccctcttccttccggtacattcaacatgacctggccgaattccttttatcgaaacaaaagcgccgcaaaataaaaagcagcaccccacatcaccaatgccgagcattgattcaggatgccggggagccggccgcctgtatccgcggtttcgtttaataaaaaatcacgtcacgatggcgccgagcgcttctgcgaatgtaacggcatgagacggagagatgcggcatcctttcagcttatcaagcgagacgtgcagatgatcaaatgtgcacgtgctgatatccatattaaaaagagacgtgccgatgaagtttgcgccgttcaaatcacagacgtcaagatctgtgtattcaagaacagcatcattccactcactttctgaaaggccgcacgagtcaaaacggacatgcttcatattggaatagctgaaggagctgtaatttgcgaggcagtcttcaaaccgtacatgacgcatggcggaatccgccagattcaagccgagaagttttgaatgctgaaacgccgttctatggatgatgcttccgctgaaatcagcgtttgagacatcgcatttgtcaaacaggacatccgtacattccatatgtctgaaagagacatccgtaaaaacggtgtttctgaaaatgactttttcggcgcgcaggccgtccagtttgccgtttacgatgccgttttcaatgatgacttctttgagctcctcatcctgaagcgcttcagtgaaagaaagcaccggcaattctttcgggattttcggtttttggatcgtattcatctcatactcccttttctaaacataatagctgaaatcggcaattggcagatatcgttttcgcccctgcccacccttgccgaattgcgtgttgtttactgaacaaaggttaatatcaaagcgggatcgcgtcaatagcggcgcttataaaagcttcattccgtttgaacgtcatccggcacgccgaaagataacaaaacaaagcccttataagagatgccacgggcttttgcctgtttcaggcgagttctttatacatgatcacatgcgggccgatgccgggtatgtcaaaggggctgcccgtgcttttccagccgagcttttcgtaatatcccttcacgtgacatctggcgttgcaccagacaagcgccgcccccatatctgccagttttcgttccgcataggcgattaacgtgcttcccgctttttgcgtccggtattcttcaagcgttgccatgccgcgcagctggtaggcgggcgccgcctgtaaagcctgctggttctgcgggtagaaagaagcgatgctgatcaatgtcccgtcgtaaaaacctccgagatgaaatgctcctttgacgctgtcctgatcatatttacaatcctcaatcgtctgatgggggcgcagcacgctgtgtctgatcgcgtatgtgtcttctgcggtgatgggttttacttcaaccatgaaaaaatcctcctttgcttgattctttttctgtatcgtaccatgaaaaagccgcctgtcgtatcaggcggcatcttccgcgtcaatgcaaatatacatcagcccgcttttcatccttttgcttaatataagctgcaagttctgatgtcaaatcagaacggagaaacggggtgattaaataaattccgttaaacagttcgcacgccgtgtcgagaagcgacttggcgatggcgaggccttcggctttctgcttttgcttgtcttcgccggcgagcgccattttttcccggatgctgtctgacagcttaatgcccgggatttcatgatgaataaactctgcgttgcggctgctcgttaacggcataattccgatatacaccggtgttttgagatgtttcgtttcatgatgaatgtcaatgagctgctgctccgagtagacaggctgggacacgaagtagtcagctccgcactcgatttttttctccagccgttttaccgctttatcaagatggcggacattcggattaaatgctccggctacggaaaagttcgttttcttgccgagcggtttccctgataaagaaatgccttcgttgaattgtttaatcagcctgatcaagtcaaaggacgttaaatcatagacggaggtagcccccggaaagtcgccgatttttgaaggatcgcccgtgatggctaaaatgtcggtaagcccgagcgtatccagccccattaaatgtgactgaaggccgatgatgttgcggtctctgcatgtaatgtgaacgagagaacggatatcaaggcgttctttcagcaatgaaccgcaggcggcattgctgatccgcggtgtcgccaatgaattgtcggcgagcgtcagcgcttctatgccggtttcttttaattcagccgccgcttgcagaaatttgtcaaaattcaattttttcggcggatcaagctctacgataattgaccgtttttgagcggcgatttcgtttaaacccggctcggtccgttcattccggacggagatgacttcttcttcccgtctgattttcacttctttatcagtgacgggggaaagtccgcggaccgcttcagccatggctctgatatggtttggcgtcgtaccgcagcagccgccgataatgcgcgcgccctgagtgcggaactgtacggcgctctcccggaaataggcatcgtccgtatcataaacaagccggccttcttctaaagacgggaggctgctgttcggatagaccgataaataagtgtcacggaatatcggcacttcggtgagcgcttcaatcatgtggtacgggccgagccggcaattgattcccgttatgtcagcgccgagatcggcaattgacctgagggcttcccgaagcggcgttccgtcctgcagcacgccctgttcgtgcatggatacattcagcataatcggaagttccgtttcttttctcgctatcttcagcacttcgcgcgcctcttctaaatcatagtatgtttccaggagcagaccgtccggctcttcgtgaagcaataaataaagctgctcccgaaagctgcgtttaatctcctccaggctgtaggcgtttttgttaaatgtgcggatgccgcccatcgttcccaatacataagcgccgtctgaggaagcgcgcgcgattctgaccgcctcctgattgatttttttcgtttcatcctcaagtccgtatcttgagagcttaataaaattcgcgccgtacgtatttgtctggatgatgtctgccccggcttccacgtaagccttatgtatccgcttgatttcctcgggctttgatacgttcagttcctcaaaacatctgtcaatgccgtaggaatagaggagagtgcccatcgcgccgtctccgattaaaatccgttcttttaagtcttgtaatagtcccattgtttgcctccttcgtcacattcagcaaggaaaaaagagaaataaaaaaagtcttcttaagaagaagactctgtaatcatttgtctctcttcttatcttccaagctgtttttagcttgctggatttagcaccttggtcatggtttgggttaaaccattacaccggttgctgaagcgtcgtcgggccagtccctcggcttctcttgataagaacgttcatgtaattgtcatgggtttccaaaacttaactgtgaaaatccctttctccaaatttaccgaaaatagagacaataatcaataggaatcacataatttatctaaaattaataaattgaacgtcaatcggcaggtctgccccgcggacggctgcaataatctgctgcagatcatctttattttttccggtgacgcgcacttggtcgtcctgaatctgcgactttaccttcaagccggagtttttaatcaccgcgttgatttttttggcgctgtctttatcaatgccctgtacaagcttcgcgcgctggcgcaccgtgccccctgaggcattttcgattttgccgtattcaatgttttttgtcggcacgtcccgtttgatcagcttgccgctcagcacatctttgagctgattcagtttaaactcgtcatcagaaatcaggacaagttcttccttttctaaagttacatcgcttttagatcctttaaagtcatagcgcgtgccgatttctttcagcgtcatctgaatcgcattctgcacttcgggaaattcaactttggatacaatatcaaaagaactttcttttgccatgagaaaacctcctataacatttcacttatgagttgattatagtagaataaagagaaatgtccaactgcataaagcatgaatttatgcatattggaaaaaatgagaaaaacatcagccccatacgggcgaatcaggaaggacgataacatgagaccagggcagcagctcacgcttagtatagatcaccaaaccgatttcggttattttttaaccgacggcgaggatacggttcttttacataacagtgaaattacagaggatattgaagacagagatgaagtggacgtatttatttacgtcgatcatcaggaaagactcgcggcgacgatgaaaaagccgctcatcagcttttatgactacggatgggtggaagtgacggacgctgtggaggatatgggcgtattcgtcgacgtcggtctgtcaaaagacgcgctcgtcgcaacggagcacctgcctccgtacaaatccgtctggccgcaaaaaggcgacagactgtattgcatgctgaaggtgacaagccgcggacgcatgtttgccaagccggcgcctgaggatatcatcagtgaattatttacggatgcagaggaagacgtcatgaataaagacctgacaggcacggtgtacagactgatcgcatcaggctcttttctgattaccgatgaaggcatccgcgcgtttattcacccttcagaaagaaaagaagagccgagactcggcagccgcgtgacggggcgtgtcatcgaggtgaaggaagacggctccgtcaacatgtccctgctgccgagaaagcaggatgcgctttcggttgacgcggaggagattctgacctatctgagatcaagaaacggcgcgatgccttacggagacaaaagcgatcctgacgatatccgcgaacggtttcatttaagcaaagccgcctttaagcgggcgctcgggcacctgatgaaaaacggcaaagtgtatcagaaagacggctggacatacgaaaaacaataaattttctgcaaaaacatcggtgaaccaaaaccggtgttttttattttctcaaaagctcctatgccctcatttgtttatcaacctgccgaacatacatattttattgaaataaaatattctgacatccgaaccgatatataactatagaaaaaaacaaaaggagagtttcaatgagaaaaatggcgatatttgcggctgtactgctgcttgcgctcagcacggcgggatgtgccggcaaatccgagggggcggcggctgaaaaaacgaaaacaatcggcatcatgctgacagacaacggcctcggcgaccaatcatttaatgattcaggctttcaaggtttgatgaaagcaagagacgagctcggcatcacatttgattacagagaaataaaagacaccggtacgtacgaaaaaggactgacccagcttgtccgggaaggcaatgatcttgttgtggggctcggttacagcatgcaggcggatttagaaaaggtcgccaaaaaatatccgaagcagcggtttgtgctgattgattctgtatcagacctggataatgtcacctccgtcacgtttaaagaggatgaaggaggcttcttagccggagcgctcgcggctatgacgagcaaaaccggcacgatcggatttatcggcggttcagatgccgacgtcattaaacggtttaagaaaggctacctgaaaggcgcggaatcagtcaaaccgaacatccgcgtgctgtcggaaatcagcggtacgtttgatgatgataagctcgggaagcgcatcgcccaaaacatgatccgaagaaaagccgatgtcctgtttacggcggccggcttcacgggtgtcggcgcactgaaagaagcggaggcgcgaaaagtatacgccatcggtgttgacagcgatcaatattacaccgccgagcacgccgttatctcttctttagtgaaaaacgtcgaccatgtcatctatgaattggcgaaagatttaaaagacaacaaggagatcaaaagcggtgagatcgtttacggactgaaggaaaacggcatggacttagccaagatcagagttgtcaaaaacgcaggcgggctgacgaaaaagatcacggatatgaaaaacagtctgattgaaaaaggaggcgatctgaagtgacattacggacaaggctgctcgttaacgcagccgttacgatgatttgcttcgccgccgtcatcggctttaccatcgtaaacatgatgaagattcaggcttcaaatgaagatgaagtggacgcgctgttaaacgtccaggaagcaaaagccgaccttaatacgttaaaagaaagcatcaccggctattcctatacgctcgcagacgcccagaaagaagatgtacaaagctatatgaaaagcagctcggataaactggcggcgctcaaaaaaacgatgacggacgatgcggacaaagccgctaagcatgcggcaggcatcagtatgatggcgcagaccgtttccgacattgcgggccagaccaatctgctgtccttaaacgccgcaatcgaggcggccagagcaggcgaggccggaaaaggatttgccgtcgttgccgaggagatacggaagctcgcagacggatcagccaaagcgaccgcgcagattttcgatatggtaaagcaaattgaagacggcatcacatctattaccggagctgtcacgaccggcgtcgctttagcggacagacagcaggagctgatggagaaaacgtcagaatcattcgcccatattgaacaaaaagccgcccatattaaggcggagcttactcaattggacggacggatcatcgaatcgaaacagcttggtgagcaagtgctgcatcatgccgaaagcatcagcgccgtcgttcaggaaacggctgcaggaagcgaagagatttctgcctccgcgcttgagcagctgtcttcttttcataaaatggcggaaagcgtcaataatctggtgagcctgacagagcggttaaacgatcaggtccgccggtttactttgtaacagacatccgtgcgcaaaaaacagccctctttctcctaagacaagagggctgttttgcttttacagatggtccggttttttggaattctggttttttcccgcctgccggtttttttcggcaagccggttctttttctggtttacggcgttattgtccaacggttttttgtcatcatctttcatgcggcaaagcctcccttctgtccgttaggatgcccgcccgcattgaaattatggcttcaggaaaaaaatcgcgagcgtgcccggcccggagtgggcgccgatcgcagagccgattgaatgaagaatgatttctttcggatggaacgcttcttcaatcatttccttcatcccaatcgccgtctcttcattatctgcatagctgattcccacggtttgatccgcccaatcgccgccttcttccttcatcatttctataatccgtttaaacagtttcttctgtccgcgcaatttttcgagcggcacgagcctgccgtcatccacatgcagaatcggtttgatgttcaaaagccccccgacaaaagcggacgtttttgaaattctgccgccccgtgcgagataggcgacgtcatcgaccgtaaatatatgtttcatccgtgcgcaaaagttctttacagacgtttcgatttcttgtattgtattcccgttaacacagagtgtttgcgcgtgcatcaccgcgaggccgcagcccaatgaagcgcatttggaatctacaatccgtaaatcaaaatcgggaaattcctcttttacttcattggcgatcattacggccgtctgataggtgccggaaagacctgaggaaaaggcgatgtatatcgccggttctcccagttccgcgtattgtaaaaatactttttttatcgtatccggtgatgcctgggatgttttcggaactttcccttcccgcatcgcttgaaagatatgatccgcctgaatggtgaccgcgtcctcatattcgtttccgtcaagtgttacgtgcagcggaatgaacccgatccggttttcttcaatataagatttcggcaggtcagaggcgctgtcagcaataaggtgaactgtcatcataattcccttctttccggttggtgagagtgatgccaactatatcatataaatttggcaaaatagtgttcaaaactttattttaagggaaaagctaataatgaaaatgagcggaggagcaagccatggtactagaacaagtaaaaaaattagcaatcgtcgtcatcggcgcgtttctgtatgcggcgggactgaatttattcctgataccggcaaatgtatattccagcggttttaccggtgtcgcccagctgctgtcaagcgtcgttgatcaatacgcccccttttatatttcgacaggagttctcatgttcctcttaaacattcccatcggtgtgttagggtggctgaaagtcggcagatcattcaccgtatacagcatattaagcgtagcgctgacgtccgtctttatggggattctcccggaaatgagactgtcacacgatattcttctgaataccgtattcggaggagtcatctcagctatcggcatcggtttaacgctgaaattcggcgcttcgacaggcggtcttgatatcgtgtcgatggtgctggccaaatggaaggataaaccggtcggcacatatttcttcattttgaacgggattatcattttgacggcaggattattgcaaggatgggagaaagcattatatacccttgtcgctctgtatgtcacaacaagggtgattgacgccattcacacgcgccacatgaaactgaccgccatgatcgttacaaaaaaagctgatgaaatcaaagaagcgatttacgggaaaatggtccgaggcattacgacggtgccggcaaaaggcgcttacacaaacgaacagaaagaaatgatgatcatcgtcatcacgcggtacgaattgtatgaccttgagaaaatcgtgaaagaagtcgacccgaaagccttcacaaacatcgtgcaaacgacggggatctttggtttcttcagaaaagactgataggagcggatagaatgaagtggctgtttggcctgttattaccggtcattttattgatcggatgcagcagtcaatccgggcagaaggagcccgctgaggaggtatccggagagatgaatgaacagcaagcggaattagccgtaaatcctgtgcagacagatcagcagatcgaatttcaaatgtctttaaaaaacaaaagcgaaagcccgatcgatttcacattcagctcagggcagaaattcgaactgaccgtacatgaccaacatcacaaagaactgtaccgctattcaaaagacaaaatgtttacccaggcgtttcagaccgtgaccttaatgccgaatgaaacgtatgacttttcagatgtgtggaagaacgtgcccggtccgggaacatacacggtgacggtgacgtttttagggaagtccgatcagatcggaaaaagactgaaaacggtaaaaacatttgaagtaatataaaaaagcggcgccctcatctaaacggggcgcctttttttattgcaatttctccagctgatcctgaaattggtgcagctgctgacgttctgcatccgtcgaattggcgtacgcggaagacacggcatttttggcgcgtgagacagctttttcctggtcgccgtcctcgaaaccgttagcaatcatgacggcctgctggacaaatgacttggcttgagaaaacagttcgtttctcattaaaagtcaacctgcctttcagccgaatcttttgctgcatcatgctgtgcttcctctaatgtagaccgatatggaaatcttgcgtcatgaagactgacagagtccttgccttgctgaataaaccgttttgatttgtttcgtttacccattgcaatgtcccccttccatatttagacgagatgagtcgtctgttttagtatgggcggaaggctttgtgttatgagcgggaaaacctcacagggagaaataggattttaaaaattcggcgattccgtccgcttcatttgaacccgtgacgcgatcggcggcctgtttgacttcatccgtgccgtttcccatcgctacgccgcacccggcaaatcggagcatttcaagatcgttgtcttcgtcgccgaacgcgatgatccgttctctcggcacttggtaatagtcgctgattttcttcaggccgaccgctttattcatcccgtgtttaataatttcaatcacatgccaaggagccgcccatcttctgtggtcaatgacctcggcgtgcacatcggataaatgcgcgcgtatgtccgcgacgtcctcttccttcgcgtgaatcaatacggacgtcacatcctcttggaccgtttcgcgcagatcgccgaatgtgacattcgccgtattcatatgaaacgcctcaattaaatgctcatcatgataatggaagtacacatcatcaatgatctcagcgagcacattatgtatttggtaggtctctgtaagttcggcaagctgtctgaccacatcgacagataaagacgtgtggtatcgtccccatgactcgtctttcgggtggtggacaaacgctccgttaaaattgacaatcggcgttgtcagcccaagctcgtcataatacatcgaactggaacggaaagggcggccggttgagatgcagacatgatggcccgcttctttcagcgtctgaatcgtccgtgccgtttcaggggaaatggttttatcatcttttaataaggttccatccagatctaaggcgatgaggtaaggttttgtctccataaataactccttttgtcatataatttgctgtttttctcttatgtacagtgtagctttttaccatctttattgtctacatgttacacttatgattatggttatcctaaggagggagtcaacgtgattcttattgatcatcaaaccgtatcaggcattccgtttttacatattgtaaaagaagaaaatcgggaccgtcccgctccccttgttttctttattcacggttttacaagcgcgaaggagcataatcttcatttcgcttacctgcttgctgaaaagggtttcagagccgtgctgccggaagctctttaccacggtgaacgcgctgaacagctgtcagcagaagagctcgccgtccatttttgggacattgtcttaaatgaaatcgaggagcttgacgtgctgaaaaaggattttgaagggcgcggtctgattgaagacgggcggatcggtcttgcggggacgtcaatgggcggaattacgacattcggcgcgatggctgcgtatgattgggtcaaagccggcgtcagtctgatgggaagtccgaactatacggcattttttcagcagcagattgaccacattcaaaagaaggacatcgacattgacgtcacaaaagaacaggtcgatgaactgtttgcgcggctcaaaccgttcgatctcagtctggaaccggaaaaactccgcagccgcccgctgctgttctggcacggcgttcaagacaaagtcgttccgtatgcaccgacccgcggcttttatgaaacgattaaacctcattacagcagccggcccgaccatcttcagtttctgaaagacgaacgggctgatcataaagtcccgagatacgccgttttagaaaccgtcgcctggttcgataagcatttataaagcacaaaggtgttaacaaaagccgcttttgcgttatactgaggaaaaaggagtgatggaacgtggaagaagcattaaaagaaaacatcatgggcgccttggagcaggttgttgaccctgagctcggcgtcgatatcgtcaatctcggccttgtatacgacgttgatatggatgacgacggcctgacgcacgttacgatgacactgacatcaatggggtgcccgctcgctccgatcatcgtcgacgaggtgaaaaaagcgctcgccgacattccggatgtaaaagagacggaggtccacatcgtctggaatccgccgtggacaagagacaaaatgtcacgctacgcaaaaatcgcattagggattcagtaataagaaaatgcaccccggattttaggtacatcctaaagtttggaggtgcttttcttttgtctgcatataagcgacagtgagggcttgttttggattgcaaacaaacctttatatataaaatttcatatgaggtttatcttttttgtaataggacagtctgtcttggagtgtacctgtgcggaattcaaatttatgtccatcgggatcagtaaaataaattgacttttgatcttgcttatccctaggacgcccatttaatatatttacatttagattttttaacctttgaagtattgcatcaaaatcttttgggtcaattgtaaaggccgtatgcgtataggatttatgtatttcatttcttggtatatccgcctctaagttaagtgcaagccaaagcccgttcagatcaaaatatgctgttttttgccctttaaccagaagttgtgcatgaaatactttctcataaaattctatagatttttccaaatctgaaacagaaaaaagaagatgattgatcccttttatgttcattttccccacctcatttaacatctttgttttaaacaatccctttggtaatacatctgcatatatatcgattatatactgactaaaaaatcatttttagggatttctgtgtattttttatgcctggtgttttccggatgaccgttttgaactgtactaaacatgattctgccggacgcgtctgctttgtcgctgcagaccggcgtgcggaaagaagggcaagtcactaaaaaaaacaagtttcccgccattcggggttttttgcggtatcgggttaaaaaggaaaaaaacggacggaggcatgatataatagaccggctgcatgcgagggaggaacccatgaagaaaaaattacttctcattatccttagcattcttgtttatacggcgctgttcgctgtttccgcctttcacaaagagccggagcggcaggcagggacaatgacggatgtaagccgtctcatgcccgtgaaaattaagcagacggtcaaaggaaaagagaaagaaacattggtcgaaacgattaaggaagcaaagagaaagcatttgaagatctcaatcgcaggcgcccagcactcaatgggcggccagacgtattatgaagacggcatcgttctcgacatgacgggctacaacaaaatactcggtctcgaccgaaagaaaaaaatcatcagagtgcaggcgggagcgacgtggaatgatattcagcgctatgtcaatccgtacgggctcgcggtaaaagtcatgcaatcgcaaaacatttttacgatcgggggctcactgagcgccaacgcccacggccgggatatccggtacggttcgctgattgatacggtcaaatcgtttcatcttttaaaggcggacggcaaagtcatcaccgttactccgaaagatgacctgttttcagccgtcatcggcggctacggcctgttcggcgtcatccttgacgcggatattgagctgacggatgatgagctttatgaaatgaaaacgaaacgcatgaacgctgatacatacagtcaatattttacgcagcatgttcagcgcaaccccgccgtgcgcatgcatctcgcgcggatcgcaacaggggataaaggctttttgcacgatatgtatgtgactgattacacactctcagacaaccagaaagaattaaagcggcacaatgaactgaaagaagatgagcatccggcgctgacgaaattcgcgctcggcctctcccgccggtatgactggggaagaaattggttctggtcaacccagcagtcttattttctcagtcaaaacggcgtgaaagtctccaggaacaatgtcatgcggtcagaatcgaaatttttggaatatgaaaacacggacaacaccgacgtgcttcaagaatacttcgtgcccgtcggcgaatttgcaccgtacattcatgatttacgcaagacgctgtcacatgaagatctcaatctcgtaaatattacgatccgctacgtgcaaaaaaatgaaaaagccgatctgtcatacgcaaaggaagacatgttttcactcgttcttttaatcaatgaagggttttcaaaagacagccaggcgagtgcagcgcggattgtcagaaaaatgacggatacggcgttgcgccaccgcggcagctattatctgccgtatatgctgtatcaaacgaaagagcagatgcgcgaggcatatccgaaaagcgatatgttctttcagaaaaaacacaaatatgatcccgatgacttgtttatgaattatttttatcagaggtacaaatcatgaaacacaaccatttaaaatggctgatcctgtctcagagcagtgtcttttttgccggcagcctgatctttccgttttatattttatttattaaaaacatcggttccagctacactcaattcggtctatcatacggcttgttcggcctgagcggcgcattgattcatccgctgctcggccggctgtcggcaagactggatccccgctggttcctgatggcgaattcgtgggggatggcggtgcttcttctgacgctcccgcacattaccggcgtgcaccaggtttatgtggtgcaggtgcttttgggcctgttcggcgccatgcaaaaacacggcgagaaaatcatgatcgccgattacactgacggcggggagcgggggaaaaaagtcggcagctatcatttctggacggccgtattttcagctgccgccattattctcggcgggtttctcgctgatttcttcacggtttatattattttttacgccagctccgtgctgttttttataagcgggctgatgatgctgaaaaaaacaggctgatccgatcagcctgtttttcttatgaaaccccctcgatcgagagggggtttttgtcagcgaaaaccgatggaaaatgaatgaaaaaatattaaatatacaattgaattaatttttattcatgttataatgttaaataatttcacaaaaaccaagaaggtgaacccgttgaaaataggtattataggcgcgactggttatggaggcgccgaacttgtcaggattcttaaccatcacccttatgcagaagattgtatattatattcatcgagcgacgaaggaaaagaatatgccgcttcatatccgcatttgaggaatatagcgtcacaatcacttcagccgcttcatatagaaacgattcgaaacgaaattgatgtcatgtttatagccgcgccgcccggcgtttccggagagtggtcgcccaagctggcggaggcgggcatcccggtcattgatctatccggcgatctgcggattcaaaacccggccgtgtatgaaaagtggtataagcggaaggccgcgccgaaaggaacgattcaaagcgcggtttacggtttagccgaactgcaaaaagaagagattcagactgctaagctgattgccaatccgggatgttttccgacggctgtgctgctcgggctcgccccgctggcgaagaataagcttttacaagattcttttctgattgttgatgcgaaaacaggcgtatccggtgccggccgaaaagcatccatgggcactcattattctgagctgaatgataattttaaaatttataaggttaatgagcatcagcatactccggaaattgaacagcaattagcggcttggcagcccggcacaggtccgatcacgttttccgcacatttggcgccgatgacaaggggcattatggcgacgatatatacggaggctccccctggtatgtctgctgcacaggtaagagaattgtattccgaattctacaaagattcatattttgtcagaatcaggccggaaggtgaatttccggcgacgaaagaggtatacggcagcaatttttgtgatatcagtgtcaccgtggatgaaagaacaaaccgtgccaccatcgtttctgtcatagataatctgatgaaaggcgccgcagggcaggcggttcaaaatttaaatatcatgaatggctggcaggaagaaacgggacttacgatgacgccagtctatccatagaacgaaagagggattcgaaaatatgattcagctgagtgaggaaatcacgaaagtaaaaggcggcgtatcttcgccgaaagggtttgaggcaaagggcgtgcactgcggtctgcgctattcaaaaaaagatctcggagcgattatcagcgaagcgcctgcagtcagtgcggcggtatatacgcaaagccattttcaggcagcgcccttgaaagtgacgcaagagagcttaaaaaaagaggccgtgcttcaggcggttatcgtcaacagcgcgattgccaacgcctgtacgggagaccaaggattaaaggacgcctatgaaatgcgggacggcttcgcgagccagctcggcattgagccggagcttgttgcggtttcgtcaaccggggtgatcggcgagcttttagacatgaaaaaaattcaggcgggcattgaacagctcggtcaagcgccgtcagtgtccggagcatttgaagaagccattttgacgacggatacagtgacgaaacagacgtgttatgaactggtgatcggcggaaacatcatcacgatcggcggagcggcgaaaggctccggcatgatccaccccaacatggcgacaatgctcggctttgtcacaacggacgcggccgtggaagaacagtcgctcaaaaatgcgctcagagagattacggatgtttcatttaaccaaatcaccgttgacggagaaacatcgacgaatgacatggtgcttgtgatggcgaacggctgcgcggggaatgattgcctgacggagcagcaccctgactggccggcatttaaaaaggggttaaagcttgtatgcgaagaccttgccaaagatattgccagagacggtgaaggagcgacgaaattaattgaagccagagtcgaaggcgcgaaaaataaccttgaggcgaatattatcgccaaaaaaatcgtcggctcaagccttgtgaagaccgccgtttacggcacagacgccaactgggggcgcatcatcggcgccatcgggcacagtgcggcaagcgtaacggccgaacaagtggaagttttcctcggcggtcagtgtctgtttaaacacaacgaacctcagccgttttcggaaactgatgccaaggagtacttatcaggtgatgaaattacgattgcagtccgcctgcaggaaggctccggcagcggccgggcatggggctgtgacttaacctatgattatatcaaaatcaatgcgagctatcgcacatagcaaaggggagcggcatgaagaaaaccatcgtttttaagtgcggcggcagtgtaatccgcgagttatccgccgatttttttcaaaatgtaaaagagcttatgcaatcgggctggaaccttgccgtcgtgcatggaggaggcccggacatttcaagaatgctgaaaacattgcagattgaaacggaatttgtcgatggacagcggaaaacgaccaaaccggtgctggaaacagcggaaatggtcttgtcagggacgatcaataaatttttcgtaaccgaactcgcgaaaaacgggctgaaagccgcgggaatatcaggaaaggacggcggtctccttcaagcgtcttaccttaatcaagacaaatacggagaagtcggcgaaatacaaaaaaccgatccgtcaatcatccacgcattaatgaaagaaggcatcattcccgttatcgctccgctttccatgacaagtgatttcgaaacgctgaacgtcaacgcagacgccgcggcatcggccgtcgcttcagccttacacgccgataaacttttatttgtcacggatgtcgaaggaattatggacggagagaacaggctggatactttgacgccgcaagaaattcaggccctcatcgatgacggcgtaatttcaggggggatgattccgaaggtaaactcggcattatcggcactgagtgaagatgtcgaggaagtgatgatcgtaaacggaaaaggagcgtttttcaccaatcaagtcttccaaggaacaaaaatcgttaaagaaaaggagagcgtgtcatgagcagcctatttcaaacctacagccgctggcctatcgatattaaaaaagcgaaagggacaatcgcagaggatgaaaacggaaaaacgtatctcgattttattcagggcatcgccgtttccaatctcggccattgtcatgatgcggtgacggaagcggtgaaagaacagcttggcagcgtatggcacgtttccaatctgtttgaaaatgatcttcaggaaaaagccgcggcaaagcttgccggacatagcgcgggggatctcgttttcttctgcaacagcggagccgaagcgaatgaaggcgccattaagcttgcccgtaaagcaacgggaaagacaaaaatcgtaacatttcatcaatcctttcacggacggacctatgcggggatggccgccaccggacaagacaaaatcaagaccggtttcggaccgatgctccaaggctttcactatcttccgtttaatgacccgtcggcattcagcacactttcaaaagaggatgatatcgccgccgtcatgcttgagacggtgcagggagaagggggagtcaatcccgccgatccggaattcatcgaagccttacagacattttgcaaagacaaacaggcgctgcttatcgcagacgagattcaaaccggaatcggccggacgggcaaggcattcggctatgagcacttcggcatctctccggacatcatcactgctgcgaaagggcttggaaacggttttcccgtcggagccgtgatcggcaaaaagaagcttgccgacgcctttacgccgggtacgcatggtacgactttcggcggtaataagctcgccatggcagctgtgaaagcaactttggacattgtgtttcagccggactttctccaggcggcggcagacaaaggctcttttttaaaagcgcagctgaaccgtgaactgacagggccttttgtaaaagaaatccgcggaaaagggttattaatcggcattgaatgcgcaggtcccgtgtccggcatcatcggagatctgcaggaacgcgggcttctcgtgcttccggccggaccgaatgtcatcaggctgcttccgccgcttacggtttctgaagaagaaatgctgtcggccgtcagtatgctgaaagcagcgatcgaagcgcattcggcagtgaaacggtaatttttttcgatataaaggtataaaaattcatatttttaattaattattcatcaagaggtgggctttagatgaaaggctatttagtattggaagacggaacatcattcggcggtgaacttgaaaaagaggcttgctgtgttggcgaagctgtttttttcaccggaatgacgggctatcaggaagtgcttacagacccgtcatataaggggcagatcatcgtctttacgtatccgctgatcggaaactacggaattaatgaaaaagaccttgaaagtaaaattccacaagtcaaggctgttgccgtctatgaagcgtgtgaacatttttctcaccatgaagcagtctcaagcttgagagagtatttaaataaatggaacatcccgctcttaaccgaagtggacacacgggccgtcgtcaaagccatccgctccggcggcacgatgaacgctgctgtgtcaacagcaggagaaattcccgcagcatccggaacacaaaatccggcggagctggcgcagtctgaagacatcacttcaatggggaacggagaccggcatattgcgctgattgatttcggttataaaaaatcaatcgcctcgtcacttgtaaagcgcggctgtaaagtaacggtcattccgtatcagcagatggatgccgtttatgacattcagcctgacggaatcgtgctctcaaacggcccgggcgacccgaaagcgattgcgccgtacatgaaccggattacatctttactcagtgatttccctgcactcggcatttgcctcgggcatcagctgattgccctggctttcggaggaaatacgtataagctgccgttcggccacaggggtgccaaccatcccgtcattgaccggaaaacgaaaagggtgtttatgacaagccagaaccacagctatgtcgtcgatgaagcgtcaattgacgaaaacgagctgtccatcagatttcaccatgtcaatgatacatcagtggaagggctcattcataagcgccttcccgtattaagcgtccagttccaccctgaagctcatcccggtccggctgagagcgagtggatatttgatgaatttctagagaaagtgataccagcaaggagagaaatcgctcatgcctaaagatacaaccatttccagcatattagtcatcggctccggccccatcatcatcggccaggcggctgaatttgattattcaggaacgcagggctgcatggctctgaaagaagaaggataccgcgttattctagtcaataacaacccggcaacgattatgacggatgaggcgtttgccgatgaaatatattttgaaccgctcacaaccgacagcatcgaggccattattgaaaaagaaaagcccgacggtctgcttgccaatttgggcggccagacggcattgaatttagccgttaaacttgaagaagcaggcgtgctgaagaagcatcacgtcaagctcttaggaacatcggtggaaaccattcaaaaaggcgaagaccgggagcagttccgcgccctgatgaaagagctcgaccagcccgttccggaaagcgaaatcgtcgacaacgaagaagacgccctccgcttcgctgagtctatcggatttccggttattctgagaccggcgtacacattaggcggaaagggaggcggaatcgcgaaaacgaaagaatcgtttcagacgcttattaaacaggcgctgttagcaagcccgatcagccaatgcctcgtcgaaaaaagcatcgccggatttaaagaaatcgaatatgaggtcatgcgcgacagcaatcatacatgcatcaccgtctgcaatatggaaaacatcgatcccgtcggcgtgcatacaggagactctatcgtcgtcgcaccgtcccagacgttaacggatgaagaatatcagatgctgcgttccgcaagcctggcgattatttcggcgctggatgtggtcggcggctgcaacattcaatttgcgctggatccgttcagcaaacagtactatgtcattgaagtgaacccgcgtgtcagccgttcatcggccctcgcgtcaaaagcgaccggctacccgattgccaaaatggcggcgaaacttgccgtcggctatacgctcgacgaactgaaaaatccgctgacgggctctacttatgcaagctttgaaccggcgcttgattatgtcatcgtcaaattcccgcgctggccgtttgataaatttaaacatgccgaccgcacgctcggaacgaagatgaaagcgacgggagaggtcatggcgatcgaaagaaatatggaagcggccattcaaaaagcggcggcctcccttgagctgaaaacgatcggcacccgcctgcctgaactcggcggctgtacgatcaatcagctgtgggaattagcggtaacgccggatgaccggagatttttcgtcgtcatggaactgttaagccgcggtgaaacgatagaagatatccatgccaaaacgaaaattgacccgttttttctccatgtattccgaaatatcatcacattagaaaacaagctgatggaagaaggggatcatctgtctgtcccgcttttaaagcaggcgaaggtaaaaggcttcacggatgtcatgatcgcatctctcacgggaaaaacggaagaagacatccgtgctctcagaaagaaatcaggcatcgtcccgtcgtttaaaatcgtagatacatgcgccgctgaatttgatgccaagacgaattatttctactccacctaccttggggaaagcgacggagatgtcagccgaaaagagaaaaaacgcgctctcatcatcggctcaggcccgatccgcatcggtcagggagtggaatttgattacagcgccgtccacggcgttctgaccctgcaaaagctgggatatgaaacgattatgatcaataacaatccggaaacagtaagcacggattatgaaatcgccgaccggctttattttgaaccgctgacgacagaacatattttaaacgtggcggaacatgaaaacattgattttgccatcgtccagtttgggggacagaccgcgatcaatgccgctgaaccgctggaaaaagcgggcattccgctgctcggaacatcctttgaaacccttgatgcgctggaggatcgggatctgttttatcagctgcttgatgatcttgacctcaaacatgccaaaggcgaaacggcttattcaaaagaagaagcaactgaaaaagcaagccgaatcggctaccccgtgctgatccgtccgtcttatgtcatcgggggatgggcatgatcatcgttcattcagaagcgcaaatgtcagagctcctggaaaaagaagcgggcatgccgtacccgattttgatcgatcagtacattacaggaaaagaattggagatcgatctgatttccgacggacatgaagtattcgtgccgacttacacagagcacattgaacgggccggcgtccattcgggcgacagttttgcgattcttccgggtccgtctgtcacacctgatatgcagcggaatataaaagaggccgccgaaaaaatcgcggtaaaactggcttttaaaggcattatgaacattcagtttgtcattgatgacaaaggggatattctcgttcttgaagtgaatccccgggcaagccgcacggttcctgtcgtgtctaaggtgatgggggtgccgatgatcccgcttgccgccagattgctggccggcgcttcccttaaagacatcaagcccgaggttcaaaatcagcacggaacggcagtgaaattcccggttttttcttctcacgccattcaggatgtggacgtaaagcccgggccggaaatgaagtcgaccggagaaggcatgtgtgtcgcgtttgacgcagaaagcgcactgaaaaaaatctacgcgcacgtctgggagaaaaaaggcagcatctatctggaaggctgtgatgcggaattggaacgtcaggctcaagaggcgggatttaccgtatgcaaagatgcgttcccggcatgggcagagcgaaaggataaagcggtccatattaatttcaatcactctgaagaagcgcgtaaacaacggatcgaagccatgacgcacggtgtgacggtctttactgaaccggaaaccgtaaaggcatttttagcaagcggctccggcaaacctcagcctgtatcgctcaaagatctttatcaaaaggaagtggcatcatgcacacaataaaagcggaacacacattaacccatttgtacggcaaagattttctttcattaaaagatgtcagcccgtcagacatcaatgcgcttctgacagaagcttcattattaaaacaacatccgatacagccgattttccaagggaaaacattggcgatgatttttgaaaaatcttcaacccgcacacgtgtgtcttttgaagcgggaatggcccagctcgggggaacgggactatttctttcaagcagcgacctgcagcttgggcggggggagacggtcgcggatacggccaaggtgctgtccggcttcgttgatgccattatgatccgcacctttgagcatgaaaaagtcgaagagcttgccgagcatgctgatattcccgtcataaacgggctgaccgaccggtatcacccgtgtcaggcactcgcggatctgttaacaatacaagaaataaaaggaaaattaaaaggagtaaaagtcgcctatatcggtgacggaaataatgtcgcgcattcacttatgatcggctgcgcaaaaatgggctgtgacattgcggttgcttcgccgaaaggctatgaagcagaggaagaggcggtgaatgccgcgaaagaagcagcggctgtttccggagcgaaaatcacccttaccgaaaatccgcaggaagcggtgcgggatgcagacgtgatttactccgacgtcttcacgagcatggggcaggaggaagagacgcagcagcggctgaatgtgtttgctccgtatcaagtcaacgcctcactcgtcagtctcgccaaacccgactatacatttttgcattgcctgccggcgcatcgggaagaagaggtcacgtccgagattatcgacggcacgaactctgcggtattccagcaggcggaaaaccggcttcacgcgcaaaaagcgctcctgaaagctcttctatacaaacaggatgaacaaaaaaaccgctgaatctcattcagcggtttttgatatttctccgcatacaagcgcatactacataaaaaagaaaaaggaggaaatgacgtgggacagcagcatcaattccgcccgggacaaaaagcgccgaataacggtgtgtacgttgaaatcggcgaaacgggaagcatggtcaaaaatccgcaaaaaatcaaacttacggtgggagaaatgttccctgaaacttcaaaccacaacagattgtggacgtaccaacgaaaaccgtgaacacaaaaaaacctgctgaatagcaggttttttatttaatgctggtttgcatcctgtttgacaggcatgatctccgcaagaacaaagactagcaccgcaataaccacggcaataacggatgattgcttgaaattgtacgccgcgctgttcatggaggcgaccaaataacaggccatatgtgttaaaaggaacgtccaaataaaaccgataataaaccgcacgtttccacctcgtccttcattttattctacgttgtatcataccatacataaagcgcgggcggaaggtcattttctcatcaaaaagcgcgcctgaaactgacatgtgcccgcctgtcttgccgtctgacggaaaattcggttcctgtgcttgggataatagccaaaacatagcagcaaataggagtttatccgatccgttttcattcttcttacatatgatagccaatagagagattaggagtaaaaggaggcgggcaggcatggggataacggaaagatttttccaattcggatctgagctgaacgtcatccatctgccgtatcggccgaacggcttctgtatctttattctgggggacagaactcactttgtcagccgggactcaagcttttggctcgaacatgaagggagaaaccagctgttaaatacgctgcttgacagagggtacaccattttcaacagcaatttatacggacggcattggggttcggaaaaagccgccctttacgccagacagctgattcattatgtgctgaaacaagaaaccctcaatccgaaaatacacttgctcgcagaaggcatgggcgccctcatcgccgatcaattgctgcagtcttcaccggagcatatccgttcagccgcaatgttagatccttgtctggaccttcaagcccattttgaatcagagaaagaaaataagtttttttataagcagtttctgagggaaacggcacaaagcttcggtgtttctgaaaaagaggcaagctcactgagctatcagaccattaccggctgccgcacccgcgtgccggtacatatatggcaaagaacgaccggagcgccgtacccgtacaccctgcacgcgaacgcgtataaagaagcccgggaaaagaccggaagcaagattgatatcacgtatcacctgcttgagaaccctgctcgtatgtacagagccatctgccggtttttccgcagtcatgaaaaagacctgtaatgaatagaatacaacagccatctcttttcagagggctgtttggcttgtgtgtgtatgaaaaaccggaaaggcggcagatgtgatgaaaacagcgctgatcattggagcagatgaatttctcggcctttcattgtgcgaacggttgatggatgaaggtgtgcacgttgatgtcattttggcagaaccggaggacaaaacgaggcagctgtatttagaagaacgtttaatgtggctcgcgagaaacgggctttttcaaataatagaggaaatcggtgaaaaggaatacgatcgtatctgcgttcaatacgggagcgggtgtctgcctgaaaaaagggctgagcctttatattggattgtttacagtgaggatcacggagactgggaaaaaaacggtcagcgggatacggcaaaagcgattatccttcctcccctttacggtccgtggacggaagcaaaagaagatggagaaagcaggatctttttagaagacgcggtctgggggctgatgaataagcttgaggctgacggcacagaagacgaaaatcagattattaccctggaaataaaagaaaaaacgcaaaaaacggaagcggaagaaaaaattaaagaatggaaaagacaattttcatcaatattcgacattttttaagaaataccttccatgttatgtgcattaccgctacaataaacgtatatcaattatacatgttatgagtttgaaaaggggttgaacatggcttgatcaccaggcttgtcatgatcttttctgtcctccttttattgagcggatgcacacaaactccgtttaaaggaaaaattgagaaggtcggaatgcttttccccgataccatcagtgacttggtatggggcacaaaaggttacaaaggtttattagcgatacaatctgaatttaacgttgacgtttattataaagaaaatatcagatccgatgaagatattttaaaagcgatagatgattttcataaaaaaggagtcaatcttttatacgggcacggaaatgaatacgaggaaatcttcaatatgatcagcaaggattatcccgacatggaattcgtcgtcgcaaacggaacggcgaaaagcgataatgtcacaagcgttcaccttatgggagaagcaatgggttttttcgggggaatgacggccgcccatatgtcaaaaaccaatgaggtcggtgtcatcgcctcctttttgtggcagcctgaagtagacggctttatcaaaggggcgaaatatgaaaagcctgatatcaccgtcaatactgaatttacggaccactgggataacggcaatgaagcgctgcatctttacgagaagttaaaagcggagggcacggatgttgtatatccggccggagacgggtataatgttcctgtcattcagcaaatcaaaaaagacgggctttacgccatcggctatgtcgccgagcaatcgaatctcggcaaaaacacggtgctgacaagcacggtgcaaaacgtagataaagcctatacattaattgccgagcaatataataaaggtacgctcaagagcggagatcacgactttgatttcagggaaggagtcgttgaaatggggacgttcagcccgctggtggacaaagcgtttcaagacaaaatctcagaccttgtcaaaacgtataatcaaacaaatgaactgccgtcaaatgaatagaggtggatacacatgcagcatgaaaagtctcttgaatttatgcagatcgcgatgaaatacttgccggaagcaaaggcggagcttgagaaatccggcatagatctgtctatggaaatgattcagccgtttatggacctgtttacatcggtcatggcggaagcgtatgagcttggcagatctgatgccggggagctgaataaataaagagagccactttttcatgaagtggcttttcacatgatttttttctttatggcggacaccatcggcgcaaagtctttaaatacgggctttaattgatccagggagttcatgatggaccccagctgattcaacacgtggttgtaatcgatctcttcttcgttttcagcctgaggctgctccgggttttcttccggttctttatcccggtctctggaatcgccgaacatcattttggagaaaatatccatagtgaagcctcctttcgtcttccttttattctatgaggagcagcgtccgatagtttagacgaatatattgccaacagaaaaaaaatagggtagaattagtacctgatactaataattgatcataactaattagttttaaattcattataaaaaaggagtcttttccaatgaaagctggaattcttggcgtcggccgttacatcccggaaaaagtgctgacaaatcatgatcttgaacaaatggtagatacatcggacgagtggattcgtacgagaacaggtatagaagaaagaagaatcgccgctgaagatatgtattcatccggcatggccgctgaggctgcgcaaaaagcgcttgatcaggccggcatttccgctgaggagcttgatatgatccttgtggcgacggttactcctgaccagtctttcccgaccgtttcctgtatgatacaagagaagctcggggccaaaaaagcgtgcgcgatggatatcagcgccgcatgtgcgggttttatgtacggtattgtaaccgccaaacaattcattgaatcgcaaacatacaaacatgtcctcgtggtcggcgtggaaaagctctcaagcattaccgactgggacgaccgtaatacggctgtgctgttcggagacggagccggagcggcggtcatcggaccggtcagcgacgacagaggcatactttcatttgagctcggagcagacggtacaggcggtcagcacttgtacttagatgaaaaagggcatacaatcatgcatggaagagaagtattcaaattcgccgtccggcaaatgggtgaatcgagtgtaaatgttattgaaaaagccggcctctccaaagaggacgtagactttttgattccgcatcaggcaaacatccgcatcatggaagcggcacgggaacgtttggagcttccggttgaaaagatgtctaaaacagtccataaatatggaaacacatccgcagcatccattccgatttcattagtagaggaactggaagcaggcaaaattaaagacggcgacgtcatcgtcatggtcggtttcggcggaggattgacatggggcgccatagcattacgctggggacgataaaaaaaggtgaggtgcacacaagatgagtaaaaaaagagtagtcgttacagggcttggagccttgtctccgcttggcaacgacgccgaaacaagctggaaaaatgcaatcggcggcgtatccggaatcggaccgatcacacgtgtggaatcggacgagtatccggcgaaagtagctgctgaattgaaagatttcaatattgaaaatcacatggataaaaaagaagcgcgaaaaatggaccgcttcacgcaatacgctgtcgtagccgcgaaaatggccgttcaagatgccggtctgaacatcacagacgagatcgctccgagagtcggcgtttgggtcgggtccggaatcggcggtcttgaaacgcttgaatcccaattcgaaatcttcctgacaaaagggccgagaagggtcagcccgttctttgttccgatgatgattccggatatggcgacaggccaaatctcaatcgctctcggagcaaaaggagtcaactcctgtacggtgacggcatgtgcgacgggaacgaactctatcggtgacgcgtttaaagtcattcagcgcggcgatgccgatgcgatgattacgggcggaacggaagcgccgctgacaagaatgtcatttgcgggcttcagcgcaaacaaagccctttctacaaatcctgatccgaaaacggcaagccgcccgtttgataaaaaccgtgacggctttgtcatgggagaaggcgcggggatcgtcgtgcttgaagagcttgagcatgcccttgcccgcggtgcgaaaatctacggggaaattgtcggctacggctcaacgggtgacgcctaccacattaccgcgcctgcccaagacggggaaggcggtgcgagagcgatgcaggaagcaatcaaagatgcgggcatcaagcctgaagaaattgattacatcaacgctcacggcacaagcacgtactacaatgataaatacgagacaaaagccattaagaccgttttcggtgatcatgcgtacaagcttgccgtcagttcgacaaaatcaatgacgggtcatttgttaggcgctgccggaggaattgaagcaatcttctccgtcatggcaattaaagacggcattatcccgccgacgattaacatcgaaacacctgatgaagagtgtgatttagattatgtaccggataaagcgcgcgagcaggatgtcaacatcgttctcagcaactcgctcggcttcggcggacataatgccactttgatctttaaaaaatatcaataatacagtttttgaccggctgcctgaaaaaggtggccggtttttttgtgcgtgcatatgataacaacaagaggaggcgaaccggtatgagcgtcaagcagacatatcaatggatggaaaaggcggcatccgtaaatgacctggccccgcatcttttgccgcttttttcaggggccgataagaaagagtggaagccgatactcgggatgctgcaaaaccacggcatgttccgccatctgaaggacggcgttaggaccagtaaacggctgaaagaaaaaggatgctacagccatatacaaaaagaggaagcctatttaaaggagaagtggaacgggccggacgtgccgatcgtagttttgcccgttgatgaacgaaaccggaaaatccgtcaggaattcggatcaaaatccggtctggcctttcgggacaaaatgttcctctttctatcgtcggatagttccaattcagctgtatccgcccttatgacacatgaatataatcacgtctgccggttagaacatgtgacaaaggacgaaaaagatgagacatttcttgatacaatcatgatggaggggctggcagaatatgctgtatatgagcggttcggctcaagtcttacggcggaatggacgtcctactatacgcctgagcagcttgattttttgtttgaaaaaagagtcaagccgaacctccgcttaacgagagacagcagaatgttttcccagctgttatacggaaaaggatacttcccctcaatgcttggctatgccgtcggattcaatatagtaaaaaaatatttaaccgaccatcaaaaaacagtaaaagaagcattggccatcccttcaaaaacctttctggaagcaacgctttaatagattaaaagaatggaaattatttaaggatattacatttatcctaaaaaattcttgcttttgtaataatgatgtaataatatacaactataaaatttttcgactattctatattttgtgatagcgaaacgtatgtttccctctgcttcagcggaatgagaaaggggcgtatcatgagcacactattagaagtgaataatttaaagacctattttttcagaaagaaacagccgatccctgcagtcgacggggttgattttcacattaacaaaggcgaaaccgtcgctcttgtaggagaatccggctcgggcaaaagcatcacctcgctttctattatgggacttgtccaaagctcgggcggaaaaattatggacggctcgattaagctggaaggcagggacctggcctccttcaccgaaaacgaatattgcaaaatccgcggaaatgacgtctctatgatctttcaggagcccatgacttccctgaatccggtgctgaccatcggcgaacaaattaccgaagtgcttgaataccataaaaaaatgaataaaaaagaagcggctaaaaaagccgttgagcttctggaactcgtcggattctccagagcggaacaagtgatgaaagaatatccgcaccgtctttccggagggatgagacagagggtgatgatcgccattgcgctcagctgcaatccgaagcttctgatcgctgatgagccgacgacggcgcttgatgtgacgatacaagcccaagtattggagctgatgaaagacctctgcaaaaaattcgatacttctattctgctgatcactcacgatttaggtgtggtttccgaagccgccgacagggtgatcgttatgtattgcggacaagtcgtagagagtgcgggtgtggaggacttatttttaaaccctcttcatccgtataccgaagggctgttaaactccataccggtgatagatggagagattgatacattaaaagcgatcaaaggcagtgtcccgacaccggataatcttccggaaggctgccgattcgccccgaggtgttcaaaagcgatggacaaatgcaaaacagggcagccggagctgataacgcatgaaagcggccgttctgtaagatgttttttatatgaggaagagggtgcccaatcaaaatgacagctgcaggccaagaaacgattttagagctgaaagacgtaaaaaaatatttcccgatccgctccggtttttttcaaaggaaagtcggtgatataaaggctgttgacggcgtttctttttcactgaagcgcggggagacgctcggcatcgtcggtgaatcaggatgcggcaaatcaacggcgggaaggacgatgatccgtttatacaagccgacagacggccggattctctttaaggggcaagatatctccggcttatctgaagaaaagctgagaaaaagcgtccgcaaaaacatccagatggtattccaagatcccttcgcatcccttaacccgaggaaaacgctgcgttccattattaaagagccgttccagactcaccatatgtacagcatgagcgagcggaacgagcgagtggaggagctgctggcgaaagtcggccttcacccgagctttgcaaaccgctatccgcacgaattttccggggggcagcgccagcggatcgggattgcgcgggctctgacgttgaatcccgagctgattattgcggatgaacccgtttccgcactcgatgtctccattcaggcccaagtcatcaatctgatggaagaactgcaggatgaattcaacctgacctatttgtttatttctcatgatttgagtgttgtccgccatatcagcgacagagtcggcgtcatgtatctgggaaaaatgatggagctgaccgataaacacgagctgtacggcaatccgcttcacccttatacgcaagcgcttttgtcttcagtgcccgtcacgagaaaaaaagacgccgtcaagcgggaacgaatcatcctgaaaggagaactgccaagcccggcaaacccgccgaaaggctgcgtgttccacacgcggtgcccgatggccaaaccgatctgcaaggaacaaatcccggcatttgaagaagccgctcccggccattacgtcgcctgccatttatatgcctgaaatgacaagcatcgagagggggtatgccggattacataaccagtttgctgcatatatatcacaaagggggaattgatatgaaattacgtaaaagcgcactgatgatgctaagtgtttttatggcgctcgccatcttcctgtcagcctgctccggctcaaaatccacaagcaccgaatccaaaccggcaggaaaaccgcaaaaaggcggagatttggttgtcgggtcaaccggggaacccacactttttaatccactttattctaccgatgttgcaagttctgatattgaaggcatgatttacagcacattattggaaacggatgagaaattaaacgtcaagccgtcgctggctgaaaaagtaacagaagctgacgggggattaacgtatgatgtaaaactgaaaaaaggcgttaaattccatgatggaaaagagctgacggccgatgatgttgttttcacctacagcatccctcttaacaaggattacaacggtgagcgtggctcgggttttgagtcccttaaatccgtaacgaaaaaaggaaaatatgaaattcagtttaaaatgaagaaaaaagatgcctatttctataatgtcgttctcgacagttacggcattttgccaaaacatatattgggtaaggtgccggttgcagatctgggagagaatgaatttaaccgtaaaaatccaatcggctccggtccgtttaagtttgttgagtggaaaaaaggtgagtatgtcaaactggaagcaaatgatgattactttggcggcagaccttaccttgatacagtgacagtcaaaacaattcctgattctaacgcggccgtggcccagttaaaagcgggagatattgatttcttcgttgtgccgggcacagattttgatacggttaaaacgtttggaaacgtgaaggtcaaatctgatctcggcttaaactacagctatatcggctggaatgagaaaaaagagctttttaaggacaaaaaagtgcgtcaggcattgacttacgctcttgacaggcaggcaatggtggatcaagtgctgaacggagacggtaaggtagcggatgttcctgagagtccgctgtcatggaattatccgaagtctaaagtgccgacatttgattataatccgaaaaaagcaaagcagctgctaaaagaagccggatgggaagaccatgacggtgacggctaccttgataaagacggaaaaaaattctcatttgaaattaaaacgaatcaaggcaataaaattcgtgaagatttagctgttgtcgttcagcagcaattaaaagaagtgggaatcgaggctaaaccgcgaattgttgaattcagtgcgttaatcgaacagacaagtgcccctaattgggattatgacgctcttcttctcggatggagtcttgcaacgttcccggatcaattctctatcttccattcaagccaatcgaaaaacgggctgaataatatctggtataaaaacccgaaagtcgataagctgcttgaagaagcgaagtcaattacagacagaaaagaataccaaaagaagtatgaagagatatacaaattaattgctgaagatcagccgtacagcttcttattctattacaattaccacagagcgatgccgaataatttacaaggctatgtattccaccctaaaaatgacttgtacaatattgaaaaatggtggctggatcaaaaatagcaaaagccctggagagggaaggaggttcctttcctctcttatcctatttaaaaaggggacaagaatatggttacatatattttacggcgaacattaatgtccttgccgattctcttaggcattacaattttgtcgtttgccatcatgaaagcagcgccgggagacccgatgtcacttatgatggaccctacaatcagtcaagcggacagggcgaaattcattgaaaaatacgggttgaatgatccggaacctgttcaatatgtgaaatggctggggaatatgctgcaaggggattttgggacttctatcgtcaagaaaggcactccggtttctgaacttatcttatcccgcttaccgaatacgattgtgcttatgcttttctcaacccttgtcgctcttctgatttctattccatttggtgttctgtcagcgaaacgtccttattcaaaattggattacgggataactgttacttcatttttagggcttgccattccgaatttttggttcggtttgattttaatcatggttttatctgtaaatctggggtggtttcccactggcggagtaagcactttgaatgctgactttaacatatttgaccgattgcatcacttgattctgcctgcttttgtgctcgccacggcagacatggcagggataacgagatacacaagatccagtatgcttgatgtgttaaaacaggattatatacgaacggcgcgtgcgaaaggattccgagataataaagtgatttttaaacacggtttgagaaacgggcttcttcctgtcatcactatttttggtttgatgataccgtcatttatcgggggagcggtagtggtagaacagatttttacttggccgggtctcggcaaattgtttattgattcagccttttcgcgggattatccggttatcatggccatgacggtcatttcagctgttttggttgtagtggggaatttaattgcggacatcttatatgcgctggttgatccccgcattgaatattaacaaagagaggtgagaggtcaaatgttacagccaaataccggcacaccccccagcgaagtgaaattaaaggaaaatattcaatccaaaccggaaacaatgacgaagatttttttcgaaaagttctttcaaaataaactagctgtaatcggagccgttatattaaccatcattatcttgtcagctttattcgcttcggtaatcgctccttactctccggagagtcaatctctcatcaatcgtttgaagccgccgagcttaaaacatctaatgggaactgataaattcggaagagacatctttacgagggttctgtacggggcgcgcgtctccttgcttgtcggattcgcttctgtgatcggcgcgattacaatcgggacagttgtcggagccgttgccggatattttaaagggtttgtcgatgccgttctcatgagaaccgttgatatcgtattatccatacctgatatatttttgttaattacacttgttacgatttttcagcccggaatggataaattaattttaattttctcccttacaggctggacaacaacggcacgccttgtccgaggagagtttttatcgcttcgttccagagagtttgtattagctgcaaagacgatcggtacaaaaaaccatcacatcatcttttctcatatactgccgaatgcgctcggaccgattatcgtctcagccacattaaaggtgggaacggttattttggcggaatctacattaagttatctcggtttcgggattcagccgccgatcgcaagctggggcaatatgcttcaggatgcacagaactttacgcttatgatacaggcttggtggtacccgttattcccgggtttgttgatccttcttaccgtattgtgcttcaactttgtcggagacgggctgcgtgatgcgcttgatccgaaaaatgtgaaatgatctcccggacgaacgggagatttttttgttgcaatgcagtcggaaatccagctccgtaaaacggaaatctcatattgaaatggaataatttatctatcccttgcctatactgtggacaacagtttttataaagtgaggggtcgaatatgttatttcttcatgatgtatgggtcaattggtttgaaggggaagaaaacggctacaatgtatgccattttcacgaatggcggaaggaagacacggttgagcttttggatcagacgccgctgctcagagtgccgtcagtattatttcattacatagaaaacgacttatcagagcttccgaaagagctgcttgaccaagtccaccagaagtcatacgtgcgaaaaaatcatgagcggacaaagctggagtactgttttgtcgtgacagacgggatcggcatcattgccgtggatacgatcgggtataccattccggtcagaaagagccgcctgattccgagacaggagcagcttgtttatgaaatggtaaaggatgtagaaccggaatcgtttcaatttgagccgtcgcaattggagtcttcaaaggaatatcacattttgtcattggcgccggggcatgtcagaggtctgacgagaaaagagcggcagatcaagcagctgatgtttatggcgctcgaccagctgaaagggctgaaaaaccgtgcggaaattgtgtattggtacacggaatggaatccgcatatgtatgagcagatcaaacggatgagttttgaagagatctgggacatgctttacaatgaaacaattgaaggctggtcggataaacatcttgcgttctgtgaaaatttgattaaagggcagccgtttttcgaaaagctttgggaaatggaacaggaatcaaaagtgaactaaaaaaagaggcggggattctcccgcctcttttttttatcttcttttccgtccgagacccatggcgttttccattttcttcaccattttgccggccgttttgtttgcgcgcgccgccccttcgtcgagaatgcggtcaagctcgtcgctctcaattaattcacgatagcgctcttggatcggtgtcaatgcgccgataacgacttcggctaaatcgcttttgaattcaccgtaccctttgccttcatatttagcttctaattcttcaattgatgtgtttcctaaaatagaataaatcgtcaaaagattagaaacgcccggtttgttttctttatcatactttacaatgccttcagaatcagtcacggcactcttgattttcttctcgagctgcttcggctcatcaagcagcgtgatgaatgccttttggttcggatctgatttgctcatttttttgagcggatcagccagtgacatgatgcgcgcgcctgattcaggaattttcacctcaggaatcgtgaagatgtcattgtattttttattaaagcgttccgccaggttgcgggtcagttcaagatgctgtttttggtcttctccgaccggaacaagatccgttccgtacagtaaaatatcgccggccatcagcggcggataggttaacagtccggacacgacggcttctttgccctttgacttatccttaaattgagtcatccgctcaagctcgccgatatatgcgacgcattggagcatccaccccgcctgggcatgagcgggaacttccgactggataaagagggtcgctttctcgggatcaagtccgacggccagataaagagccgcgagattgcggatgttcttccgcagctcaagccgatcctgcggaactgtaatcgcatgctgatcgacaatacagaagtagccgttgtagtcatgctgcaaatcaacaaattgcttcattgcgccgatgtagttgccgagggtaacggaaccgctcggctgaatgcctgaaaaaatcgttttcttcatagttcttacctcatttcttaaaacataataaaaaaagcccattcttcccgtagaaaaaagggacgaatgaaccgtggtgccaccctgattattccattacaatggaatcgctcgagacgttggtaacggaggctgctccggctgggcctactaacgttcggtcagctgctcagaagtccattccacatcgcccgttacctgctcccagcaccgcagactctcttcaaacggatgaaaatgtgtactactcttcatcatcgcaatcacaacaaatgtatttgattgatctattataaatcaattatagccaaatgtcatcagaggaatacaagcttatttccagtttactttaggggtggaaatcctcaaaaagaactgaaaaagcttaaatgataacgtatatcaacatttcgtataacgaatattatatgtaaaaagcaatatgaactggaaattacattaaaaaaatttagttaggtcatgctttaaactatagaagtgtatcacctttttgacagaaaaactgaccaaatttaaatattttaaattgagaaaatagtattgcaataaattattcatttcattataatgaacttgttcactctattgttacagcttctttacataaaataatcagaaaagacggaacacaattaaagtttagaaaaatattaagttattttgtctgatatttctgagtatttagtagtaaaggctgaaaaatttgattagggggttagtgcatgaaaaagcgttggtctattgtaggtttgatgcttatcttctcgcttgtattaagtgcgtgcggcggattcagcggcggatcaggcggcggcaaaaaagacaccaaaggacagacttcacttaatatcaatattaaaaccgagccgttctcattgcatccgggtttagcgaatgattccgtttcaggaggcgtaatccgacagacttttgaaggattgacacgcgtaaactccaaaggtgaccctgaagaaggaatggcatctaaaattgaaacaagcaaagacggaaagacctatacatttacgattcgtgacggtgcgaaatggtctaacggcgaccctgtgacggcgcaggattttgaatatgcatggaaatgggtgcttgacccgaacaacgaatcacaatacgcttatcagctctactacatcaaaggcgctgaagctgccaatacaggaaaaggcaagattgatgatgtaggcgtaaaagccgtaaatgacaaaacattaaaggttgaactgaataacccgacaccttatttcacgcaattaacttcattctatacgtatatgccgatcaacaagaaaatcgccgaaaaacataaaaactggaacacaaacgcgggcgaaaattatgtgtcaaacggcccgttcaaaatgacggcctggaaacacagcggttccatcacgctcgaaaagaacgatcaatattgggataaagacgctgtgaaattgaagaaaatcaacatggtgatgattaacaataacaacaccgaactgaaaaaattccaggccggtgagcttgactgggcaggaatgccgctcggccagcttccgactgaatctctgccgacattgaaaaaagacggatctcttcacgttgaaccgatcgcaggcgtgtattggtacaaattcaacacagaagcgaaaccgctgaacaatgttaacatccgtaaagcccttgcttatgcgatcgaccgctcgtccatcgtgaaaaatgtaacgcagggcgaacaaatcccggccatggctgcggtgccgccgtcaatgaagggattcaaggataacacaaaaggttacttcaaagacaatgacgtcaaatcagctaaagaattcttaaataaaggactgaaggaattaggcgtcaagagtgcctctgaccttccggcgatcaagctgtcctacaatacggatgacgcgcatgcgaaaatcgcgcaggccgtacaggaaatgtggaaaaagaacttgggcgtcaaagttgaacttgataactccgaatggaatgtttacatcgacaagctgcacagccaaaactaccaaatcggacgtatgggctggctcggcgatttcaacgatccgatcaacttccttgaattgttccgtgataaagaaggcggaaacaatgataccgggtgggaagatcctgagtttaaaaagctgctgaaccaatctcagcttgaaacggatccggataaacgtatcgaagagctgaaaaaagcagaaaagatctttatcgacgcaatgccggtcgcgccagtttatttctatacggatccttgggtgcaggataaaaacctcaaaaatgtgatcttgacaggaacaggcgaagtttacttcagaaacgcttcttttgaataaaagccggttctgaaaacaaaagacccaaggtatatggggaggatgtccccatatacctttcttactgattacgtataaaattgtaaaaaacatggaggtgttcaccttgctgaaatatatcggtaaacgattcatttacatgatcatcacattgtttgtgattgtgaccgccacgttcttcttaatgcaggcagcgccgggcggaccattttccggcgaaagaaagctgccgcctgaaattgaggcaaacttaaacgaacactatggtttggacaagcctcttttcgttcaatatgtcagctacttaaaatctgtggcgatgtgggacttcgggccttcttttaaatataaaggccaaagtgttaatgatttaatcaattcaggcttccccgtctcattcactctcggtgcagaagctattctcctcgctttagcgttcggtgtgcttttcggggtgcttgctgccctgtaccataataaatggcaggattataccattgcgattttaacgatctttgggatctcagttccgagctttatattggcgacgattttgcaatatattttctcaattaaattagaactgttcccggtcgcaggatgggaatcctgggcatacacctttctgccctccattgcgctcgcttccatgccgatggcgttcattgccagactctcccgttcaagcatgattgaagtgttaaacagcgattacatacggactgcaaaagctaaaggactgtcccgtccgtcagtcaccgtgcgccatgcgctgcgaaacgcgcttttgccggtcgtgacatatatggggccgatggcggcatccattttaacgggaagtttcatcattgaatccattttcggaattcccggtttaggcgcgcattttgtaaacagcattacaaaccgtgattatacggtcattatgggagttaccgtgttcttcagcgtgctcctgcttctatgcgtattaattgtagacgtgctgtacggattaatcgatccgagaatcaagctttccaaagcaaagaaaggagcctagaccatgcagaacattcctaaaaatatgtttgaaccagcttcagctaatgccggcgatgccgaaaaaataaataaaaaaagcctttccctctggaaagacgccatgctccgcttccgcagcaataagcttgcgatggtcgggttcgtactgatcgttcttattattctgatggcgatttttgcgcctatcttttcaaggtatgattatgccactaccaatctattaaatgcggataaagcgccgtcgaaagatcattggttcggcacggatgaccttggaagggatatattcgtccggacatgggtgggcgcgcggatttccatctttatcggtgtcgcagctgccgtgcttgatttattgatcggcgtaatctggggcagcatttccggattccgcggcggacgcacagatgaagtgatgatgcgcatcgccgacattctgtgggctgttccttcattattaatggttattttgctgatggttgtcctgccgaaaggattgctcaccattatcgtcgccatgacgatcacgggctggatcaatatggcgaggatcgtccgcggacaggtgctgcaattaaagaatcaggagtatgtgcttgcttcacagacactcggtgccaaaaccggccggcttttgtttaagcatatcgtcccgaacgcgatgggctctatactcgtaacgatgacactgacggttccgacggcgatttttacagaagcgtttttaagttatttgggcctcggcgtacctgcgccgcttgcgagctggggaacgatggcctcagacggattgcctgcattaacctattacccttggcgtctgttcttccctgccggctttatctgcctggcgatgttcggctttaacgttgtcggcgacgggttaagagacgcgctggatcctaagttacgcaaataaggagtgatatgagtgacacgtttgctagaagtaaaagacttagccatttcatttaaaacatacggcggagaggtacaggcaatccgcggcgtcaatttccatttgaataaaggagagacgctggcgatcgtgggggagtcgggttccggaaaaagtgtgacctcccaagcgattatgaagctgattccgatgccgccgggctactttaaaagaggacagattctttttgacggacgcgatatcgtgccgatgtccgaaaaagaaatgcaggccatcagaggaaaggacatcggaatgattttccaagatccgatgacctctctgaacccgacgatgagagtcggcaagcaaattacggaagtgcttttcaaacatgaaaaaatctcaagtgaagcggcgaaaaagcgcgccatagagctgcttgatctcgtcggaattccgatgcccgaaaaacggatcggccaattcccccatgaattttcaggcggtatgagacagcgtgtcgtcatcgcgatggcgcttgcggcaaatccgaaactgttaattgccgatgaaccgacaacagcgcttgatgtgacgattcaggcacagatccttgagctgatgaaagatctgcaaaagaaaattgatacgtctatcatttttatcacgcatgatctcggcgttgtcgccaatgtcgccgaccgggtcgccgtcatgtacgcgggtcaggtcgtcgaatcgggcacggtggatgaaatcttttatgatccgcgccatccgtatacgtgggggctgcttgcctcaatgccgagtctggacagcaccgatcaggaaaaactgacggccatcccgggtacgccgcctgatctgacgaatcctccgaaaggggatgcatttgcgctccgcagctcatatgcgatgaaaattgactttgaacaggaaccgccgatgtataaagtgtctgatacgcattttgtgaaatcgtggcttctgcatcctgatgcgcctaaggtcgagccgcctgaagcggtgaaggctaaaatccgtcagcttccgaatacgtatcagcatcctgttttaatgaaggaaggtgaaaaaaatgactgagaaacttctcgaaatcaaacacttaaaacagcattttttcacgcagaaaggaacggtaaaagccgtagatgatttgtcatttgatatttataaaggcgaaacgctcggccttgtcggagaatcgggctgcggtaaatcaacgacgggccgcagtattatccggctgtatgaggcaaccggcggggaagttctctttaacggggaaaatgtccacgggaaaaaatcccgcaagaagctgctggagtttaaccggaaaatgcagatgattttccaggatccgtacgcatctttaaatccgagaatgacagtcgccgacattattgccgagggaatagatattcaccgcctggcaaaaacgaaaaaagagcggatgcagcgggttcacgaactgctggaaacggtcggtttaaataaagagcacgccaaccgctacccgcatgaattttcaggcggacagcgccagcgtatcggaatcgccagagcgctggcggttgatccggagtttatcatcgcggacgaaccgatttcggcgcttgatgtctccattcaggcgcaagtcgtcaatttaatgaaagaattgcagaaagaaaaagggcttacttacctgtttatcgcccatgatttatcaatggtcaaatacatcagcgaccgcatcggcgtcatgtatttcggaaaattggtggagcttgcgccggcggatgagctttacgaaaacccgcttcacccatatacgaaatcattgctgtccgctatcccgcttcctgatccggactatgaaagaaatcgcacgcgaaagaaatacgatccggcagttcatcagctccaagaaggagaaaaaatggaattcagagaagtgaaaccgggacattttgtcatgtgcacagaagctgaatttaaaacctatctataaacgtatcatcctccaagactgagtcttggaggatttttttgcgcacattcaagtttattaagcctgctcccgtttttctataatggaaaaaaagggggagatcagtatgaaaaccattttgtgcgccatttgtgcgggactgtttatcagtgcagccgcttatccggcccatgccgctgtgaaagaggagcagccgcttgtaaaagtagcactggctgaaaaagaattgccgaaatcaaatgcacggttcgcttatccgtcagggctgcatttttcacatcctgataaggtgcggggcatttacgtcacaggacattcagcgggaggaagcaaattcggggagctgacagactttgtggacaaaacggagctcaatacaatggtgattgatgtcaaggacgacaacgggaacctcacctttaagccggacggccattctgagtatgccaaaatcgccaagccgtacatcaaagacccaaaaaagatgatgaaaaagctggaggaaaaaaagatctatccgatcgcgcgtattgtcgtatttaaagacagcgaactcgcgaataaaaagcccgagtggtcctttaaagaaaaaaacggaagtgtctggaaaaacggccgcggcgaatcgttcgtcaatccgtttatgaaagaagtatgggattacaatgtaaagattgcaaaacaagccgtaaagatgggttttcaagaaattcagtttgattatgtccgttttcctgaagggtttgaaaaacgtgatgacgaactgacatacggacacggcgattacggaaaaacagcagacagcaatgtgcaaaaacgcgttcacgccgtcaccgattttgtcggttatgcgaagaaaaaactcaagccgtacggcgcggatgtgtcggttgatattttcggctattcagccacgctgccggaagcgcctggtatcggccagaatttcagcaaaatttcagaccaggtcgatgtcatttcatccatgatttatccgagccattggacaagctatttcggcattgataaaccggatcttgagccctacaatgtcgtcaaagaatacgcgaaggtggaaaataaaaagctgtccaagctgaaacacccgcctgtatcgcgtccgtggcttcaggacttcacggcatcatatctcggcagcggaaattatcaaaagtacgggaaacgccaggtggaggaccaggttaaagcgctgcatgatgaaggaattgacgaatttttattgtgggacgcggcaaaccgttataccaaaaacgtcgattacacaccattttaaaaaaattgaaaccatgttaaaggatcacacgtcttaatagatgtaagattgtttaaacaatcggaaatggggtatatctaaaagtgtgaagacaacgaacccataaggagcaaatgaatgaactggtacgaaaagctgagtgaatattttccgattgaagaaatgaaatcaaaagcgcatatggaagctctgttaaaggagcaaagcgatgtttatcataaagaagaggggcagtaccacgtgctgatgtatgcggaatttgactctttcatctttattgattacctgtttgtgtcaaagaaatccagaggacaaggcctcggaagcaagctgatcggcagactgaaaaagaagaacaagccgattctgcttgaggtggagcctgttgacgaggatgacacggatacacagaaacgcttgcgtttttatcaaagagagcatttcaagcacgcgcagtcaatcgggtatcggcgccggtcattggctacgaatgaagtgaacaaaatggagattctgtactggtcacctaagacggaatcagaagaagaaatatttgaagcgatgaaacagacatatgaaaacattcacacttataaagatgaaaaatggtacggagaatcatacgagaaaacggatgaagttctcaaagtcattgatgagaaaaaacaaaaaaacattttcgatcagctgagctaattgagaatggggaaaaatcctccagccgtaaatttgccggattgacacatttttttctcaggagactgttcacacttacttttttatagtataatacctataaagattccttttttaaagtcatttcaatttgagaatacaaacatgttcatcctactaattagaggagtgaagattaatggttacattatacacatcacctagctgtacgtcatgcagaaaagcaagagcttggcttgaagagcacgagattccgtttgtagaaagaaacattttctccgagccgttatcaattgatgagatcaagcagattctgcgtatgactgaagacggtacggatgaaattatctctacccgttctaaagtattccagaaactgaacgtaaatgttgaatctatgccgcttcaagacttatatactttgatcaatgagcatccgggactgctccgccgtccgatcatcattgatgaaaaacgtctgcaagtcggctataacgaagatgaaatcagacgattcctgccaagaaaagtgcgttctttccaattaagagaagcacagcgtcttgccaactgatataagcttacgataagcatggaaaaagcccaaaaccatcgcggtttgggctttttgttatttttcagtctgctggtaaatcatactggcgaggataacaaaaacaacggtcaaaatcggcagcatcatctgtatcatgccgtgttctgccatgaaaaatgacagcttgctgtctccggcaatcatttcaccgccggtaaatgcgagaagaccgctcccggcatacatcaataaaggcattttttccatggcggcatgaacgagcttgctgccccaaataataatcggcaccgagatgaagagaccgatcactactagtgtcagctcaccgtgagaagcgccggctactgcgatgacattgtcaagcgacataaagatatcagccagaacgattgtgcggatggctttccaaagagaagaactgcttttcacatgctgcgcatctttcttctcaatcagaagctgatagccgagatacaataaaaataccccgcctgcgcattgtaaaaaaggaacattcaataaatagaccgcagcgctcgtcagaacgattctcaagacgactgcgataaatgttccgaagatgatcgcttgctgtctttgtttatgggccagattccggctggccatcgcgatgacgacggcattgtcaccgccgagaataaggtcaatcccgataataagcagaagggacagcaggtaatcgtgcggcatggtaacacctcgcttatagatcgattgcttgtacagctaatatatgaagcagtgcgctatttatgatgggaaccgggagaaagcctgtttttcggtgtgaaaatgcttttttatttcttttataactgttttatcataaaatagaaatataaagaatttgcgctgtcttctataaggttaagatgtggacggaatgggtaaagtgtagtaaagtactattcatcgggagcttagatgtcccttcaacatcttataaagaagggaaggttggcaaaatggaaatagaaagaattaatgagcatactgtaaaattttatatgtcttatggtgatattgaagatcgcggttttgacagagaagaaatctggtacaatcgcgagcgcagtgaagaactgttctgggaagtcatggatgaagtgcatgatgaagaggaattcgctgtcgagggtcctctttggattcaggttcaggcattggacaaaggactggaaataatcgtaacaaaagcccagctttccaaggacggacaaaaactcgaactgccgatcccggaagataaaaaacaagagccggcagatgaaaatctcgatgctttacttgatgatttccagaaagaagagcaggccgagagccgggaagataaggagcaaaagcttcagttcactttgcggttcgatgattttgaggatctcatctcgctatcaaaattgaatcttaacggaatcaaaacgaccctgtattcgtttgaagaccgatattatttatatgcagatttttatgagcaaactgatgaagaggttgaaaatcagctaagcatcctgttggagtacgcgcacgaatcatcagtcagcattcaccgtcttgaagaatacggcaaattagtgatcgctgatcatgcgttatatacaataaaaaaacactttgcatcataaaaaaccgatttctctcagcagaaatcggttttttttgttctgaatgacaggatgaacggctgaaaaccgtataacggctctcatccgcaaacaggattatgccttcttcctgctgaatacaacaagattcaggaaaggagaagatgcaacatgttcagtgcagtgactgccggcggacggctcattcagctggccggaagctattcaaaggaaaaagcggcggagctgagaaagaaacgctggttctgccccgtttgcaaaagtgagcttgatatcaaactgggacgcgaaaaactgccgcacttcgctcataaaaaaagcaggctgtgtcccggggaatccgaacctgaaagcgaataccatctggaaggaaaaagacagctttttctctggctgaagacacaagggtgcagtgtcagcctggaaccgtatctgacttccgctggacagcggcctgacttgacggcagaaagcggagaagaaaggctggcttttgaatttcaatgtgcgaacctttcggcggactctttaaagagccggacggcaggcctgaaaaacgccgggtaccggccggtctggatcattggggcaaaacggttaaaacggatgaccgcgcaatttttccggctttctgcttttcactggcagttctttgaagtcaattcattttcctccttaatgttttactgccccgacgcccgctccttttacaggctgcattccatcactccgttttacaccggctattcttatgccggcttaaccgcaatccctcttcacaaagcaaatctgaaagacatttgtcatccggaagggcggcgcagcgtcagactttcctcgtgggggcgtgccgttaccggcttccgcaacaaaggcgggcggtttttatctgaagatgccggtcttatccggcgtcttttttacgaaagacatcaggttgcatttccatttctcccctctgaagtgtttattcccgtttcagcaggctttgtgtttgcaagtcccgtttttgtgtggcagggccatttatacttgcggcttgcggaactttctaaaaaaggcgcgccgatccgattatccggcatggttcatgatttacggcaaaaaatcaggcataaggagatccggatgcggtatggttcacaagacagccttatcggaatggcggtaaaacaatatgctgatttcttatgcttgcaggattttttaagggaaattgagaatgaagtatatatgccctcatctcaacagaagcgccctcaaacggcagaagagctgcgccggcgggacctgctcttttttggggaatgagaatgcttcatttcgttcaccctaacgtcaaggtggtggcgaatgtgaggggcgtacaagcattttgttttcgttttttcactgtattattggtatgctcggtcttatatgccgcatatgatttgacaaaaggcagtgaaaagccggaagataatcacaacacaagtttttggagaaacaatcgttttttcaattggcttgaagtaaagaaaacgagggggatcaccatgactgaggaaaataaagcagcacagctgcctgagagaagtgaagtaaaggcagagcatacatggagactagaggatatttttcctagtgatgaggcctggaataaagaatttcaagcagttaaagaattaattccgaatttatcttcatttaaaggcacgcttgctcattcggctgataatttatacgcggcgcttacggcacaggatgaagtgacgaaccgccttgggaaactttatgcatacgcacatatgcgctcagaccaggatacgggaaattctttctaccaagggctgaacgacaaagccgcaagcctgtattctcaggctgccagcgcgactgcttacattgaaccggaaattctggcgattcaggaggacaagctgcaccagtttattcttgaaaaagaggagcttaagctttactcccatgcaattgaagaaattacaaaacagcgtccgcacgtgctgagcgaacaagaagaggccctgcttgcggaagcctctgaagcgctgtcttcgccttccaatacattcagtgttttaaataacgccgatattacgtttccgtcgattaaagatgaaaacggcaaggaaactcaaatcacacacggcaactttattaatttcctggaaagcagcaatcgtgaagtccgcaaaaacgcatttgaagccgtatataaaacatacggacagtataaaaacacgatggcgactacactcagcggcactgtaaaaaaagataatttttacgcccgtgtgaaaaagtataaatcagcacgggaagcggctttatccaataacagcattcctgaagaggtttacgataaccttatcaaaacgatcaataaacatcttccgttattacaccgttacattgacctgcggaaaaaggtgctcggccttgatgaagtccatatttatgacctgtacacaccgcttgtaaaagattcgggaatgaaggtaacatatgaggaagcgaaagattatatgctcaaaggacttgctccgctgggcgaggaatacgcgtctattttaaaagaaggacttgaaaaccgctgggtcgatgtatacgaaaacaaaggaaaacgcagcggtgcttattcgtccggtacatacggcacgaatccgtacatcttgatgaactggcatgataatgtcaataatctgtttacgctcgttcacgagttcggccattccgtgcacagctactatacgagaaaatatcagccgtatccgtacggtaactacagcatttttgtcgctgaagtcgcttcaacgactaatgaagcgctgctcggtgaatatatgctgaacagcttaaaggatgaaaaacagcgtctgtacctgctcaaccacatgcttgaaggattcagaggcacagtgttcagacagacgatgttcgctgaatttgagcatctgattcatacgaaagcgcaggaaggcgagccgctaacgcctgaactgctgaacgaactttattatgatctgaataaaaagtatttcggtgacaacatggtgattgataaagaaatcagtctggaatggtcaagaattccgcatttctattacaattattatgtgtatcaatatgcgacaggctacagtgcggcccaagcgctgagcagccagatcttaaaagaaggcaagcctgcggtggagcgctataccgaattcttaaaagcgggaagctcggaatatccgatcgacatactgaaaaaagcgggagtcgatatgacatcgcctgaaccgatcgaggcggcctgcaaaatgtttgaagagaaactgaacgaaatggaagagcttctttcgaaagtgaacccttcgtaattcaaaaaagcctgtgcattaaatgcgcaggctttttctaaaaccccttaaacgtttttcggtgattcagccggtacagggcaaacaatatggacagaaacagcagtggagatgtaatgtaaatcggcagcatgtgcatcatggccagcaggtttaaaaagaagaaaaacacaatcattccgatgatcaatacggtgcggagcattgatttccctccttgtttatgattgatatattctatgaaaacaagcagtcagttatgttttgtgacaaaaatatgaacattaatcttatggcttgtcaaaactcgacaagatttgatatgataaggatgtgaaattgatcacaaacaaacattacccctttgtttgaccgtgaaaaatttctcccatcccctttgttgtcgttaagacatatgaaaccgcgcttatcccggcgcggtttctttatttgcacaaaaaaagccggctccgtaaggaatcagctttttttaatggtcacaacaggtgacatcctcctgggttccggccagagatttccaaaacagaccgtgctttgcttccactctggcgacctttttggcgaatgccagttttttcatttctttttcaacttcttctagactcaaatcataaacgagtgcgatttctttcgatgcgacaaaccggaaatattcaatgaaacattccaaaggcggcgtttcagaaggcttcggttcatccccgagcatttcgaataagatctcttcgtatacgtcataagaatagttgccgggaaccttcagcccttcatcatcatgcaggctgttaaagaacgtcaatgtcgggttgacggtgacgtccatttccgccgcgattttcatatcgcactgaagcgcttttaccgcgctttgcgaatggaggtcgcgcttgaattcttcaacatccaatttcgtcttttcagcaatttctaaaagaacgtcttcatccgtaatattctgcttggagacaaacaggctttcctgcatgctgcggagaaacagaatgcccgcttttcttccctgcagttcggccgcttttaaagcgagtgcggcaaggtagggcgatgcaagaggctgatcctgctcaagccaaaggcttccgtcacagggcatcccggaacggttcgcaattttttcccaagcttcggcaagaaggtgttttttccgcttttgcttattcagcgatgtaatgctcgcggaaacaatgatccgcagggtgaaaaaacgtccgtatttgatttttaatttttttatggcgggctccagcgaccagcattcaggacataaagggtcgacaaacatgtaaatttcgagcggtttttttggatgtccgtggcaatgggcgaagtattgctcatgctgataattcgtcaatatgatcgatcctccgcttctgactggtttaccatatgcctggccgtcagttccagacgcccgtacagaaattcacgaatatcgccctccagcccgacctgatccatcgctttgctcatacagcttagccacgcatcagccctctcatccgtaatcggaaaggggagatgccttgccctgagcatgggatgtccgtgctcttcagtataaagaggaggtccgcccaaatactgggttaaaaattgcttttgttttctggccgtttcagtcaaatcacttggaaatatcggcttcagcaagggatgagacgagacacgctcataaaaagtatcaacaagttgcgatagaagttcctctccaatcgcttcatatggtgcgttaaacgattgtcccatgttgactactcctttatatggctaataggaatcataattcccattgcgaatttatctttcagttttactatcttcagttactgtatattttagcaataacattttatttctacaaacaaagtgcctttctgtcaggcgcttgtatttcatatcatatcacatcgccttcattcatgtgtaagatttcactccgcaaaaaaaccagagggcgaaggaagcctctctggtttacgcgtaatactgccgggttatgtttttgacatattgctgtgtttccttaaacggcgggatgcctccgtaccgatctacgttgccggggcctgcgttgtaggcggctaacgcgagagatacatttccgtcgtatttcgtgagcatctgctttaagtactttgtgccgccctcagcgttctggacgggatcaagcgggtttgacaccccgagtgattctgccgtggaaggcatgagctgcatcagccccattgcccccgcaccgctgaccgctttcggattaaagcctgattcctgtttaataaccgcgcggatcagtttttcgtccactccgtatttttcggctgctttctgaatggcgctgtctattgaaaagtttccggtgctgatgtcagaagccgcattcggagactttatgctcggggaaacggtctgtgaagctgccgcggaaccggatgaaaccggaattctcggtgaatatgaagcgtgagcggtccgcacaccgtttaaaatccctgattccggctgctgccggacggctgtgtccgtatactggctgagcagcgcgctgaaattggcaagcgggctttctgaagattgtccgcctgaatccgtgcttgtatgagagattgattgcagcgccattgactgcagctggagaagggccgcccaattcgttatattcactgtgtcattccacctttttttgtttctgttcataaaaacgctggattttatttttcgtgatccgctctgggatgccgaattgcttgagcaattgttcaaacgcctgttttccttcatcccagtcagcagcctcgaattccaattcaaagtcttctttctctaaatatcggctgtgatctaaaatgattaagcctttttctgattctttttccgcgcgtgcggtcgacagcgttccgaagcagcaaatgtgttctgaacggattccgagaccgtccagctgccgtttgacggggccatccggaatcttgaagacgtcaagatccggtgccgccgcaagctgttggtgcgtttccagcagaccgaccgcggcaggttcttttaaagtcagaacgaacgagccgtctttttctcggatgcggagtgctgattttttttgtttcagggaaaaatctttcgtgtcgaaataatgattgacctgctgtttaaaatcatattctttcatgcagagtgcttcactcagcttcagaaattctgattttgtcagcaggtttttgaattcaatttctatttcttgggtcatgacagtcttcctttcaggacgaaaaattgtataattcccattatctctttagaggttacgtttatcaatatcgaccttgatatgataaaataaatgctgtactttgttaaaaaaggagaacattatgcaaaagagaattgaaatccagaatgcatcattaacagaagacgcgctccgcttgaagtgcggagaagacttaagcggagcggaacgcaaagcctcaggtcaaatgcttgttgattccgatcactttgcttttgtatacatacttgaatcagctgactcttttgaatatgtcattataaaagaacatgtctggccggatctgaaagaagccttagaccaaggaaaaccggcggtccttgaggccggcgcgaaaacggttgaactttcagggctgcatgaagaactcgattatcttcttgaaaatattaaagataatgcaaactacggagatatggaagaaaaagtgaaaaacgtatttctttagaacaggttcggaattgggggatgtacgatggatgacaaacaatgggagcaatttctagcgccataccgccaggctgttgaagaattaaaggtgaagctgaaaggcgtcagaaccctttatgagtatgaagatgaccactcaccgattgagtttgtgacaggccgcgtgaagccggtggcgagcatacttgaaaaagcgagacgaaaaagcataccgcttcatcagattgaaacgatgcaggatatcgcggggctgcgtattatgtgccaatttgtcgatgatatccagatcgtcaaaaatatgctgtttgccagaaaagattttaccgttgtcgataagcgggattacatagcagagcataaggaaagcggatatcggtcttaccaccttgtcgttttatatcctttacaaacaacgtccggtgaaaagcacgttcttgtggagatacagattcggacgcttgccatgaacttttgggcaaccattgagcattcactgaattacaaatacagcgggaacattcccgaaaaagtaaagctgaggctgcagcgggcctcagaagccgcatcccggctcgatgaagaaatgtcagaaatccgcggagaaatccaggaagcccaagccgcgttctcgcgaaagaaaaaagcgggagaccgccagtaggaaggaaaggaggggaatggcatgaaatttgccgtttcttcaaaaggagacgaggtttcagatacactgaaaagcaaaatacaggcgtatttactcgattttgatatgaccttggatgaaaaagagccggaaatcgttatttccgtcggcggtgacggaacgcttctttacgcatttcacaggtacagcgaccgtcttgataaaacggcttttgtcggagttcacacggggcatttgggtttttatgccgattgggttccgcaggagatagaaaagctcgttctggccattgccaaaacgccgtatcataccgtggagtatccccttcttgaggtgattgtcacttatcatgatgaagagcgtgaggagcggtatctggctttgaacgaatgtacgatcaaaagcatagaaggcagtctcgtcgctgacgtggaaattaaaggccagctgtttgaaacgttcaggggagacggtttatgtctgtccacgccttccggaagcacggcttataataaggcgttaggcggtgcaatcatccacccttccatcagggcgattcagcttgccgaaatggcatctatcaacaacagagtgttcaggactgtcggctcgccgcttttgcttcccgatcatcataactgtgtcatcaaaccgagaaacgacgtcgactttcaagtcacaattgatcatttaaccttgctgcataaggatgtcaagtccattctatgccgtgtggcaaatgaaaaagtcagatttgcaagattccgcccttttccgttttggaaaagggtgcaggattcctttatcggaaaaggcgaatagaaagaggaaacggattggacaacttttttatccaaaagaacatgactgcccgggatgccggcatgacggttaaagaatatacggcgcagctcggcatttcaaagcggcttctcgctgacattaaattcggcgggggagacctgcttgtgaacggagagcatgtaaccgtccgcaccgtgttagcggagggagacgtgcttaagattgaatttccgaaggagcatgtgagtgaaacgcttttgcctgagccggttccgcttgatattctttatgaagatgaccatgtgcttgtggtcaataaacagccgtatgtctcctcaattccatcaagagaacacccgtcaaaaagcatcgctaacggagtgatcagccactaccgaaaaagcggcgtgcaatcaacggttcatcttgtcacccgccttgacagggacacatcgggggcgatgctcatcgccaaacatcggctttcccattctcttttgtcggcagcacagaaaaaggggcttgtcagcaggcgatatctcgctgtcgtacacgggatcatgctgcagaaggaaggaacggtggacgcgcccatcggaagaaaacacgacagtattattgagcggatggtaacgccggatggacaacgagcggtgacgcattttcaaacggaaaaagcgggacatgcgtttacgcttgcagccctgcggctggaaacggggcggacgcatcaaatccgggtgcacatgagctacctcggccatccgttagtcggtgatacattgtacggcggaaaaaatgagggaattgcccggcaggctcttcacagtgagcggctttcattcgtacaccccatgaccggagaaacgctcgtttttcacgctccggtgcctgacgatatgaaaacattaattgaacacatgtaaagcccgaaccgtttgccggtttcgggctttatttcatgcctgcctgccgtgatcctcgcgaaatcgtgaagcatcatacggcatagagctttccacagagacggtttcatgctcgggaaaacgaaagcctgtcagctgattgccgaagacacagcctgtatcaatgttgaccgtacggttgacgatccgggggcgttttaccggggtatggccgtacacaacccacgccttgccttcatagtcggcagcccagtctcttctgacgggtctgccgtcgggatgcgtttcacccgtaatatcgccgtacagaacaaattcttttaccttacgcgagtatttaccgatatcgtcagcttttatgccggcgtgggcgacaacgagatcgccattatgtaaaatgtcataaagcggcgctgactcatataatcggataaattgtccggagacttccgttctgtcggcgggagacagctctttcagttcggctgccgtcgtttccagtccgtgcatcacttttacagggtttccttttaagtaacgatacagtttgttgcaatgatttcccgggacataacggacggctcctttttcatatgcttttgccacaaaacgcatcacttctacggattttgggcctctgtccgttaaatcccctgcaaagacaagcgtcctgccttcagaatggacgggcgttccgtctttcacttcatatccgagcttttgcattaaggcgatcatttcgtcataacatccgtgtatatcgctgatgatgtcataagccattcgtgtcagcctccttattaacggttttttatttattatggggctaattcctatacctaattacgctgttttggtacaaattaaaaaaagaattgaagaaataaagccttatcacttttttttcgcgttaagccttgttagaatatgcgttatgtttttaaaaaaagtaaggtttcgtccgcttaaagcgggcttttataacccttgttttaaggaggtatttacaaatggaacacacatcagtcgcatctttagtcgtcgttctgatcgtcgcttttttgacgccgctccttttacatcggtttaagctcagcatccccgtcgtcgtcgcggagatcatcatggggcttattatcggaaaaagcggcctgaatcttgtcgttcagggagacacgtggctggagacgctgtctgttctcggctttatctttttaatgtttttaagcggcttggaaattgatttttcttcatttgagaaagggaagaaaaaacaattccttccgaacggcaaggaagcgcccaacacgttttctgccgcgctgattatctttttcggcatctttattttatcattgctgctgtcctatgcctttgtattagccggttttattcaaaacgcatttttaatgacgcttattatttcaacaatatcactcggtgtggtggtcccgactttaaaggaagaacggatcatgaactccaatatcggccagatcatcctgcttgtcgccgttatcgcagacttggctacaatgattctgctcgctttcttctcttctctttacggagaagacagcggaaatatgtggcttctgttgattctctttgccgcgggggtcgtgctgtatttcttcggcaggatctttaaacaccgttcatttgtgcagtcgatgtctaaaggcactgtgcagatcggcacgagagccattttcacactgattatcgtgcttgtcgctttatcggaatctctcggggcggaaaatattctcggcgcgtttttggcaggcgttctggtatcgcttctgtctccgaataaagaaatggtggaacagctggattccttcggctacgggtttttaattccgatctttttcgtcatggtcggggtgaaattggatatttggacgcttttccaagatccgaaaacattaacgatgattccgctgcttctgcttgcgctgtttatcagcaaaatgttcccggtgttttatttaaagaaatggtacgacaaaagaaccgtgtttgcttcgggctttttgctgacgtccacgctgtcgcttgttatcgcggcggctacgatcggagaaaggctccacattatcagcgccaatatgtccggcgcgctgactttagttgcggttattgccagcatcatcacgccgatcggctttaagaaattattcaaacggcaaagcgcgccgcaggaaaaaaagcgcattacatttatcggcgccaaccaaatgacgctcccggttacgctggaattgcctgaggaggaatatgaagtacgggtcgtccatgtgtatcaggaaaatgccggggaaacgcttgcggaatccgttttttcggttgacacgatttctgattacgagcccggcacgcttgagtcgcacggtattttcaaaacggatattcttgtcgtggcgacgggaaatgaagatgtgaacgctgaaatcgccttactagcgaaagagaaagggactgagcgtatcatcgcaagcgtcggctcggttgagcatgaaacaaaactgaaagaagagggcatcagtattttttctatccttctgtctacaaaaacgctgctgcgcgcgttaattgaggcgccgggcgtgatgagcctcctgacgaatgaggagtcttcgttatatcagatcaatctggaaaacccggcgtataacggcatcattctgcgggaatttccgctgatgggcgatgtgattttcgtccggattttcagaggtgtggacagcatcgttccgcacggagacacacggctgaaaacaggagaccgtctcatcgtcacaggctcgcgcaactacgtgtcagaactgagaaaaatccttgaagcttgaccaaattgcaattcgtgataatatagaaggcataacaaataaatcattaatcgtatgaccactaggggtgtccttcataagggctgagataaaagtgagacttttagaccctcataacttgaacaggttcagacctgcgtagggaagtggagcggtatttttttggggttccttttatccatttaaattccaaaccacttttccgatgcgggaaagtggtttttttattttatcagggggaagacatgatgacattttctgaagaatgcagacaggcggctgccgaatggtgggacggaagttttgttcatccgtttgtaacgggaatcggtgacggaagcctgccgatagaccgtttcagctattacgtgctgcaagattcctactatttgacgcattttgcaaaagttcaggcgttcggcgccgcatatgccgaagacttgtttacgacgggcaggatggcgggccacgctcaagggacatatgaagcggaaatggcgctgcaccgcgagtttacggagcttttaggaattacggaagaagagcgtgcagcatttaaaccggcaccgaccgcctattcttatacgtctcatatgtacaggtcggtgatgagcggcaattttggagaaatattagctgcgcttctgccttgttattggctttattatgaagtcggcgaacacctaaaagagtgcaaaccggagcatccgatttatgaaaaatggatcggtacatacggcggagactggttcagacagcaggtcgaagaacagatcagccgttttgacgagattgctgaaaacagcacagaggaaatccgcgcgaaaatgaaagagaattttgtgatttcaagctattatgaatatcaattttggggaatggcttatcaaaaagaaggctggtccgagaaggacggaaaagaggtggaatcctttggagctgcacgcggtaactgataatcgcaaacccgttgccgagctggccgaggatattctatcgattcagcgcgaagtaagctttatccatatccgtgagcgggataaaacagcgggagagatcatgcagcttttgtcccttttgaaaaagggcggtgcggataaggacaaattgatcatcaatgacagggcggatatcgcgctttttgccaacatacaccgtgttcagcttccgtcccgcagcttttccgtaaagcaggtgcgaagcagatttccccatcttcatatcggacgttcggttcattcgctggaagaagccatccaagctgaaaaggaagatgcggattatgtggtgttcggccatatatttgaaaccgaatgtaaacaaggacttgaagcaagaggcatcagcctgctttcagagatcaaacgcacgctttccatccccgttatcgcaatcggcggaatgacactgcagacgatcggacacacaaagcaggcgaagccggacggaattgccgtcatgtcaggcattttctcagctgaaaatcccgaggaggcggcaaaacggtatgcacgtgcggtaagggaggccgattatgaagcagcactatgatacggcggtgatcggcggcggaattatcgggtgtgccatttcttatgagctggcgaagacgcagcagaacgttgtcttgtttgaagccggagaagtcggccgaaaaacgacaagcgctgccgcgggaatgctgggtgctcatgcggaatgtgaaaaccgggatgcgttttttaattttgccatgcacagtcaaaggctgtatgaagcggcggggcaagagcttgaggaagctagcggcattgacatcaggcgccataacggcggaatgcttaaactggcgtataccgaagaagatatcgcccgtttacggaagatggatgatctgccttccgtcacttggctttcagcggaagatgcccttgaaaaagagccttacgcttcaaaagacattctcggcgcaagtcttataaaagacgatgtccatgtcgaaccgtactatgtttgcaaagcgtatgcaaaaggagcgcggcgctatggcgctgacatatatgagcacacacaagtcacttccgtaaaacgggtgaacggagaatattgcatcacaacgtccggcggggatgtttatgctgacaaagtcgcagttgcaagcggtgtatggagcggccggtttttcagccggctcggcttgggacagcctttttttcctgtgaaaggagaatgcctttccgtgtggaatgacgataccccgctgaccaaaaccctttaccatgatcattgttatgtcgtcccgagaaaaagcggccggcttgtcatcggcgccacgatgaaacagggcgactggagcgatacgcctgacatcggaggaattgaggccgtcattgcaaaagcgaaaaccatgcttcccgccatcgaacatatgaaaatagaccggttttgggcggggctcaggccgggaacaagagacggcaagccgtttatcgggcaacaccctgaagacagcggcatcatcttcgccgccggccattttcggaacggcatcctgttggcgccggcaacggctgaaatggtgcgggatatgatcatggaaagacagattaaacaggaatgggaagaagcgtttcgaatcgatcgcaaggaggctgttcatatatgatccttcagctgaacggaaaacaaattgattggaatcgaaaagaggggacggttcaggatttgcttgaatcgtaccagcttgaccaaagaatcgtagttgtggagagaaataaagaaatcattgaaaaaaagaattatgaaaatacaagtttgtgtgaccgcgatgtcatagaaattgtccattttgtaggaggcggatgaggatgttaacaataggcggaaaacagtttcggtcaagattgctgttaggaacgggaaaatatccgagttttgagattcagaaagaggcggtggccgtctcggaatcagatattttaacctttgcggtgcggcggatgaacatctttgaagagtctcagcctaactttctcgaacagcttgatttgtctaaatacacgcttctgccgaatacggccggcgccgcaacggctgaagaggcggtccgaatcgcaaggcttgccaaagcttcagggctttgtgacatgataaaagtagaagtcatcggatgcagccggtcacttttgcctgatccggttgaaacgctgaaagcatcagaacagctgctcgaagagggatttatcgtgcttccgtatacgtcggatgatgtcgtgctcgcaagacgtcttgaggagctcggggtgcatgccattatgccgggcgcttcgccgatcggttccggtcagggaattttaaatccgctgaatctttcttttatcattgaacaggcgaaggtgccggtcattgtcgatgccggcgtcggatcttcaaaagacgccgcctacgcgatggagctcggggctgacggcgtgctgttaaataccgctgtgtcaggcgcagatgatccggtcaaaatggccagggcgatgaagcttgccgtagaagcgggccgtctttcttatgaagccgggagaattccggtgaaagattacggaactgcaagcagtccgcgagacggtcttccggtatgacggacagatattccagacaggagctgtttcagccgatcggtcccaccggccaagagaagctccggtcgtctcatgccgtgattatcggcgcgggtgcgcttgggacggcaagtgcggagatgcttgtcagagcaggggtcgggaaggtaacgatcgctgacagagattatgtggagtggagtaatctccagcgccagcagctttataccgaagacgatgtcagacaggaaatgccgaaagccgcggcggctgaaaaacggcttcggtctataaatagcgatgtagaggtcgagggatttgtcatggatgtcactgcggaaaacgcacccggattgattcgtgatgcctccctcatcgtggatgccgccgacaactttgaaacgaggctgattgtgaatgatgcggctgtgcagaaaggaattccctttctgtacggcgcctgtgtcggcagctacgggctctcttttaccgtcattcccggtgtcacgccgtgccttcactgtctgcttgagacattgcctttaggcggtatgacatgcgatacggcgggaatcatcagcccggctgtattgcagacggccgtttttcaggcagcagatgcgctgaagctgttaacgggcggatctatcgagcatgttctccgttcctttgatttatggaaaaatgaacggtcagaaataaacgtcgcccgtcttaagtcggctgattgcccaagctgcggcacaaacgattttccgtttttatcctatgaaaatcagacaaaagcggcggttctgtgcgggcggaacacggtgcagatcagaacggggatttccgaacagtttgatctgcaaaatcttgcgggacagctcagacgggcagggcttgatgtttcagccaacccgtatttaatttcattttgcacagacaatttcaagatggtactgtttcgtgacggcagagcattaatacacggcacaagtgatatcagcagagcgaaatctttttatcataaatggatcggataatgtgaaaggagcgaaaaacatcatgagcatatgcaaagcattgacgattgccggatcagattcaggaggcggcgccggtatacaggcggatctcaaaacctttcaggagctcggcgttttcgggatgtcagcccttacagcggtaaccgcccagaacacgttgggcgttcacggcatttatccgctcacccgggaggcgctgggcagccagattgacgcggtggcggaagatttgcggcctgatgctgtaaaaacaggaatgctgtggagcgcggaaatgattgcggaaattgcggaaaaaacggatcagtacgggcttgatcatctcatcaccgatcccgtcatgattgccaaaggaggcgcttccctgctgcgtgaggaatctcaggccgcgttaaaagagctgttaattccgcgcagctatgcggtgacgccgaatgttccggaagctgaggtattgacggggatggaaatccgcacgtttgaggaccggaaaaaagcggccgaacgcctttgcaagcttggggcaaagcatgtcatcataaaaggcggacatcagcctgaacaggggagaatcgttgatttattatttgacggttcgtcttttacccaaatcagccacgcttatattgacacgaaacacacccacggaacaggctgcacgttcgcagccgcgctgacggcagaaacggcaaaggggaaaaacattcagaccgcgtttgagacagctgtcaattttgtgcgggaagccgtggaacatacactcggcatcggagcgggacacggcccgaccaatcattttgcctttaaaaggaacagtctgcagacgagataaaaaagagaccgcttcaacatccgcggtctttttcccatgctttcaatctggacaaggttatgatatgataaaaattaagatcaggtactaaaactatgtctttaagacgattacaggaggctttatacatatgaatttctcacttgaaggccgcaacatcgttgtgatgggcgttgccaataaacgcagtatcgcatggggaatcgcccgttcgctgcatgaagccggagcgcgcctcattttcacttacgcgggagagcgcttggaaaaatcagttcatgaccttgcggctacattagaaagaaatgattccatcatccttccgtgtgatgtgacaaatgacgctgagatcgaaacttgctttgcaagcattaaagagcaggtcggcgtgattcacggcatcgcgcactgcatcgcgttcgcaaacaaagaagagcttgtcggcgaatatttaaatacgaaccgcgaaggattcctgcttgcgcataacatcagttcttactctctgacagcggtcgcaaaagcggcgcgtccgattatgactgaaggcggaagcatcgttacactcacttacctcggcggagagcgcgtcgtttcaaactataacgtaatgggtgtggcaaaagcgtctcttgatgcgagcgtgagatatttagccgctgacttaggaaaagaaaacatccgcgtcaacagcatttcagcagggccgatccgtacgctgtctgcaaaaggaatcagtgatttcaactctatcctgaaagaaattgaagagcgcgcgccgctgcgccgcacgacaacacctgaagaagtgggcgacacggctgcattcttgttcagtgacctgtcaagaggcatcacgggcgaaaatcttcacgtggattcaggattccatattaccgcacgttaaataacaagcagtccctttcagggattgcttttttctttcttctgattttaatcattccgtcatataaataaaacatgacagaatcggagggatgaagatgtcaaaacaaaacagaaacgcggaaaaaaaaccgctcatgtatattgttcaggcggattattcagacacgcaatcatcaatgcaggacatattaatcaaaaaaaggaaagcgccgcagccgccggaagaagagccgatgcatggaaagcgggaggaagaatgtaaaactcagcctgaaggagcagtggctgtcgaaccagaaaagcaagtacctgaacagcacagccgctcagaagaagccgttcaagaagttccggcgcaagcggagcaggacactgccaagcctgaagccgctaaaaaagagcctgaagccgctgaaaaagagcctgaagcggttcacaatgccgccccagaggaaaaggtcccgccaaagcgcgtgaaaaagccgatgagcagaatgtccattcttgaaaaaattgatttcttaacgaagctgccgcataatatgccgcggaccctttgtctgatagaagccaacgggaaaacctacagaggcgtaatcgtcggaagaaaaaataatgcgatcttcctgcggacgacaagcaacggagcgccggcagaactcgcaatagacgatattacctcgctgcatccgcttggattttaaccatacaaaaagctgcctgaattctttaatccggcagcttatttttatgctttttgatttaagaatgtgtgcggttgatcagtctcgggttcaggcaattgatggcgcagaagctatggagatcgacttcaacgcaatagttcgttttttctaaacggaatacatcgcagagagagtctttatctgtaaaatcaagaatgtgcttatgctcgtcaaaagcaataagcaggcttaatgtggcacagccgtcacagaccctttcaactctgaaaaaaacggtgttaaaacacggaccgttatccagctcgccgacatttccgaatgcggtaaacggtgatgatttagaagtgaaaagtacaaacggcactgtatcgcctaatgaaaaacccggcgataaaaggttggaatagcatccggccgggcaatcttcctcgaccgcattttgcaggtcttcaatattttctaccgcttcacgcacacagtatgttgtatgcttgctcataatatccctcctgacttcacgttttatataccggattaaacgatatcggagagtcagccgcccggaagtccgggcgggctgatgattgcatctgtaatagaaggttggaaggggattcttctttaggaaagatgcgaatcaatgactatccgtgatgctttttctctttgtgcggctcaggccggtcaacaagctccggtgaaaggcattgaatggcgctgaagcagctcagatcaacttcaatgcaaaaatctgttttttctaaaccgaagaaatccgggtcacaaggatggcagacgctgagggtgtcgccgtgcacatctacggggcgcaatactgaaagcgttgcgcagcaatcacaaactctttctgcccggaagaaaatagactcgaagcactggctgtcatccgcaaatcctccgacgttcccgaatgtggagaacaaaccgccttttttatcaaacaagagaaacgggatggtatctttaccggtaaccgtcgggcttaacagattggtatagcatccagtcgggcattgttcttcaacagcctcttgttctgctaaaatcttctcgactgcatcgcatacacaactttcatctcggccatggtgttttccgcagctcatggatttcagctccttcttttagggtatttgacttttgtctttaacaacatatgtacgcgagcctcacttggtgtgggtgaacgtctatatattcatcatatgcggagaaaataagaaaaagcagagcatttttagctctgctttttctttttagaggacaagggtgatgactaagacggcaatcagtaaatttgtcgctgttgagatcaacactgcgatatcggcatctactgttgtcacgtttacgccgcgggagttttcgatgagcaatttttgacggttgatttgtttgttagctgttagctgcaataagtcttgtgcgaccaattcagcgatgactccgtcagcaattgaagtgagagtggccgttacgactgctgcattaatcgctgtcatgactgaagcgactgcttgaacgtctgttgacgttacgttaatatcacaagagtctctgataataatcgcttcttcagaaacttgtttgttgatattcgcctgagccaggtcttggtcaaggaaggcattatcttcgccaaatccatgtccgttacagcaaacactgcatcttcttccttctttttcttctttttcttctcgcggatgttcgcattcaggatcaagtgcaacccaagagtatggtctgctttccatatctattcctccttttcttttactattattaaatgagccggccccttattttgactcaggcatctatcctgataaaaatcactattttttagttattgaccgggattttggcgtctttgccggagctgttcgattaattgttctctgcgggtttgcggatttgtctgctgttcttgcgctttttcctgctcttttttctgtttctggctttcaagaaaagcttctgttttcgcctgcatgtctttgactaatgcgatcagcatttctttttcttcatcagggatttcccgcattttatcctttgtcacgccgtgttttttgaagacattgctgacaagcacctttaaaagcggatccacttctggtagattttcgagttctttttttaatttttcgttatctgccatttgttctcacctctatttaaatatttgaaaagaaaggttaaaggatgtctagttcagcaaaaagtatatttaataattgaaacaaaatttgtacaaaggccatgatatcgtctgctgtcagtgtgattttaatattgcggctgttcaggacttgaatgacggtcctcttttttatttggcaatcatccaggatcagcagttcggttgcgatttggtcggctgtgtcttcatctgcgatcgcgagctgtgtcgcgaggataatcgccgtagtaactgaggcttgtatagaaagagcggccgttatatgtgttgtatctattgtgacattttcgcaatcaatcacttcgatcgtctgctcgaattcgttggataattgttcgtatatttgcggttgcagtgtttcgactttttcttcaaacgacataaccttcactcctttctcattcatactctatataatgcaaatgaaacgccgagcggaataagaaaaacaactaaaccgcacctatttttttaccggacaaggtgcgattcatgaagatcagggttttcgcatatgtataaagaggtcaagttttgaaaaggagtgaacaggtggttatcaattggctttcatttattctgttatcgtttgccgttttccggctggccaggcttttcgtatttgacaccattatggcgccgcttcggagcctttttcacgaggaaaaaacagaaaccgcacccgacggcacgacagaaacctacattgtcataaaaggaaaaggcatcagggcatttatcggtgaacttctcagctgctattggtgtacgggcgtatggtgcgccgcctttttaattgcggcgcagattgtgatccccgaggctgcgcaatggctgattttgctgttagccatagccggcgcggccgggatcattgaagctgcggtttctcgtcttctgcaggaataaggcggttccaccagcaacttaccgtcactttcggcataaactggcatatatgacataaggaaaggaaggatcaccatgaatcaatcaagcaaaccttcccaacactctccatacaaatcaactgtgcatcagccttacgaaaaaaaaattaagaaaaaaggctgcggctgcggccaaaagaaaaaaccgaaatagccgttttcaaaaaaaaccggagcttccggtttttttgttttttgccgaacgccggcctctgcccggcatagatcataggaggaggggatgttatgaatatatttgaatcattcataaacggtaaataccgccggcacaatcaaaatcagcgggagcatgacaactatatcttatctattgaaaaacagctgtctgagtttgatgaagcgggagcgcgctttgaggaatggatagatgtgtttgccgccgaaacagaagcgaaactgaagaaaaatgagcattctcaataaaatgaaaagaaatccgcaccggccctatgcatttatccaagccaaacaagtcggctcacatagagtatagagagtaaaggaggtgcttaaatatgggattcggatatggcggattcggcggcggctacggcggttacggctgcggcggcggctgcggatacggaggcggctatgtcggaggcggatacggctcaacatttgttcttgttgtcgtattgttcatccttctgatcattgtcggtgcatccttttttggctaaaccttagcaagactttggataagcgcgggaccgttcagtcccgtgcttccctaatgtatgaaggatagagaaggagatgcggaattttttccttgtcttacgggcacacgttccgccctttattcatacaatatcgtattactccacaaaaggaggcacaccatggataatcaattttttaaaaatattgagaagaaaacaggcgtcagcatgaaggatgtcatgaaccttgcaggatcattgcaaaatgccaatttcaaagatgaaaacacggtgagaggcgtcattcagaaggtgtcccagctggctaacaagcgtgttccgaaagaattggaagacaaaatcgttcaatcgattacaagcggtaaagagaaacttgattttggcaccatttctaaaatgttaaacaataaataggcgtcagccggccttgctaaaaaggcctttttatgtgagaagaacccggcagtgatctgccgggttctttatatcctgagtgcgctccgtctgtccgtccgaagaaggggctcgagaaatcttgagctgcgcgctgtttttccccgcctgtacgcgggacaagatacatataaatgctgcatggcccttgtcatggcgacatacaggagccgtctttcttcttcgagcggagcgggatcgccctgtctcgctgtctcaagcgcgaagtcatggggtatcgagccgtcagccgcgcctaaaatatagactgtattgaattcaagacctttagagcggtgaatggtcagcagttcgacgccgttttcatcggttttctgattctcagcggcgcgcatatgatcgacatgcgcaagaaaatcgggaatggttttgaattttttggcggccactttgacatccctgagatcatcagagcctttttccagtttgtttccctcattgccccgtttttttaaatactcggaaaaacccattttgctttctgcaaaggtgatggcttcaacgggcttcattgtccggatgcttgcgaaaaacggaacgatctgcttgatctttcctatttgaaaaggcttcaggtcaggcagtttcgtcagtgccttaatcatcgtgcaatcttccgtgattgacagcgcctttaacgtttgcagggcggattgctttaaaaataaggcgggcagcagatctttcaccgcatccgtatcatcttcattctgactcgcatataagtaggcgaggatctggcgtacgattctgcggctgtagaacgtctgcacgccacggtcggcatgataaggaatcgatgattggtgcagtctttcataaatggcccgtccggcgctgtttgtccggtaaagcacggcaaaatcatcaggactcgccccgttttgaattttctctttcatatccgaaacgatcatggtcgcttcttcttcttcatcgtaaggataaaacatcacgggattgtgaacgccgtctttgacggcagaaagtgttttttcataccgttttttatttttctttacgacggcatgagcgcttgagacgatcggatgcggcgagcggtaatttgccgttaagtaaatggtctttgctgccggataatccttttgaaaatcaagaatgaaagacgggctgctgccgcggaacgcataaatggattggtcgtcatcacccacgcagcacaggttattctccgggcttgcgatcatttgcataatgttgtactggacaggattaatatcttgaaactcatcaatcaaaatatgagaaaatctgttttggtactgcgcgagaatatcaggccggctttgaaacagttcataacagccttgggccatgtcatcaaaatcaaattgccgtttttcccgcttctgccgttcgtaatgttcgtagagccggtacacttttttctcccagtcgtccgcaagcggaatggtctcatgggggagatacgtgtttttccagcagccgataagctgcagcgcctggtcgacgggaaactctttttcatccaaattttcttcatagagcgcctttttcacatattgctctttttgccactccatttttaaaagctggctgccgttccattttgaagaatcataatgatagagtattttatagaaaaaactgtggaatgttccggtcacgagacgggagacttttccggctgccagcccgtactcattcgccatccgctctttcatttcggcgacggcttttgtcgtaaaggtcacaagcagcatattctcaggtgaaatgccgaggtgttcaatcatatgggcggcgcgggctgtcagcacccttgtttttccgcttcccgctccggcaagcaccagcagggggccgtccgtttccgtgactgcccgcatctgttcgcggttcaggccgatgccggggaacaaagatgtatcagctgcctcggatgttggtgaaaacggttcggccgcaggcacttttttcgggcttttccattctgagacgatcggtttcggattctctgaaatcgcttttcctttcggcaggcggaacatgcctgcctccttatactcttctttttctttctccgcttgtggttcctcggcggcgcatgctttttcacaggcggtgaagtctcccttttgccggtgataaaatgccggctgctctaaaatcgaaagccgcatcaagacaggctggtcacaatgtgcgcaaaaaatatttcctttctgagcttcttcaaaaaggaattggtaatgttctctagaatatgtatgtaaatgtatcgttcggttattcagtcgggcgcatttcaaaaaggggtcctcccattaaaaggtgttcatccatttgatagacaaagaatatcataacaaaagaaccgcgtttcaaaaagtaagattaagggaaatgaaaagcgaaggggaggggtacatatgatttatgcaggacggattcaaaaccagcagtattctcaatacgcaaaccgggcagcgggttataagcctgattacgccggcattacgaaagcggccgccctcgccaatgacagggtgtacagagaggtggagcgccgccaggaaaacaccgcagccgcagaaaagaaaatgcatgaggaaaaacgtaagcgctctctttcccgtctgccgcaaattatgggaaaaggccggttgataaatcaatatgtgtgaaaaagcccggaaatctccgggtttttttgagccgtatatatgaaagatgcggaaaggaatgattcaatttgagaaagctttcattattaattgcggggttatttctattcggcctctttactgccggaatgaaaccggcacacgcggcggagagctccgcagcaaaagatgtcactctcacacagctggcgccgcatgtctggatgcatacaagcatcggtacggcagacggaagtcccgtccctgcgaacggattgcttcttgaaacttccaaaggaatcgtactgattgatactccgtggaatgacagtctcacagagcaattaatgacacaaataaaacagcggtttcccggcaaaaggatgaccgatgccattgtgacacacgcccatgacgatcgcatcggcgggctgaacacactgtacaaatacggtgtaaaggtgcacagcacgaagctgaccgccgacttcgcccggcagcagggatatgaccggccgctcggagatttgaaaaacgtgacaaagctgcagtttggcgatatgaaaattgaaacgttttatccgggaaaagggcatacggaagacaatattaccgtctggctgcctgaggataagctcttattcggcggttgcttaatcaaggctttagaaacaaaggaaatcataccaactccgggcttttatccggatcagtggccgcgcgccgtccgcaaagtcatgaaaagatatcaggacatcagcattgtcgttccgggccatggcagtccgggggatgaccgtctgctgccgcatacgataagccttctgaaagaaacgtaaaaaagaagaccggcgctcccattacggagtgccggcttttttaactcttcctgatttttataaaactgaggaaagcaagtgcaagcgccaaaacggtatatcccgctatcggccaaatatgctgatgaaaggaagaataatctccggatatgacttcctgagccagctcgatcgagtggataaacggtaaggcataagcgatatgtttgaatgtgtcaccgagcaggctcacctccatccaagccccgcccagaaattgcacgagtgtaatataaatcgttccgatacctgaaatttgtttgtccgtaaacacagcccctaaacataaaccgaagaaaacggacatcatcgcaatcggcagcaagacagcgatacctgcgagaagattcatccactcggcggataaaccggcagcagcagctgcgataaaacaaatgacgatttgtaaaatggctaacggaagcatcggcagtgcgtaaccgatgacataatcggctgtttttaaaggggaagcaaacaaacgggtcaaaagggcggtctgtttgtcttttgcgatcagcaatgcagagaacatcgtaaggaaagcgaaaccgaaaacaatgagtccgggtgctaaatgctgaattttaaaggtatcaagcggcgcatttttttcaatcgccgtaaacagaaacaatagaataacaggcagtgcgattccaaggatgatagataagggatcacgaaaaatctctttgcggttgcgaatggcgaaatcaagcataaagacccgcctctccgtcacaaatcgctaaaaaggcatcttcaaatgtggctgaatgagtttgttttttcagatcctccgccgtgcccagtgcttttaatgtcccattttctaaaatgcaaatacggtctgccagtgcttcagcctcttctaaatagtgtgtcgttaaaataatcgtcatgtctccctttaatgtctcaagatttttccacaactcgcggcgtgaacggacgtccagccctaatgtcggctcatctaagaaataaatatccggtttcgtaatcatgcccattgcgatgctgaggcggcgctgcattcctcctgataaggttttggtttttgctctttctttctcttttaattgaaacaattcgagcatctcatctgttcttttttttgcttcttttttcggaattccgtagactccggctataaactctaagttttcccgtacggttagatgaggagcgatggctgtttcctgcggggacatattcaatttcggttttattttatccaaatcagtcgaaatactgtgtccaagcactgatgcatcaccttcatccggagaaaggagtccgcaaagcatattgattaatgtcgtttttccggctccgttctcaccgagtaaagcgaaaaattcccctttctcaactgagaactcaagacggtcaacggcggcggtttctttataatgtttcgttaattgcttcagctcaatcgcgtgcatttactcatcctcgctatctgcgtcgatttgcttagcgtttaaaatatcttttgcaaactcgaaaaagagttcttgtttaacaagtgcgataccttgctggtcatccccaagcataagcagtgaatcccccggatttatatcgaaaacatctcttgcttctttaggaatgacaatctgtccttttgtgcccactttaacagtcccgaatatgtgttttccttttggtgccgtcatgtttatccctccgaaatatgaattgtattttttgtatgaattgtaatacttcgtatactaaacatacattaaccttccataaaatgcaataaaattcatgaaacggtattgttttcataaaaaaagcactcctgccatatcaacaggagtgcttttgtttttattgtttgtattcctttatcatttccagatgggggatgcccgcatcgagaaattcttcgccggatgtgacgcggtatccttgtttttcgtaaaacgggaccgcctgcgtctgcgcatgtaagataaagctgccggcgcccttggctgccgccgctttttcaagcgcctgcattatgatggctccgacgcctaaagaacgatggcttttcattacgcagatgcgctctaattttccatgcccgtctttcaagcgccatctgccggctccgaccggctggccgccgtcatatatgactatatgctctgacgtgtcttcgaattgatcaatctcttcttcttccggaacgtgctgttctttaacaaagacctcttttctgacgaaaaaagcgtcgttcagctgtttttcagtttttacgatgatggattccaagcagttattctcctccgcctaataaaaatgtttcgtacacagtccatgagccgttatccagctgatagagcaggtgaaaacggtcgatgacttcttcgtgggaaatgtcttgcattttcagctgtccgagtacgtcggaatgttcatctgacgacagcttctggccgaccgtgacatgcggaacgaagctgtattccggctcgccggataatgctcctgagtagcatttctcactcagagattttaattcctccgtcggctctgctttcatatatatcacattattcacaggagaaaacgagctgtattttgtgattttcagaacgagcggatgcgactctttcgccgtctgtctcagctgtgatacgacctgctcgatttcctgttctgtcgcttcaaacggatctcttaccgtcagatgcggcggaatgagcgcgtagctcgggtcgtagcgtttccggtacgaatttgcgagatcctgtaatttttttgatggaaataaaacaataccgtatttcatgaaagttccctccttaaatgaatggttacagcatttttttcagcgccggcgtgatgagcggctgccagtaggtccatttatgatccccgtcgaaggtttcatacgtgtattcagactgtttgctttccagcagctgtttgagctcttcgttcggcgcggtgaaatcaagaacctggccgtccgtcgtgtgaacgccggtttctttttctccgatttgatgataaacggaaatctgtttgagatcctccgactgccggacggcatccagcacgtgcccgtcaacatacggagactgcatgatgacgtttccaaacatattcggatagtcaatcgccgtcatgagcgaaacggttccgccgagggaatccccgatcatggtgcggccgtatccgacttgataagtcgggtattctttgtcgataaaaggaacgagctcattggcgataaaccgcttatatgaggcgaacttagagccttctggatggtatgtgtttcttcgctcccgcacatttttataagggacgccgataatgatgcagcggtcaatttccccttttgacataagctcttccgcctgacgcccgattctccctaatctgaaataatcatggccgtcctgagcgatgaccgtatgatatttatacaggggggagaaggtggcgggcaggtagaccaaaacggtcatttcctcttcaagctcatgggagaaaagtgttttctcatgaatgattccgttttttgatgccacttcgcattcctccaggccgcttcttgtcttgatggttttttcctattgtaccatgaattattagaaatttctttcttcagatgcacttcttgcgagagttcagataaataaaaagttgttgaaatctattttatagtgcgttaatatagaacaatcagaaaatacaaaacaatattcttatcacgagaggtggagggactggccctttgaaacctcagcaaccggtttgctttgccgcgggaaggcaaagtgccaaggtgctaaatccagcaagcgattcacgcttggaagataagaggaagagaaaagctccttcttcttatgaagagggggcttttttatttttgaaaaaggatggtgcttactgatgacgcagcatgttgaaacaaaattagcccaaatcggaaatagaagcgaagaagcaacgggaacggtcagtccgccgatttatctgtccaccgcttaccgccatagaggaataggagaatctacaggttttgattacgtgcgcacgaaaaacccgacacgccagctcgtcgaagacgccatcgccgtgttggaaaacggtgcgagaggatttgctttcagctcgggaatggcagccattcaaaccattatggctttatttaaaagcggggatgaattgattgtatcctccgatttatatggaggcacgtaccgtttgtttgaaaacgaatggagaaaatacggcttaagctttatttacgatgatttcagcgatgaagactgtttacgctccaaaataacggaaaacacgaaagcgctatttgttgaaacaccgacaaacccgttaatgcaggaggcggacattgaaaaaatcgcccggattacgaaagaagccggcctgcttttgattgtggataatacgttttataccccggtcatccagcgtccgcttgaactgggagcggacatcgtcattcacagcgccacaaaatatttagcggggcacaatgacctccttgccggtctggctgtcgttaaggatgaagagctcggcgacatcatgtttaatcaccaaaatgcgatcggcgccgttctcccgccgtttgattcgtggcttttaatgagagggatgaaaacactcggactcagaatgcgccgtcatgaagaaaacgcccttgaacttgcagaatttttagaacaggaagaggaaatcgccgacgtgttatatcccggaaaaggcggaatgctgtctttccggctgcaaaaagaagaatgggtcaatccgtttttaaaggcgctgaaaacgatctgtttcgcagaaagtctcggcggggtggaaagttttattacataccccgcgacacagacgcacatggacattccggaagatatccgtatcgcaaacggcgtctgcaaccgtctgctgcgtttttcagtgggcattgaacatgcagaagatttgaagcgggatgtaaagcaggcattacagcaagtaaaagagggggccgtgtcatatgagtaatcacaattggacgctggaaacccagctcgtgcacaatccatttaaaacagacggagccaccggagccgtcagcgtcccgatccagcatgcttccacattccatcagtcttcatttgaagaattcgggacatatgactacagccgatcaggcacaccgacaagaacagcgcttgaagaaacgatcgcaggtcttgaaggcggaacgagaggttttgctttcagctccggtatggcggcgatttcgacggcgtttctgctcttatcccaaggcgaccatgttctcgtcacggaggatgtgtacggcggaacattccgcatggtgactgaggttctgtcccgtttcggaatcgaacatacctttgtcgatatgacggacacagaagcggtcgcctgcgccatccggccgaacacgaaagccatttatatggaaacaccgtcaaacccgacgctcggcatcacggatattaagggcgtcgtcaaactggcaaaggaacacggctgtctgacataccttgacaatacattcatgacgcctgctctgcagcgtccgcttgatctcggtgtagatatcgtgcttcacagcgcgacgaaatttttaagcggccacagtgacgtgctgtcaggccttgccgccgtaaaagatgaagagctcggcaatcagctgtataagctgcaaaactcgtttggagcggtgctcggtgttcaggactgctggctcgtattgagaggcttaaaaacattgcaggtcagactggaaaaagcgagccggacggctgagcggctggctgcctattttgacgggcatcccgcaatcaaaaacgtttactatcccggccttgccggacacccgggagccgatacccataaacgtcaagcgagcggagcgggcgccgtcctgtcctttgaattggaaagcaaagaagccgtcaaaaagctggtcgaaaacgtatcgcttccggtatttgccgtcagcctcggcgctgtcgagtccattctctcataccctgcagccatgtcgcatgccgccatgccgaaatcagagagggaaaaacgcggcatcacagacggccttctgcgcctgagcgtcggagtcgaaaacgccgaagatttagaacgcgacttcgaacaggcattgaaaaaaataacccccgcccaagtgagatcataaacgaaaagggtgccgtcaattttgcgacgcgcccttttttattttagataaaaaaagtgttgacgaatgagaaatcaggatatataattataaatgtcagagagacaacaacatacccagcaacacatacatatcatgattccgtagctcagctgggagagcgctaccttgacagggtagaggtcgctggttcgagcccagtcggaatcatagccaaaacccttgcgttgcaagggttttttactttgcttatttattgattttgtcatcattcatcgagttggggacgaattggggacggaactgcttttttgggccgattttgaagtacattcgctgtatacttcaagggaggtgaacatcgcctttaaggcggcggtctttgccgaaacctgttcattacagagaaatacagaaattccgtatcactgaacggctaaagtgataacgatcagcagctggttaatcctgctgtttttttgtatttgaaaaacggaatatttagttttgtatgaaaaatacagcgaaaatctggaaatcattcacagcacaggaaatgacgcatgcagccgctaatgaaatcagttatatgaccggtagcagtgaatcgactagatatcattttgccgtcgatgataaagaagtgatacagggggccctccatcctaaggcaagaaatcatacttccccttgctttccggttttttaagtcaaaagcccattaaaacccgaggggagagcgtaaaacagattcgaacggcgctgtcggccctttattaaagcggaagaacttcgggattgatggagcatatggagcgaaaacagcgaatgcagtaattcgatttcaattggtgaatggattaaaagctgatggaatttatgcgcttgaaccaaagcaaaacttgaagtgttgttaaaataagcggagactctttccttttttacagactctctcccacactgaacaagaagggttgtgttaaagcaaaatctaagaaattaaatccaaaaagattgcaatgacaagcttctaaagagatgaaaaatatcgggatatcaactaaggcgcaaaatgcaataaaacaggagcttgaaaaaagaaaagaaaaaacaaagagaaaaaataaaggaacaagaatatttaatcagaaaacaaaaagcaaaagaaaagcataggggcaaatagttggagaacccgctgaagcacttcgattgaaaagttgagcggcatcagttttttgcttcggactgatttagagaaaaagaagtataagtcagagcccttctcaagatgaggagggtttttttgcaatttatttaaattcacttacatcagtaaatgcggctgaacgattcagtacgattcagctcatgtatggtttgaagccagacggaatttgcggaccaaaaacgaaagcgaaattgaattaataaaagaagcccttcttaaaagagggctctttttctaactatgttgtttaagatgctttttaatttgttcagtgacttgcttaagccattctaatggagttatatcatcttcaggaaagtatataccatccgctgcttcctctataaattcattcttgtcttcttctgaataatcactatttacaaactcagttagtgctattaaatctctttcttttagtttttgtgatgcttcatttaaatattcatcaagtgcattttccggagactctatatcttggtgaaaatgtccgccgagaaatctaaatacaggatcagaaactttaatttcaatcattatatatcacctcgttgggtagcctgttagtataaagctaccatctttatttttctttaatactattctagcattagtcatatctttaacttcatttgaacctttacgaactcctctacctataacttcggttcctctataaggtaacggtaatggatcgttaacatcactttttaaccactcttcaatttcctttttatgtttagttaatgtttcattagcgactctttctgcagttggcctatcagtgaaactagaagaggcacgtatcttcttgtttatctgtagcctctgtaataactcttcatcagtcttcccaacatgcctttctagaaggtgtccgccttttgcttcgtgagcagctaagccaccgcctggtgcgagaggactgctgtctccttgtttaacactatgtatgccgttattgtcagaagtcacagatttactgagcacactctctttctgatcttcaataatacttttcaacaaaggagtattcttcacattgtgagtattttcaatatcctgtgctattccggcaagcgcgggttggtacttatttttcgaaacggaattgatataattttttcctttttcaatcccggtttttacatgttttgcagctgctttttcaccggcttccaagacgttatccactttggcggcgcctgttttcgcgagcttgcttgatacttttacagctgagccggaacctttgagcccgacgatgctcccgatggcgtaagtgatgtaatgggatcttgaatacgcatccccgttaaccattttatcattccacgaatccgccaggtttgtccatatgatttttgcgtaggagggcgtgttcaatacagccgatatggttttagcgactttttgttcatcggagagatggtaaaaatcccatgcgccgacagccagatctttgacgccggttatggtgtcttttcccacatcataaaggccgacgcctattcctttgacgatatcccaagccgtttctccgacttcttcaagctgttttgcttgttcaagctgcattacatattccacctgagcgggttcaaggttttcatagccgatcttctttgcgatttccaaatactcatccggatcggtgacaccatcagccagctttttcttcagatccttgatttcacgctctttcgcttcttcctttttaatcgtcaaataagcatccgaatgtcttgcgatatcgccttttttcttatggatgtcgctttcacggtacgctttggcgttgtagtgaagcggcgtggcgctttttcctttgcctgtggcgttttggagctgctgaaagtcggcttggataaactgttcgttcgcttcggtttctgcgtattctttcgttagatcgtgatcaagcttgccgagtttatgtatggtttcgcttctttttttgtcagctgaagaaagcttttgatctgtgctttcggttgaaaacaattcgagcgagatgatgtcttcgatctcaccgaggatggagcgcatgtcttttttctgcgcttccataatcgcctttgatttactgagggcatgggtgagctcgtgctccagaaaagattcttctacatgagattcggaaagacctgcgtcttcgactttgccgggaaggcttgtgagaaatgcgattttcatatcgatcagatcaagccagctgtctgtgacgccggcgtgatcctggaaaaaggctttgatattgtcagcgccccggcctgagaaatcattgtcaccaagatcagccataccttgaaacgctttttttaggttgaccatctgaccgcgcagttttttatattcacccgcacgctgtttggcggcggcgaggagggtggttgcttcgaaaactttcatgaccatatcctttcatgcgaaatacttcaacaagatattaccatggaagaatgaaggaaaagccaaataagtattttgaaagtgcaaaatgattaatttgttctgggtaaatttacttattttatgatcgggaattggggtagagttagctttaggttgaatcggttgttagaacatcatgtgacgcacttcctttaaaaagcatacacacacatattagagggctgaaatttacccgaatgaattaggatacggcggcccaaactgctttccgcatggaatcaacctgggcaactggtcaatagctttaaaaacttcatcataacagggaagtgcggcgggcattgggaatataaaggaatataggcttacagctatgcaggatggatgaaaatccgtcagacggcgaaggaaaggcaatctccatgtgttgtgacagttcgaatgcgggggtacggaacttcccattcatccgagttatgtcagagggacgaaaagacttttttgaggaggaagcggaatgattaaatttacacggccttcacctatgaagaaaacatgtacgatgcacccggaaaaggaatctgtcagatcggtttcgtttactgattttaacggcaattctgtaacagtaacactttgtcaaatgtgtctggctgaattaaaaatgaaagccgcgactgaatacaggagcatgaccgaggagcgggccaaactgaatcgtttcaagattggtgatcatgtgtatttagagcatttgggagtcgtcagcgagataaaaaacatggaaggcgctcaagtggcaaacaggacagacacagacggagtccggaaggctacccctaaggaaatcgcagaatataaaaaacaggggaagcgatgacggtgaaaaaacgactcagtcaattatttatcagttgtgttacttatgggagcgggggccggatgtttacgggtgcgcgacttacacggccggagcctccacggtggagaggaggagaattcaaactaagaatgtgaattgatcaaacgcagtttcatgaatcttcgaaggctttccatccgaaatttgggtgcagtatgggaaatttttttgtggaaacttgacataatgctgtcaggtccctattgtatgattaaatgaatggccagtaaaatgataggaggcgttcaatatgaaactgctgcaaattagactattggttaatgactttaaaaaaagcgtcgagttttataaagattcattaggacttccaataagttggttagagaaggaaatggaatatgcacttttcgataatggagaaacgaaaatagagcttttatctcaagaaaatatggctgaaatagttggagaagaaagaaaatctttagacggagattcgcaatcgagatttttgcttcaatttaaggtagaagatgttgataaaacgtatgactatttgcacaagcaagggattacatgcgtcaatgaaccacatgatcgtcaggaatggcgtgcacgagttgctcatttcagagatccagataataatcttattgaaatatataaaatgatataattttgaccgcgagattaaggtaatgcgtttgttaacttaccttatgatttttatagtctgcaagagaaacatatatagatccaagacggaaagcctgcggacactgatcattgcacagctcactatgctctgattggtgtccgtttttatttgcacggagggataacaaatagataatgaacacgaagcggacatgcaaacattcagacgcggcaagggcggcgcatttaataaggggaggaatcagaatgcaggatttaatcattcacaggaaatatattgactttcatcctgtttgtaatgttaattagaagatgtatacaaaaacattataatgaggaggtctggatgtgaaaaataaagcgggaatacaagttggaatatgcattgggcttttatgtttaagctttaccggtttcagccctttattcggctctacgcacgctgaagcaaaatccatagaaaacacaaaaatgacaagctgtataacgaatcaaaaatttgttcagcttgagaaaaaatttgatgccaggcttggggtttatgcgattgatacggggtcaaacaagacaatcgcctatcggccgaatgaacggtttgcttacgcatcaacctataaagttctggctgcagctgctgttctgaagaaaagctcaaatgaaaaacttaatgccatcatccgctacagcaaagacgatttagttacatattctccaatcacagaaaaacacctggatacaggcatgagcctgaaagaaatctcagaagccgctgtccgttacagcgataatactgcggggaacctattgctgcagcagcttggcggccctaaaggtttcgaaaaatcactgaaacagattggggatcatgtaacgaaagcggatcgattcgagacggatctaaactctgcgattcccggggatcgtcgtgacacaagcacagcaaaggcactggcaaccgatcttaaagcgttcactttgggtaacactctcacgactgacaagcgcacgatcttaacggattggatgcggggcaacgctaccggcgatgaactgattcgggcaggcgctcctgcaggatgggaagtcggcgataaatccggagccggaagttacgggacgcgaaacgacattgccatcgtttggccgcctgacagagctccgattgttttggcaatcctgtcaaaccgatttacagaagatgccgattatcataatgctcttatcgctgaggctgcaaaagtcgctcttcatgatcttaaataaacattgccgttcattttttatggacggttttttatatgttgagaatgcggtatgcgggtttcgatgttataatgtaaagccataaaatgatgggaagagggggagtttcgatgcattacataacggcatgcttaaaaatcatcagtgataaagaccttaatgaaataatgaaggaattcaaaaacttgaggaagaaacgaacaaagaagaaggctgtattcagttccatgctcatccgcttgaaccatcagaacgcaaaattatgctttgggagatttgggaaaacgaagaagctgttaaagtccattttacgaaaaagcacacaaaagacgttcaaaaacaagaattaacggaagtagaatggttaatgaaaagcaatgtgaatgagtaaaaggctttgtatgttgttggctgactctgccggcaacaatcatcagtttcattcattaaaacccttgctgcgcaagggttttttactttgaaaagttctttatatcgcagtctttttatgggtaaggaacagacttggaatgaagatggccgcaaggatgatgacggatactaagaatccggcatggtagccttttaaactgttcggaatcgttggctgcaatccttgtatgacagttgcggtaacggttgcgatcacagctgacccaaagctggaaccgaggttttcaatcatatgaataccgacacctgcttccggaagctgtttgctgtcaagacctgtataagcgtcactcattaatgggagcataattcctccaaaactggtgccgcggataaataatacgacggaaatccaaatcatacttgtgttatcggtgataaaaataagcgggatagatccgatcagcgaaagaacaagactgaccgtaaccacgtatttcgcaccgatcttatcaatcatttttccgatcagcggacgagtcacgagcattccgactccttgagggattaaagcgagtgctgctccgactgccgtgaaatgacgaatgtcttgaaaaaacagcggaagtattaacatcggccccatgatggcaacattcgctaagaacaacccgatcgaagatgctaagaagctcttgtttgcaaacaaattcataggcagcacggtttggtttttcttgatcagattatatacaagataaatgactgctgaaacaagaccgatgcccgcccataaaatggtgtcgctattgttaaatgatgcatgatccgccgctttcgtaataccgtacatcaatgccgcgctcattaatgacaaattgataatcccgaaaatatcgagtttacgatctttgttgaatggttcaaagtctggaatggttttcatcataagcggtgcggcaaccaaaacgatgaacacgttgatgtaaaaaatccaatgccatgaagcgacttggacgatgaagcctccgatgacaggtcctaagatcgggccgaagatcataggggtgctgacgattgccatcacttttcccaggttttccggacctgccgttttaaccaagagtgttgacataagcggagtgataatgccggcgctgaatccttgaagcaaacggaagaagatgaagctggaaacgtcacggctcattcccgcaaaaacagaaatgacaccaaaggcgatgactgagccgatgaagattttcttaccgttatatttattcataagccagccggatacgggtactgcaatcgcaagtgctaacatatagcctgtaacggaccactgaatggtatccaatgtcgtgttgaagtctttggtcagtttgtcgatggcgatgtttaccatcgtagagtcaagcattggagcaattgctcccagtgcaatagcccaggcggctgtgagaacttcttttggcagccgaagttcctttcttttatgtgttgacatattattctcctctcaaaatcgccgtatttgtttccttgtcaacaaaataatagagtgattttgtttctttgtcaacaataagagggatataaaaaggcagcccgttttcatggagcagggctgcctatggttttattccgatttcatgtctgcaccaagtttctttatttctgaatccaaatgcctgctgtatgtttccacgaagctcagcatcgtgtcaaattgttcatcagttacttgttcaaacacgattttgtcccgttcttgaaactctttgtgcaattcctcgtgaattttataaatgacttttccttgctcggtaagcctgaaatagatttctttcttattaagcggcttctgatagctttcgataaggcctttattgataagcttcttcgttaatttacttatagcgcctcttgtcatataaagggactccgcaagttttgtcacattggcgtcttcaattttttcgatgaattcgatgcaatgcacttcagaaggtttatgccccttaaggctttcttccatcttcagcctattcagccacaccatcttgttaaaaaagtccctgaaatccgtgaggagctgttcttttttgtccatgacccgtcctcctgctcggtggtgcttacacaatattataaaatgtttgtttctttttcaacaatcgtaaagttattatttaggaactgagagatagtgcgcagaaataagaaggagggggaacagaagaagtatcctatttttaaccgaaatgtggtttttcgagtatgtttctttccgtattcgttattagctcttcataacaggctaactctgcagccttacaaaaaagcaggctgcgaaaagagcctgctttagaattgcatcaatcattttcctgttgcggcatcataaaaagcgtcaattgcggttgtgtatttcaagacgtttttagacacttttgcggttgcgcctaatggatacgcatctgacagaacgctggagtgagcttcgggttcccagtaaaatacgccggttcctttgccgttcggaacggctttcaccagttttatggtgtcttttatggtccagtaggaatctttcggattattttcatctccgcccagttcaaccaccatgacttccttgttgtagcgtgaggcgatgtcattcaaattagatgataaatggccggtgagctcccagtacggcttaccttcccaatagggatagaacgaaacgccgatgatgtcggttttccctccgtttttaaagaattgatcaaaccaccatctgaataggctgttgtccgtgccgtgtgctaaatggctgattaccttggtggccgggctgacggatttcacggcgtcatagcctttgttcagtaagccggtcaatttgctgaaatcgctcgtgctgccgtcgggcagtaaaattcctgaattcatttcatttcctacttgcacccaatcaggagagatgccgtgatttttaagttctttcatgacatcgtacgtatggttatacacggctgcctgcagctggctgtttgaatagccggtccattggttcggcttgatctggtggccgggatcagcgaacacatcactgtaatggaagtcaaccattactttcattcctaacgcttttgcccttttggccgccgcaagtacgcccgctttgtcactatagccgagcatcgtccatgttgtgccgtctttcagccaataatagctgcttggcggattcacaaacactctcagtctcacggcatttattccgtgatctttaagaatctgcaaggcatctttctgtttcccgccgtcatccagccagcgcacaccttcatcctccatttgtttcagccatcctatatcagcgccataggcaaacggggcatccgcttttgctttaggagacttctcaagaaatgtaaaagcggtgaaaatgagagaaagacagattgcgtttacaaatacacgtttcaatcggtttttgaacatcacaatacctcctgataaaaaagattgttgattgatttcactctgaatgtttcagctgtcattctccaataacgtcgtgaaacgctgaaacgcctgaattccttcgggtgtcattttaaaaacgcctgcatcggtcagcgcgcgtaaaaatacattcgcggtttctctttgtaaaacagcggctgcattttccggtgtcacgtctttatccgctttgatgttttcagcccacggaagatgaatgtccttgatgtcatgatgttcattcagtaaatactttttcacttctgccagctcatctttcagacggggaggtaaaacggcgagccccatcacttcaatcagaccgatattttcttttttgatgtgatgaacgtcttgatgcgggtgaaaaatgccatccggataatcttcggaggtgcggttgtttctgagagcgagatcgatttcaaaatccgttcccctgcgtctggcaatcggggtgacggtattatggggttcatttgtcttcgcgatgatgctgacggtttcgtctgaatattcccgccacttttcaaaaacatacgcagcggcatctgtcagcaaatccggatcttttgcgcgaaggcggatcactgataccggccacttcacggcttcggcctgaacgtctggaaaatgacgcatatgaaaagggtagagggaacccgcttttgccatgggaaactcatgggcgccgccttgataatgatcgtgtgaaagaatggaacctcctacgatcggcaagtctgcgtttgatcccgcgaaataatgagggaaaatttccgtaatggccagaagccttctgaagctttcgcggctgatgttcatcggcttgtgcacgcttgaaagaaagatggcatgctcgctgtaatacgcataaggagagtattgaaaaccccactgttctcccgctaagtcaagcctgatgatgcggtggtttgaacgggcggggtgatgcggtgttccggcatacccctcgttttccatacagagcagacatttcggataccggttttccggactgttttttaccgcggcgatgtctttagggtctttttccggttttgatagattaatggtgatgtccaattccccaaaaggtgttattgagcggtacacgatattttttcgaatggcccgcgtcttaatatagtcgttgttttgactcaatctataaaaataatctgttgcttttttcgggcaatctgataacaattcgctgaatgcgtcattgatcagagaaggggccggtgtgattacgtccatgattctgcttcccagcatgtctctttcagccggcgtatcgtttatgattgaccgttttaccgcgtctttcaccatttcgtccaaatagtgaagcctgttttgtttcttgatacgtttcggttctgcataatccgtcagtccgagcagatcgagaagtctgtttcttgtataaatcacatctgtttcatttatgtcgcctaagacagtgctttctttcagaaaccctgccactgattcaaaaacgtcaatgaccgccgcctccatttcatttgtccttgtatccgttaggatgatgccgatgccaattccatgctgacgcaatgatttccgatatgtccgtttgtttcggattccagccgagaatgttccgcgctttatcgctggaagcgatgagggcgcttggatcaccgggtcttcttgcggacgctcttacttttatgtctctttcggtcacttgccgggccgcttccgccatttctgatacggaaaacccgctgcttgatcctaaattgaaaatgccgctgtctccgccgttttgcaaatattccagagcgagaatatgggcatcgattaaatcagaaacatgaacataatcgcggatgcacgtgccgtcttttgtatcatagtcagtgccgaatatcaaaacctcctcgcgctgaccgagcgcggtttgtaaaaggatagggataaggtgggtttccggatgatgatcttctccgatggaaccgtccgttttcgcgccggcaacgttaaaataccgaagcgagacatattttatgccgcaagcggtatcgcaccacttcagcattttttctgccatgagttttgattcgccgtatgcgctttccggcttttccggcatgtcttctgtgatgggcgctttttcaggttcgccgtaaacagcggcggatgaagaaaacacaatgtgtttcacttcgaattcctgcatgacctccagcgtaatttgcgtaccgtacacattattattgaaatatgaaagagggtctttcattgattcgccgacaagggattgagcggcaaaatggagaacgcctgttacgttctccttcgcaaatacagagcgaagaaacggtttgtcacggatatctccatggtaaaaaacggctttttcatgaacggctttccggtggcctgtctggagattatccacagctatcgtttcaaatcctttgtttactaattgatcaaccgcatgagaaccgatatagccggctccgccgagaacgagaatcgccatgatttatttttccctccattcagccgcgccatcgcttatatccgcgatgtagaaagaagcttcaagacctgtcctgctgcggtagtgagatgaaacggcccggataaagccggcggtttcttcactttccacaatggctatggcgcagccgccgaaccccgcgcccgtcatccgcgctccgagtgctccttctttccaggctgcttcagccagcgcgtctaattcgtcaccggtcacttcgtagtcatcacgtaacgaacggtgcgacgcattcatcagctccccgaacgttttcaaatcattcgatttgagagcttccgccgctgagagggtccgctcgttttcattgaccgcgtgccgggctcttttacgcaaagtttcacgggagagaagaggttcgagttcgttgaattcttctcccgtcaattccgcaagtgatgcgatattttgatattgccgcagttccgtgagagccgcgtcgcattcgctgcggcgttcattatactttgaagccgccagctcccggcgcttgttcgtattcataatgacgattttatatccgttaaaagcagccggaatcatttcgtgctcaagcttatcgcagtttaacagaatggccatgttctttttgcctttttgcactgcgaattgatccataatccctgaattcacgccgataaattcattttcgactctttttccgataagcgccagttcagtatcggaaacatccaggctgaataactttcttaaaatggaaccggttaacatttcaatggaagcagaggagcttaaaccggctccgtttggaatcgtaccgtgaaaaagaatatccattccgctgtctatttggccgccggcttcaagaaggtaatggaccatccccttcggataattggcccagccgtcttcttttttgtatgcagtggcggaaagatcaaggcagacaatgccgctgtcaggaaagttttctgagtataaccggatctggtgatcttcgcgttttgcgcatacggcatatgttccgatcgtgatcgcgcatggaagaacgtgaccgcctatataatccgtatgttccccgatcaggttgatccggccgggtgcgaaaaacagttctccgttacttctcttgaaaatgtcttcgaatcttgatttcaaaagtttggcatccatggtaaacctccgattctattttgaggtatgctccagtatgaactgaatggctttttgtgaatttctggtgaggctgatatattccgctcctttcgttgcgacgagtttcacatgcaggcggtccgcatcttctttaatgtcatcataataagagccgacttgcggagccaaaatgatcatatcgaagtctttcatgatgtcgtaatgggatccgtaggcgcctgctgaggcggtgatcggcacgttgtattcttcggctccttcggtcagtgcgttcgcaagcatagcgctcgttcccgctccggcgcacagcactaacacattggtgccgtgttccaaggcggatgaggattcctgaagatttgtgctgatgacggtggccgcgtcttctgaggcgccggccattacgggctgtatctcccgggatttttgcggcgcggtttcaggttcggtatgttgggcttcttccgccgctaatactttgtcataagctttacagaatggcaggtatatcaggaaatcgacaataattaatacagccgtcagaacaaaagccgagagccccatgccggttccgagaatcaagccggcgggcgccggggtggcccacggaagaacatacataaaactgttcattccgatgacatccacgaaaaatttaaacagacagacattcaccatcggcgttacaacaaacggaatgaaaaaataaggatttaaaatgatcggcgcagcaaagagaagaggttcgtttactgcgaaagacaccggaaccgcggatgcttttccgactgctttcaattgcttggatttcgcgaaaagcagaaagataaacggaacaacaagggttgcgccggttcctcccattgtgccgacgaagttcccgagtccgacggtcagcacgttggacgcctgctcgccggcattatgaagctgaaggttcgcctccacatttgcgtaaataatagctgcgatggccggctctacaatagaaggcccgtgaacgccgacaaaccagaacagcgccatcattccccaaatgacacaaatcccgagataaccgtctgcggcggtaaaaaatggcgataagagagaggagagagcctccgcaaacgatacattcagcgtattcctgatcaataaatcaacgatcaccatggccaaaacggaaaaagcgaacggaaaaacatctttaaatgtttgtgaaatggtacccggtacttctttaggcattttaatcgtaatatttttcagcacgcagaatctgtaaacgttcaccgttatgaaagcggatacaaaagcggctaaaagaccttttgtgccgagatattccgcggagaacccgccgtcgatttgagtgacgcttaaaatgagaaacccgacgactgaagcaagcatcgctgaaacggggttgatccctttgtttttcggcatttttcggttcattgattcactcaggcatttcgcacttgttgccgcaacgatcagaccgagggcgcccattgaatagttataaactttccaaagccattcagaaacacttttaggccaagtgaaacccaacacttccggcacagcggcggtgaggatgaaaatgctggcgaataaaataacaggcatggcagttaagaagccgtcgcggatcgcgcctaaataaatgtttcttgagattttttcgaaaaacggttttcccttttcgatttgcttgatgataccgttcatttttccactccttatcggcggcttcggtagagttctataaaatcctgaataagatcacggagcaaaagggttgtcatcaagtggtcctggccgtgaacgaaaataaaccctaattccatgtccttgccgtcagcttcttcagctaacattttcgtttgcgcattgtgggcgagggttaaattttcatcggcgcttttcaatgctgcttccgtgttttcgaagtttccggcacggacttctttcaggactttcaataaagtgctcctggcgtcgccggcataggcgacgatttcaaaaccgagcatctgcaattcttcctttgtcatgaaaaaaacctcctaaagacggcacacatgatggaaagagattcttttcatcatgtatgatcgttaaatgattgtttttgtttcacttacaagtttgtaccagtaggccgattctttcggataccgtttttgggtgtcgaagtcgacgtaaaaaagaccgtaacgtttgttgtagccgttggtccatgaaaataaatccattaaggaccataagaagtacccctttacattgactccgtcggtaatcgctttactgacggcttctaaatatacttttaaatagtcgattcttgccttatccataatgatgccgtcttcaaactcatctttatagcccatgccgttttcggtaatgtaaattttgttatattgcggatagtcccgtttgatgcgcatcagcatgtcatacatgccttcagggtaaatgagccagtcccaatcggtccgcttcaggccttctttgtaaattcgttcgccgattccttttactttatagaccgaagtgcccttatcgcccgttccgttatggtgaataacggtttctccgtcgtacgctttgacgaaatggcattgataatgattgatgccgagataatcattgcgcgttgaggcttttttcatcacgtcaaagtcactgtctgaaaactcgtatgaagcgccgtttgcctcacagatttcatccagagcacgcatggtttcctcagaataatagccaaggtaggtggcatcgaggaggaatctcactgataacgcgtcatccagaaaacaggcgtggcggtcttcttctgtgccgctggcgggatattttgtttccaatgagtggacgaccccgatttctcccggataaccgccgtctttaaaaaggttgacggtcatcgcatgcgctaccatcatgtgatggaggcattgaatgacttttgtgatatcacttttaacagatggcgggaaaaccccgagtaaatactggttggtggctgtgggataaatttcgttaaacgtgctccaatatctgatttcgctgaattctttaaagcaaaactccgcatagctgacgaacgcttctattgcagcgcggttgaggaaatctccctgatcaaataatcctttcggtgtatcgaaatgatgcagcgtgacaaaaggggtgacgttgcgtttatggcactctgagaaaatacgatgatagtaatcaacaccttcctgattgattttgcccgtgccgtcagggaaaattctcgtccaggctatagaaaggcggatgccgtttattccgaatttttcacatagtttaatatcttccggaaactggcggtaaaaatcacttgccggatcagggctgaatcttccctgtttttcaagaaattcatcccaggccacagggcctttgccgccttcttttgtggcgccttccgcttgatatgccgcagtcgccccgccgaaaataaagtcatgaggtaatttgagcattactgaatcctccttcgccaatgtgtgaattggagtttgttaatgtttgtaattgttgtcttttgtttaatagtaaacgcatatatttttgttgtcaatagcttcataaagaaataacatctgtgtttatagaggttatataagtttttcgttgttttacatgttgattatgttgtttgttaatgtttatttttgttgaccggattgccgcagtatgttagattgtgtgtaaagttgaggggatgattgaacatgttaaaaaaagagcgacttttaaaaatcatcgatatcgtaaactcgcgggggtttattacggtgagtgatattatcgatgaactggaagtttctgatatgacagtgagaagagatctggacgagctggataaggccggaaaaatcgtacgtattcacggaggcgcacagagcatatcttattccattgatcacgaattatcgcataatgaaaaactcggtgttcaaatggaggagaaggggaagatcgcggaactcgcagcttcctatgtaaatgacggcgataccgtttttttagggcccggcacgacgattgaacttttagcgaaacacctgctgcataagcgaatcaggattatcacaaacaactatcccgtatttgatattttgaaacatggcgacactgcggataccatcctgattggcggcgacttccgaaaaaataccggtgccttcgtcggccccatcgtgaacggcaatctgcagaaattcaattttacgaaggctttcatcagcgccaacggcatacataatgatgagatttcttcttacagcattgaagaaggggaagctcaccaaatcgcgctgaataattcgcggacgaaatttttgctggcggataataaaaaatttaaccgggaagatttttacgtgttctataacttgcacgatatggactatctgattacggatgataaagtcatgaaagatgttcaaattcattacgagcaatatgtagatgtcaaaatcgcaaaaaaataaaaaaggcgggcggttcgatgaaaggggttatttttgatttcaacggcacgatgtttcaagattcgcatctgcacgaaaaagcatggtttttcatggtgaaaaaatacgcgccgaaaaccatttctgatgaagacattttcgttaacattcacgggagaacaaacagtgaaatcctgacgtattttatttccggcgatttaacaaatgaagaaatcaggaagctgtcttttgaaaaagaagcttactacagagaattatgccttgaaaacaaagacgaattaaagctgacgaagggactgaccggcgtattgaatcatctgaaaaaatctgaaacgccgatgaccatcgctacggctacggtaaaggaaaatgtcgagttttactttgacgtctttcatttggatcagtggtttgattttgacaaagtcacgtttgatgacgggagcttccccggaaaaccggcgccggatatttttctcatcgcatcggaaaagttaggcctcagacctgaagaatgcttggtcattgaagatgccttttcggggctcacagcggcgaaaaaagcaggtgcgggcaagattatggccattgacccgcacggaaaaaaccgcgcgctatttgaagaaaaacagctggcgggtgacgggatactgacagatttcacctcgttttttgaggtgattgccggacattctgtttgagagatgcagttggattgagagtgatctttactttaatgtgaaatgcctttggttgaagctattatgagcttcattaaggattcattgagaggtgttattctatattacacttatatactaaatttttagtaaactgttggccaataaccgagaagtgaaaaccaaatcacttttaaatccagaggcctttttcaatatttctttgatcgaaagtaagtgatcttggatcgcttagttaaatgaatctcttgtcatacgatcgccatctataaatggaattatcacaaagatgagaggaatgaataaattgacagagaaatatgacaagtggacaagattacttgatatgattgaacctaattatgcttttgaatcagcagttgtgggtaactctatttatgtattgggaggtgcacgtaatcaaaaatataacaaaaattatagttttgacaccataagtcaaaaatggacgcaaggattagatatacccacacccagggtaggttcatgcacagcagtgataggtaattatatttatgtattgggcggttataagggagcaaatgtttacagctctgtagatgtttatgatactaaaacaaatacatggggacgtgtacctgatattccgaccccgacttgccatgcatcagccgctgttattaacgatacaatttatttgattgggggattcgacaccgatgctgctcattcgcaacattatgcttttgatactttatccaaaacttggagtgttaaaaaagcgcccccaattaatatatatgcaacagaaactgaagtttttaacggaaagatttatttagttggcgggcaaactaaagaagtagttcaaggacatatcagaagcgatctaaacgaatatatttacgaatatgatcctgttatggatagatggaatcgcaaaaaatttttaggacctttgcaaaatacttcgacagctgtccttaataataagatttacattattggcggtagaaaaaatccaagtgtgattgagcctttaacaaaagtatatgatccaattaaagatgaaattagcgtagaaaaaccctatccttttgaaagatatgatgccagaatagccgcagttggagacaatctttatctttttggcggtctaacgccgtctggatatgcattagaatatctgcatgctcttactccggtaaaaaccgaagaggataaagatggagaaccaaagaatcctgaggaaccaccaaataaacagcccgccagtaatcgggcaattcttcttgttacaatgaccacaggtcttgagaaagaatttgatctttcaatggaagagattaaagattttatcagatggtatgatcaaaaaagttctggaataggcttatctagatatgttatcgagaagcactataataatatagggccttttcaaaatagaagggaccatattgtttttggaaacattcttacttttaatgtgagtgagtacactttagataaataattacctgttttccttctgcagccctcttttttaaaaagagggctttttttatgaggtgcttattctttttcagttgcgcttttgtttttgtataatgattttctcattgaaggcggcattttttgcatcagaaaggtgttcgccttaattgaaatattggctgaatttatagattcgcagagataagggagtcgtaaaagatatgccgtttgcggatttcagcctgtcttttgagaaggatcattcttcaatgacgcttatttcccccgtaccgaaaaaaagtgaaacacgttctcctcgcttttcataggttttgataagtccttcctgccctttaagtttccagcctttttcggctatttccaattggtataaaccgctcggaccttcttcttcttttgcgaaacggtatgtatagtttgaaacgtattttcctttttcatattcctttgttttagtgtgcatagcgaataatggcaccgggaaatcagggtgagaaacagctgctttatatcctcccaaaataaataagctaaataacaataatataaaaaaccacagaatatatttcataaaacctccttatgtcaattagtcggtgcattttaaaaaaagatacaccgcatgattgggttataaaagcgggtaagaagataaggaaaggagagagacggatggaacttgattttgtgattcgtctggcggttgcgggtctgcttggggctcttattggattggagagagaattcagggcaaaggaagccggtttgaggacgcattttttagtggccgtcggcagcgccttgatgatgatcgtttccaaatacggcttttttgatttgttatccaacagccatacgtcctttgatccgagccgggtggcggcgcaggtcgtcagcggcgtcggatttttaggagccggcacgattattttgcagcggcatgtcgtgcgggggcttacgacggccgcggggatttgggctacgtcggggatcgggctgacgatcggggcaggtatgtatgtcatcggcatcagcggcacgattttggcgttaatcgggcttgaactgttaaattttctgtttaaaccggcggcgcattctttgtctgtcagtttcaggattgaagagaaagccgtcatgcatgatattttaacttctcttgaggaaaaaggaattctgattacgtcctatgaattgaataaggcggtgcttgaagtgaagggaagggtgaaaagcaaaagcgggaaagcagcggtaatggagaaagttcaagccctcccgtatatcctgtcggtcaaagttgaatagcagacaggggaagcctcctgtctgcagtcatttcttttcaaacattaataccaaggatagaacgggatatacggccgcggatagtatgggtatggtctggggtaataataaggcggccgcggatagtatggatatggtctggggtaataataaggcggccgcggataatgatatggcacccgttcgtggctctcggctgtgtattcatgatcgaaaggatcgtacaagaggaaaacctccttttcaaatgttggttccgtttaccttattcctgtatgcccggtacggtgtatgtacaatgggcaaaaaaaagacgccggttatcatccggcatctttttttacactttcacatcaattgaatggccggcagtcgggtgctgggacggcagcattttcactgtttcttccgccgcagcctgtgcatgctgcatgaccgtttttgttaaagcgatatttacattctgcgccagagatgactgatgcattgcgattgataacgcagggatatccatagcttccacctccttatcccttcatatcggcggcgtgctccgattatgaagagggctggcggtttctttttacggcccattctaaaagtgcggcagcgcataccccgagggtataggcgaaaatgtcactccagacaaattgccagccgaggatcagcccgccgagcgtgctgcttctgatcgcgtcaatccatggcgcgtgatacagctggctgcattcaatcagacagcaaaacgagaggctcaaaattgcggctgtttccgtccggatgtgccgtaagaaaagcccgaatcctgtaaaaatcatggccgcccacaaggcatctcctaaataagcgtttatgatgccgggcaatagggcggtgatgtatgcggttctggacagcaaaccgagggcgatgataaaaacggtacatattccgtatgtcaatggatgtctattcacttcacactgttcccctttttttgtactcccatgtattgtaaggaacgacggagaagctgtctatgaaaaaacggcccgggaggccgcttttttgcgttatctggcttttaggttgacatgatctgctttttgatcactgccgatgacgaagcggagctcatactgccccgtatggtagacgtaatctgtttcgcccgtttctggcactgtcaggattttgtcagcgctgccgatttgtttgcttaagacgtcaggtgtgacgctgccgaggtttaagcgccgctcgacccccgttccaaaatagcgtatttccgagatttttccgtttttatgataggaaaatccatacccggggtttcccatgttccagctgtataaatcaaatggattgcggctgtctgctttttgttccggctcgccgattttattgtaaacgtcctgtcttgtgctttggttgattttcaggcctttcacattttgcggcatttcccctttaaatgccgattggtaaaggctgttcaccagttcttgtgcacgctggttttccgtttttgaagcggctgcggcatggacgggctgtgtatccgaaaatgcttctgctccgaaagcgcatcccgtgagcatcactgccgataatcccgtgacgagtgtttttttcttcaacatgtgaacgcctcctttttaccgctcatacccgtatgtttcctgagataaacgagatgttttagtgaaaggccggttgggaatcatagaggatgtatagaggggtacagaaaggggaaagaaaatggctgatacaaagaaagttacaatcaatggggttgaaatggaagcgccggacggccaaaccgttttgcagcttttgaacaatagttcaattgacgtgccgcacgtgtgttatcacccgagtctcgggccgattgaaacgtgcgatacctgtatcgtcaatgttaacggggaactggtgcgttcgtgttccgcgcaaataaaggacggagatgtcattgatacgctttcgtccgatgtaaaaaaagcgcaggttatcggcatggacaacattttgcacaaccatgaattgtactgtacggtctgtgattacaacaatgggagctgcgaaatacataataccgtaaaggaaatgaaaatcaatcatcaaagcattccgttcgatcaaaaaccgtatcctaaagatgaatcaaatccgttttaccgatatgatcccgatcagtgcattttgtgcggacgctgcgtcgaagcctgtcaggacgtacaggtaaccgaaaccttaagcattgattgggagcggaaacgcccgcgggtcatttgggatcaggatgtgccgatcaatgaatcatcatgtgtttcctgcggacattgttcgacggtatgtccgtgcaatgccatgatggaaaaaggcatggaaggcgaagctgggtatttaacaggcattaaccaagagacgcttcggccgatgattgatatcacaaaaggcgtcgaaaccggatacggatcaattttagccatatcggatatggaatcggccatgcgggatgaaagaatcaaaaaaacgaaaaccgtatgcacatactgcggtgtcggctgcagttttgatatatggacgaaaggaagagacattttaaaggtcgagcctcaggctgaggcgcccgcaaatggaatttcgacgtgtgtgaaagggaaattcggctgggatttcgtcaatagtgaaaagcgccttaccaaaccgcttatccgggaaggagactcgtttcgggaggcggaatgggatgaagcgctgcagctgatcgctgataaatttaccgatataaaagaacatttcggcccggacgcgcttgcgtttatcacatcttccaaatgcacgaatgaagaatcatacgtgatgcagaagcttgcaagagccgttatcggaacaaataatgtcgacaactgctcacgctactgccagtctcccgccacggccggattgttcagaacggtcggatacggcggtgattcagggtcgattacagatatagaaaaagctgagctcgtgctgattatcggttcaaatacatctgagtctcaccccgtcctgtccacacgcattaaacgttctcataagctgcacggacagaagctcgtcgttgctgacttgcgaaaacatgaaatggccgagcgctccgacgtgtttttccagccgcgtgccggatcagatattgtctggctgaatgccgtatcgaaatatctgcttgatcacgatttggcggatactgcatttctgaaggagagagtgaacggattagatgaattcgtgaaaagccttgaaccttatacgatggaatatgcggaaaaacataccggtgtggacaaggataccttaattaaagtggcccggatgattcatgaagccaaaagcgtatgcgcactgtgggcgatgggggtcacccagcatatcggaggaagtgatacgagcacggccatttccaacatgcttcttgtgaccggaaattacggcaagcccggcgcaggctcatatccgcttcggggccataataacgtgcagggagccagtgatttcggcagtatgcctgacagcttccccggctatgaaaaagtaacggatgaaaaagcccgcaaaaagtatgaacagggctggggaacagacctgccgaaagaaatcggaatgacaaatcatgaaatgatcgagggcatccactcgggaaaactgaagtgtatgtatgtaaaaggggaagaaatggggcttgtcgactccaatatcaaccatgttcatgccgcctttgaaaagcttgatttcttcgttgtgcaggatatttttctctcgcggacggccgagttcgccgatgtggtgctcccggcaagcccgagtcttgaaaaagaagggacgtttacgaatacggaacggagggtgcagcgcctttacgaagtgtttgaaccgctgggcgattcaaagcctgattggcagatcattacggacatcgccaaccggctgggcgctgattggcgctatgaacatccggcagacattatggaagaagcggcaatgctttcgccgctctacgtaggcgtcacttacgaacgtctcgaaggctacaattcactgcaatggccggtagcagcggacggaaccgattcaccgcttttatttacggacaagtttccgttttcagacggcaaagcgattctatatcccgttcagtggaccgagccgaaagaatttgatgaagaatatgatatccatgtgaataacgggcggctgctcgagcattttcacgaagggaatctgacttaccgatcaaaaggaatatccgaaaaaacaccgagtgtgttccttgaggtctcgcccgaactcgccgaagaaagagggctggaagacggaacgcttgtccgtctgacatcaccgtacggaaatgtgaaagtcaaatgcgtcatcacagacagggtaaaaggcaaacaagtctatctcccgatgaacgattcaaaagacgccgccattaaccttttgacaagcagctatgcggataaggataccgatacaccggcatataaagaaacatcagcgaagatggagattttgaaaaaagaaggcgttaatccgcttccgaaaatcaatttccgttacggaaacccgcagccgcagatcggtgtccgggttgatcggaaatgggcgcgtcaagattatgtatttccgggagacgccgtaaaaagggggaaacagcagaatggctaaagcaatcagcggcatccgaaaacagaccgtcacagaagaagacaaacgaaaaaaggacttagaagagatcgagacggctcttttacgaaataaagacgcgattttggaatctctgcacattcttcagcacatgaacgagcgcggcgttttggcgcttctgcgcgggctcttcggccaaggagacaaagtgatggatatcctggtgaagaaggcgaatacgccggaaacggccaatatgctgaaaaatctcctgctgttaagcggcgttctcggcatgctcgatgtaaaacagcttgagccgtttatcgttaaaatcaatgcgggcgtcacaaaggccgtcgaagaaaaagacagcggcaggaagacgggttattttgatatcgtccgcgctttaaaagacccggaaatcaacaaggccgtcactctgctgttttctttcctgaaaggcatgggcgctgatacggacgatatggaaagaaatacgcagcctcctgaagaccaaaagcagcaccagaaaccgcagacgaatgagtgaacatttctcccgagcctggctgaaggctcgggttttttgtgcgcttctgctgttttcttgggagaaatttcacctccggattcatgacttttgttgtgttatgttaatagttaaggttatgaatagaaaaaaattgaaaatatgtgctaggataaaattcaaggtacgtcaactattcaaatatgaaacaatcaggagtgatgtaacatgagtaagctgaggagcacgagacaagccatccaaagaaccctgatgaaaggaaaaaacggcctggacgtatacaacccttttccttggtatgaaaaaatgagacgtgaaagccctatatactttgatgaagaaacgaaggtttggagtgtgtttttatacgatgatgtcaaaaaagtcatcagtgataaagagacgttctcaagccgcatgactgatgtgaaaagctcgattgcaaagtccatgctgaatatggacccgccgaaacatacccaaatcagatctgccgtcaatcgcgctttcactccccgtgtcttgaaggaatgggagccgagaattaaagacattaccgatcatctcctgaaacaggcaaagaacaaagggcggattgatatcgttaaagatctctcttaccctttgccggtcatggtgatttcagaattattaggcgttccgtccgagcgtatggatcagtttaaaaaatggtcggacattctcgtcagcatgccgaaagatgcgagtcctgaagcggcggagaaaaatcagcaggaacgtgaccaatgtgaggcggagctggcggcgttttttgcgggaataatagaaagcaaacgaaaacagcccggccaagatattatttctattttgataaaagaggaagaagagggagagaagctcacgccagaagatctgatcccgttttgcaacctgcttttagtggcgggaaatgaaacaacgactaatctcatttcaaatgcggtttacagcatattagagacgcccggcctttatgaagagctgagacaggacccttctctcatcgcgcaaacagtggaagaaacgctgcgttttcgcgctcccgctccgtttgtcagaaggacggtccggcacgacactgaactgcgcgggcgccgcttgaaaagcggagagatcgttctctgctacgttgcatctgccaaccgtgatgaaaacaaatttgagaaggcgggcgtatttgatatccatcgccaatcgaatccgcacctttccttcggattcggcgtacacttctgcttaggcgctccgcttgccagacttgaagcggaagccgcactgaaaggaattgtaaaagccttttcacaccttgagcccgttcggattgagccgatccgaaacagtgtcatgtacgggctggagtctttagaagccgagataaacgaaaatgagggagaagaaaaaagatgagaaaaacacacatcgccattattaatgtggccgctcacggtcatgtcaatcccacgcttcctgtagccgaggaacttgtcaatcgcggatataaagtgacattcgctacgactgaggaatttgaagcttccgttgccaaaacgggtgccattcccgttttataccgcacaagcataaaggcggacccgaagacgataaaagaacgggtaaacaaaagtgacgcgtttgtgatgtttctggaagaagcggttgaagtgcttccgcagctggaagagctgtacaaagacgaccttcctgacatcgtcctgtttgattttttagcgcttgccggaaaattgtttgcggataatggcggcatcccggccgtaaagttctgcccgagttatgcaatgaatgagtattttcaattaggaagagacgaagaaacgatggaagcggccaaacaggcgatagaagaatatcaggagaaaattgaaaatgaacaagtgaaacggatgacaatggaagaatttttcatgcctgaaaaattgaatatcgtctttatgccaagggcctttcagccgaaacaggaaacctttgatgaacgattctgttttgcgggtccgtctcttggggaacgcacaaatacgggaagtctggaaattgatgcagccgatgaccgtccgcttatgctcatctcactgggaacggcgtttaacgcctggcctgaattttaccggatgtgtattgacgcgtttcgggactcgggctggcgggttattatgtcagtcggcacaacaattgatccggaaagtttttcggatgtgcccgatcactttatcatccgccagcacgttccgcagcttgatgtgctggagaaagcaaagctgttcgtatctcacggcgggatgaacagtacaatggaggcgatgaatgcgggtgttccgctcgttgtcgttccgcaaatgcacgaacaagaggtcaccgcaaagcgtgtggatgaattggggcttggcgtgcatctgccgctgaaagaagtcactgtggcccgtctgcaaaaagacgttcagaacgtatacggcgataaaaacattctcagccgcgtgaaaagcatgcagcagaaaataaaagaaaccggcggtccaaaacaggctgtttgcgccattgaagaatttttgaaaacggcgtccgtcgaaaattgattaggaaaacaggcagcaccggacggctgcctgttttgttatatgtttttcttcatgccgcatctccggcattccctcaaaaattttccgcccttcactgagcttttaaacagcgtgtagtcgcaattgtcacatcggccgctgtgaacatcaggatattcattgaactcataaatgaccgaagtatcgtatccttttgtctcgaactctttttttgtttccatgattgaaagtccctccgcgaatcaaatcgttctgtccggttaatgatacagcaactgcacgggggattcaacgggagcatagcttgattttcccgtctgattgcgtaacaataatagaaataaatgacggcctgccatagggcgcccggcatctgaagggaagaagaaaacagcgatgggaaaaggattgaacgggaaacggattgccatcggcggttcgcggaaaacagaagagatcacaaaattaatagaaaagcagggcggaacggcggtcatccgttccctccaaggaaccgtatacctggcggaggatcaaatggaacccgacgtaagaacatttgccgagcaaaaagccgactgggtgatattcaccacaggcatcggtacggaaacgttattgtcggtatcggaaaaaatcggtctgaaagaagaatttttagcggccattcatgaagcgaaaatcggctgcagaggctataaaacatatgcggccttaaaaaagctcggcatcacgccgcatgcctcagatgaagacggtacaacaagagggctgatccgctccttggaacgatttgactttaaagataaaaaagttatgatacagcttcatggcgaaaaagcgccggttttaacggagttccttgagaaaaacggagcggaggtattccctgttctgccgtatcagcatattccgcctgaaagggagacggtcgataaactgatgggagagctgttaaacggagaggtcgatgccgtatgttttacgacagccattcaagtgcgctctctctttgattatgcaaaagaaaaaggatccgcaaaagaattgcagcaggcattcgaaaaacatgtgcttgccgccgcagtcggcaaagtgacggctgaagcgatccgggatgaaggggtaaagagggtccttgctccggacattgagcggatgggagcgatgataattgaattatcccgttactatgaatctctgaccttgtcataaaccaccattcagcagggaaaaaagcttacgcttccctgctgaatttttttaattgccagtgttccgtgaaaagggaaggatatgtcaaggcgctgagtatgatgcatgtaagaagagcggaggccatcgttgtaaaaacgatcagcagctgaaagcgcaccgcctgtatcggatcagcccccgctaaaatctgccccgtcatcatgccgggaagctgaacgagacccaatgttttctggctttctagcgtcgggatcatactgagtttcatactggacgtcaatatctgccggacggcctgcttaggcgttcctccgagagagagaatcagctggatttcttctttccgcaggtctgcttccgaactgagccggcttaaaaacagacttgagagcaccatggagtttccgatgaccatgccgcttatcggaatgacatatcttgaagtgaacggaatgatgtgaagggtcagtaaaagtccctgcgtcacggtttccgcgattgccagtgtcagaaaaacgcgccaaaatgagccgatccgcatttttttccgtttggcgacattgtgcgaagcggccgtgagcatgagaagcaccattaatatgataaatatcgggtgatcaccgcgaaaaatcagcgacagcacatagccgatgatgagaagctgaatgacggccctgacggttgcgacgatcatatccttttcgacaccggctttaaaagatttagacaggaataaagcgataatgacaaatatacttgttagtaacagtgaaagatcattcatatcagcacccgctcccttgtaaaagcgcccgggctttttcgtgtttcggttccttaaagaacgttttcgtttccgcggtctctaaaagccgtccctcagccataaaccataccgtatcggataatcgttctgcttgttcaaggttatgggtgatccacaggattgtcagctgtttttgccgatggagtttcgtaatcagtttctcaatggtgagaacggatgaggagtcgagcgccgaggtgatttcatccagcagtaggatggacggcagtccggcgagagttcgcgctaatgagagtttctgccgctgacctccggataattctttcgcattccgatccagaagcccgcgcggaaggtctgtaaaatctgcgagctcttcaggggtatagtgctgcgccccgtggagtttttctgcgagcagaaggttgtcccgcaccgtgccctccgtgacgggagctgattgaaatgcaaggcccgcggtttttctgagctccctgatatcccagcgccttatttcttttccgaatacaagcacttccccttcatcaggtgtattcatcagattgcaaagtgacagcaatgtgctttttcccgcgccggaaggccctatcaacgccgtgatagaacctttttggatatgtccggttacacggcttaggacatcaaaggacgtattgttttgttcaaagcgtttgccggctgacagaaaagatattgccggaatttcttctttcatataggatgacacctttcgtaaaaaatcaggaaccggtgagattggctgacgtttgctccgccgttttctggtctgtctgccgggaagcgaatgtatgcatgaccattcccgcaataataatgaacagtccggcaaatgaaagaagtgacggaaacgccgcggataaaaagacgatttcgccgatcagtgcaaaaagaacctctccggactgcgtcgcttcaacagcagcgagcttctgcggctcattcctcaccatatcggtggcgcggaaaaataatactgttgcgataacgcccgagctgagtgcgacgataaaggattggaatgtctgtcccattgagggaagcccgtctctataccagccgaaagcggcgatcaaaagccaaaacggaaggcttgcgagcgtcatgccgagcacccgctgaaacgtatcgagttttccgccgtattgttccagcattttgcggttgccgagcggataggcaaacgccgcgacgacgaccggcgccacgctgaatagtatcgtgcggccggacagagaacccgcatgctgaagctgaatcagcccggctccgatcaggatgatgacggaagtaaccagcgaaatcagcgggatcttttgtctgacggaaaccgggcccgccggtgaattttttgtttcgcagaaaaacggcgacagaagcacacccgcgacaattgtaatctgccacgtgccggcgatcagccagccaggcccatatgccgccgcaaacgtaatcggggcataaaaaagcacgaacccggtaaaactccacttcagccaaaaaaacggttttttccggatttcatgccagagcggcgcccattttcctttcgcataaacgatcaaaaataaaaacggaatcataaaaagaaaacgcagggaagagctccacatccagcttccgccggaaagctccatcgccctgtttaaaataaatgtgactgcaaaaaacagagatgccaatattccgatcacgatggctttcattaaatccctcattttgacacatatttttttatactatactattcaccggcaggcttcgcaatggaatatgagaaaatagcgttttaataaatgatgaatgggaaacagacatatacggaggtgaacacaatgcagaaagaggatattcaagtgctttatttcgaaggtgacggccgcattccgaataacccgaatcttccgcttgttatttataaagcggtatttaatgaagaaacggtacagaaagcagagtccgtcctccgccggcacgattggtctaacagctggacgggcggagtatttccgtatcatcattttcacagcaccacgcacgaagttcttgtcgcggtaaaaggaaccgcggttttgaggttcggcggggaacaaggggcggacgccgttcttcaaacgggagacgcagcggtcattccggcaggcaccggacataaaaaactgtcgggcagttctgattttaccgtgatcggggcttatccgggcggccggcagtacgatacaaaaacggagaaaaatgatagaacttcagaagaaatcagccgtgtcccgctcccggaatgtgacccctttacgggaaaatcgggcccgcttttagaattgtgggaaaaatgacaggggaaaagcggacggtctgtaaaaaaatagcctaaaagaaacgttattacacccccgccatataaataatttcataaacgaaacaattcacgttcaaattttgttcaaaaagtgttattatataagagtaaatcaaattggggttttttatgtttgctattttcagagaggaaaaagaaattttgacttattcaattgtttttgttgatataaaaataatactggatatggcaaagtgaaaaactgggtagtaaacatttatttttgtaaatgattgtgcatgaattcacaatcttgctttttcatgcttttctgcatgaagggggaaaggctaccctttccaaaaaaaatcagcatactgcttatagtaaaggagaatcggatatgccagaaacaatcgatcaaacaaatgcatctgtcagccaaggccaacgcgatcttattgatcagctgctaaaacctgaagttcaagaatcactgactgttttagtggatcagcttccaaaactgactgagttagtaaatattttaacgaagtcttatgattttgcacagtctgtagcgacagacgaagtattgaagagcgatacagtgggtgcgcttacagaaattcttgagccggtgaaagaaacagcgaaagaagttgcggctactgccatcgaagcaaaagaccgcgcggatgcaagcaatgaaacgatcggacttttcggcctgctgcgcatgctgaaagatcctcaagctcaaaagctgttccgttttgctaacagctatcttgaaatcatgaacgaaaaacaaaaataatctcagattcaaattgatataaaggacggaggatatacgatgtcaaaacatattgtcattttaggcgctggttacggcggagttctttctgctttaaccgttcgcaaacattacagtaaagatgaagcacgcgtaaccgttgtgaacaaatacccgactcaccaaatcattacggaactgcaccgccttgcagccggcaacgtgtctgaacaggctgttgctatgccgctggaaaaacttctgaaaggaaaagacgttgacattaaaatcgcagaagtcaattctttctcagttgataagaaagaagttgccctttctgacggttctaagctgacttatgacgcgcttgttgtcggacttggttctgttacggcttatttcggcattcctggactcgaagaaaacagcatggtgctgaaatctgctgctgatgccaacaaagtatacaaacacgtggaagaccgtgtgcgtgaatactctaaaacgaaaaacgaagctgatgcaacgatccttatcggcggcggcggcttaacaggcgtcgagcttgtcggtgagcttgctgacatcatgccgaaccttacgaaaaaatacggcgtagacccgaaagaaatcaaactgaaattagtagaagcaggtccgaaaattcttcctgttcttcctgatgaccttatcgaacgcgcgacaaaaagtcttgaaaaacgcggcgttgagttcttaacaggtcttcctgttacaaatgttgaaggaaacgttattgatctgaaagacggttcaaaagtcgttgccaacacatttgtatggacaggcggcgtacaaggcaacccgttagtcggcgaatccggccttgaagtgaaccgcggccgtgcgacggttaacgatttcttacaatctacttctcacgaagatgtattcgttgtcggagacagcgctgtatactttgcgccggacggccgtccgtacccgccgacagcgcaaatcgcttggcagatgggtgaacttgtcggttacaacctgttcgcttacttagaaggaaaaacgcttgaaacattcaagcctgtaaactctggtacgcttgcaagcctcggacgtaaagacgcggttgccatcatcggagcgaactctactccgctgaaaggccttccggcatctttaatgaaagaagcaagtaacgtacgttatttaacacatatcaaaggattattcagcctcgcttactaatccttaagatcatacagaagacattgccggacttttctcggcaatgtcttttttttgcataaaaatgttaatagatacaattttctgaaaaataaaataaaaatgattgatatgtgagaaagaggaagctaaaataaaaaagaaccattttgttaacgttaacattttttaagagggaggatgagagtgtgaaagcttttatgggtgatgactttttactggatagtaaaacggccgtaatgctgtaccgggaatacgctgaaaacatgccgatcattgattatcactgtcacttaagcccaaaggaaatctatgaaaataaaaccttcacaaccattacggaggcatggctttacggtgatcactacaagtggcggatcatgagggccaacggcattgaagagcgctgcattaccggaaacgcttcagatgaagagaagtttttcgcctgggcaaaaacggtgccgatggcgataggcaatccgctgtacagctggacgcatttagagctgcagcgctggttcggcatttatgacgtattgaatgaaaaaacggccgcggcaatttggaaaaatacgaatgagctcctgcagggagacgggtttggcgcaagggatctcattctgaaatcaaatgtcaaagtcatttgcacaaccgatgatcctgccgatgcgctgacataccatgaaatgttgaaagaaagtgattttccggttcaagtgctgcccggatttcggcctgacaaaggtctggacatcagcagcccgggttttgccgattgggtccggtcgctggagagcgcttccggaatggctgtcaccacctaccaatcgtatttggatgcgttggaatcccgcgtccgcttttttcacaatgccgggggaagagtgtcggatcacgcattagatcaaatggtttatgccgagacgaccgaagaggaagcggcccggatttttgccgccggattaagcggagagcatgtgtcttttgaagatgaaaagaaattcaaaacacggacgctgcaatatctttgcggtctttacgccgaactggactgggcgatgcagttccatattaacgcgttaagaaataccaatacaaataagttcagcagcctcggtcctgatacgggatatgactcgattaatgatgaatgtatcgcaaaaccgcttgcccggctgttagattccgccgaaaaaaagtggcaattgcctaaaacgattttgtattctctgaatccgaatgacaactatattatcgccagcatgatcaacagctttcaggatgggaaaacaccggggaaaattcaattcggcacagcctggtggttcaatgacacgaaagatggaatgcttcaacaaatgaaagcgttatcaaacacaggcctgttcagccggtttatcgggatgctgacggattcaagaagtttcctgtcctatccccgccatgaatacttcaggcggcttgtctgcacgctgatcggcggctgggcggaacaaggcgaagcgccctgcgatatggagcttttagggaggattgtcgagggaatttgttaccggaatgctgaggaatatttccgcttttaaaaaatggaatgaaagaggtggcctatgagtaatgtgcctgtcgtgacagcacctgccgcaaaagtgaaggagcataagctgagtctgaaagaaaaagtatcctatggtttcggagattttgggaacggatttatgtttgatctcgggcagatctatttgctgaagtttttcacagatgtcgcaggcattccggcagcgttcgccggcagtatttttttggtcagcaagctgtttgcggctttgactgatccgattgtcggctcggccattgactacagaaaaaagatcggaccccgggggaaattcaggccgtacttattattcggaagtattattcttgcggtcatgaccgtattgatttttgtgtcaccggacgtgagtgtcacctggaagcttgtgtacgcctatgcttcttacatgctgtggggggtcgcttattctttcgtcaatattccgtacggctccctcggtgcagccattacacaggatgcggaggacagaacggcgctttccgcattccgccagatcggctctctcggcgcgctgctcattacaagtgtcatcgtcatcccgattctcgttcattttgataacgttcacatcggctacccggcagtcatgggaatgatggccgtaatcggaatcgcgggatttatgatctgctaccgaaactgcaaagaaagaattatcgtccgtgaagcgccgaaagaaaagctgtccgtcatgtcggttttcaaatgctttatcggcaacaaaccgcttctgactgtcgttttcatgacgattttctcaatatcggcatacaacattaaatccgctatgcttgtttacttcgcccaatacaatctcaacaatgcggagctgatgtcctacatgagttttatcatcatcggctcttcatttttaggtgtgttgtttatgccgaaactcgtcaaacgcttcggaaaaaagcaaacggtgatgatcggttttgccgtcagcgccgcggctgatgcgctgaatttctgtctcccgtcaaatgtatatatctttacggcgttagcgagcattgcttttatcgggatcagtataccaaacggcattacgtgggcgcttgtgtcggacattattgattacggagagtggaagacgggtgaacggaaggaggcgacgacatattcgcttttcaacttctccagaaaactcgcccaatctttatcaggttttctttcaggcatcgggctgagcgttatcggctatatcccgaatgcgtctcagacaaaaggcacgttaatcgggattaaagggcttctgctgctgtacccggctttcgctttagcgtgcgccatgctgattatcggtttaatgtataaactgacggaccggcagcatgacgagctcgttcaggacttacatcatgcaaaacctcaactttagtgattttatggactgtccgttaatggtacaatagaaataaatgacagcatacagaaagaaaggaaaaacgatggtaaccataaaagatatcgcaaaactcgccaacgtatcccacacaaccgtatcccgggcacttaacggcagcccctacattaaagagcatacaaaacagaaaatattagagctcgcttcacagctgaattacacaccgaatgtaaatgcaaaaagccttgccatgcaaaagtcccatacgatcggactgttttttacaagcatcacaaacggaacctcacacagctttttttccgataccatcaaaggtgtaaaccgcacaatcagtgaggaatacaatttgttcgtccgcgcgattgacgatctgaaaagctttgaaaccattacgcccatgagatatgacggaatcattttaatgagccaaagcgacagtgataattcatttatttatcatatccgcgagaaaaacatcccgctcgtcgtgctgaaccgggacattgatgaccggagcatcacgaatatcctgtcaaacgataaagaaggctccagacaggcggtcgactgcctgatcgcaaacggacacagagatatcgcgatcattgagggaaaggaaggattcaggtcagcttctcagcggaaagaaggctatttgacatctttaattgatcattctatcccgattaagcatgaatacagtgtaaaaggccgctatgatatggaaagcggcagtcaggcgatggaaaaacttttggcgcttcaatcaccgcctacggctgttttttgttcaaacgatgatatggcgatcggggcgatgaataccattttcgccaaaggcctgaacgttccggaagatatttccgttatcgggtttgatgacatcggcatttcccaatacatgacgccgaggctttcgacagtaaaacgcccggttgaaaaaatcagcatactcggcgcagagaaaattttggcgcttatcaccgacccggatacggcggcggaaaaaatatacgaaaacaccgaggtgatgataagagattcaattaaaaaactcacataacggcccgtctgattatccgggtttttgtacgggagaatgttaacgtgtgcataaatataaggaggcggacagcttgcggcagctgaataaaaagatgtgcggaaaatacattcaatatcctgaaaaagtccttcagttcggcgaaggcaactttttgcgggccttcgctgactggcagatcgatcaattgaatcaattgacggattttaacggaagcgttgtcgccgtacagccgagaggctctgagaaaataaaacgtttaaacgaacaggacggtttgtttacgctttttttgcgggggataaaggacggaaaaccggctgaagaacacacgatcgtcaaatccatcagccgcggcattgatcttttttctgactatgattcctttaaacggctggcagcacaagaggatcttcgttttatcatctccaatacgacagaagcgggaatcacgtttgagaaaggcgaccggcttgaggataggcctcaaaaaacattccccgggaaattagcggcgttcctttatttccgctataaggcatttgcgggtgacgccgagaaagggtgcattgtgcttccatgtgaactggtcgaagaaaacggacggaaactgaaggctgccgtgcttcaatatgccgggctgtgggagctggagcctgattttactcaatggattcatgatgcgaacatcttctgcaataccctcgtggatcggattgttccgggatttcctgttgataccgcggaagaacttaccgattttctcggatacgaagaccgtctgcttgtggtcggtgagcattattatttgtgggtgatagaagggccggaacagcttcagaatgagcttccttttgctgatgccgggctgaacgcactgatcacgtctgaccttacgccttacaggacaaaaaaggtgagaatcttaaacggcgctcatacggcattggcgccagtggctttattatacggactgctaaccgtccgggaagcggctgagcacgaggtgacgggcagattcatcgaagagctgatcaatgaagaaatccttcccgtgctgcaaatggagggtgtcacccagtatgcggcagatgtgttacaccggtttaaaaacccttatatccaacattatctgcaaagcatcacccttaacgccgccgcgaaattcaaaacaagaaacctgccgacgctgaaggcttatatcgaacaggagggccggcttcctgagaggctggtattttcattcagcgccatgatctattcatactggaacgggctgaacaaaccggcagatggcgaggaggttctgaaccgttttcaaatggcgcggtcccgttgcaaagatgatatgtttcaagcggcattttctatattaggagaagagcgattgtggggaaagaatctgaaccatcttccggggctgactgaacgaacggctttttttctctctgtcattcataagcgggggatgaagcatgcgttacatgaatgctgcggcaataaggggggaagtgaaatgaaagaggtcataaaaatccataaaaacgataacgtgcttctcgctatgcgccattttaacaaaggggagcggctgtatacagacggactggcgattgaagtgaaggaccctgtaaagcgggggcataaaatcgcgctgcaaaccattgaagaaaacggcagcatcattaaatacggtttttcaatcgggcgtgcgacaaggcggatttcggccggcgagcatattcatacccataatctgcaaacgaatttatccgatgtgcaagaatacacgtattcaccgcgcttcgaggacaatccttttacaaatgagaaccggacatttaaaggctacaaaagagaaaacggtacatccggcgtccggaatgaactgtggatcgtgcctacagtcggctgcgtaaacggcgtcgctgagaaaatcctgcagcgcttcgtaaaagaggcgaaagacattgccccctttgacaatgtgctggttttaaagcaccaatacggctgctcccagcttggcgatgatcatgagaatacgaaacaaatgctgattaacgccattcgccatccaaatgcgggcggtgtgctggttttagggctaggctgtgaaaataatgagctggcggcaattaaggaaacgctttctgaagtgaacggagatcgggtgaaatttctcgaatcacaggctgtcacagatgaaattgaagcggggacagcgcttcttaaagagatacaccttgcggcaaagggagataaacgtgaggagattcccctgtcagaattgagcatcggattgaaatgcggcgggtcggacggtttttccggcatcaccgcaaaccctttattaggaagattttcagattacttgattgcacagggagggagtacggtcttaacggaggtgcctgagatgttcggcgctgagacgattctcatgcagcgtgcggtgagtgaagaagtgtttcataaaacagtccgattgatcaatgatttcaagcaatattttatgaagcacgagcagccgatttatgaaaacccgtcaccagggaataaggaaggcggcatttcaacgctcgaagacaagtcgctcggctgcacccaaaaagccggtcttgcaccggtttctgatgtgctgacatacggtgaaacactgaaaacaaagggattgacactgctcagtgcgcccggcaatgatttaatcgcttcttcagcgctcgctgcggcgggctgtcacatcgtgttgtttacaaccggaagaggcacgccgttcggcacatttgtcccgactgtgaaagtatcaacaaataccgatttatttcaatcaaaacctcattggattgattacaatgcgggcagattggcggaagaccaaacaacagaagatcacattgtgagagattttattcaatacattattaaagttgcaagcggagaatacgtcaataacgaaaaaaacgattttcgggagcttgcaatctttaagtccggtgtgacgttataagggaaaaggcgatctgacaacagaccgccttttcgcattcacttatcgttttgccccttgatgaattgtgaatatctatgagctataataatggaatggtgccttacataaaggagatttttataatatatataattattatggaagattggtttttagtcacatatttcagagggggtcctaatgaataacattttatacattgaagatgaccaagaaattggccaatttgtaaaggatgatttagaagatcggggctatatgattatatggctcacttcttcctataattacgaaacatatatagaaaaggctgatctgatcgtgcttgatataatgatgcccggtttagatggatttacaatcggtcaaaggatgaaaaaaacacatccgcagatcccgctcttgcttttaacagcgagaacgggtctggaagataaactgaaaggcttaggatttgcggatgattacgtgacaaaaccctttcatcccgatgaactggccgctcgaatcgaagtattattaagaagatttgacaagactgccattcatgaattgaagctaaaacacttaagtgtccacttgaaagaaaaaagaattttaaatcatcaaagtcatgaggaaatatttttaactgataagcagttaaggatttttttgcttttgcttagacatcccaatcaaatattaacaaaggaacaaatttatgaaaatatttgggagcagccttatatcgaaggggataagacgttgatggtacatatcaggcatttacggcaaaaaatcgagatcaatccaaatgagccggaaattcttgaaacgatcagagggattggatacaggattaaacaatgaaattatcaacaaaataccttattaatatcgttgcctcaattttgttttttccgatagcctttttaggtgtgaattttctttactatgtcacattaacatacttgattgatcaccaggggcaagtacactatgaaccaaacaagttggaaagtgattggaagtctgatgtggaaggtttttcagggaaatccaatcgggaaattacgtctgctttcccgcacatgaagcaatataaacactctgatattgtatggataaatgataagggaaaggtgatgttttcgaactcagaacggttggccaaaaagggtgaggttattcacgttagcgaattgattaaattgatggaacaaaaccaaaagaaatatttattgctgagtgcttatgtaaatgggagtgaagacagcggatatgcatttttagaaactccgcgctcaattataggatctcaatgggaggttatgagggccaagtattcctatatatggtttatcgccttgatttttgtctgttcactttttgtgattaattcatggatgttttttgcgaaaatacaaaaaaggttaatttctttggggaatcatatgaaaaaacaagataatgacggcataccggaatttgtaacagttaaacagaaggatgaactgggtcaagtggaatattcattcaaccagatggttgaggaactaaggaacagcagacaaaaagagcgtgaagaaggcgaaatccgaaaaaacttgattgctgatttatctcatgatttaaggacccctcttacggttataagagggcatacatttacgttgaagaatgaaataagcagtgaaaatggaaagcattctttaggcatcataaacgataaaataacgtttatgggcgaactgattgacaatttgtcatcattttctcttcttgccgcaggtaaattgccgcttcataaaaagagttgtgacatattaaagataatacgttcttcgttaacagcttggtatccaatttttgagaaagagcacttcacaatagatattgatctgaaggaaaacatcgtatgggaaatagacgagacttggctgaagagaattcttgataacatttttcaaaatgttttgcgccatgctcattcaggaaaatacgtttccgtacagacaaagctaattgaaaacaaacccgtaatcataattgaggataggggcccgggaatgaattataaatctgaaagaaaaggcgccgggatcggcttatcgatcattaatatgatgcttaaacaaatggggcttgaacataaaataaagagcaatcaaaacggaacggtttttattatttatccaaacagcaatgaatacgtgaagccgtagaggcttcacgtattttttatattgagaaatttaaacgtaaattaaccttgactatatcttctttttaacctcgtaagtttatattataaacagaacaagacggagaggaatgatgaaaagtgggaaaggctgatccagctttaatatccaagggtatcaatgtttctataaaaaagaaagaaattttacatgatataaatttaacattggaaaaaggtaaaatatatggtttattaggtcccaacggtgcaggaaaaacgacattgcttaaagttctgttagggatatttcctccaacttcaggtgaagtgatttttgagggggatgacttatatggaaatccaaataatgatgtgattcagtctataggaagcattatagaatttcctggcttttatgaaaatttgaatctttttgagaatattaaattacatcttaactatttaaaaaaatcagcttctgatgaagaaataaatgagattttaggaaaggttggactttttgaacataaagataagctgttttcgcaaacttcattaggaatgaaacagaggctgggaattgccagagcagttgcgcatgctcctgcattgcttttgctggatgagccgacgaacggtttagatccatatggtattaaagaagtacgtgaaatgttgatccaagaggtaatgaaaaatggaaccacagtcgttatttcaagtcaccttttaagtgagattaatctcatggccgatgaattgcttattatgaataaggggcagattattttcgagtcagcctttatgaaaaatacgcaacatctttatttgtacaaaattccagctgaagcgggtattaattgggcggatattgagaaatttgcggatcatgttatttcaaagaataaacagcaattcgagtttatttcaataattcatccgtcggaaatgaaagagaaattaaattcttggggatttaacaaggcgtctattgacggatttaagctatctttggaagatctttatttaaaactgctggcaaaggagaaaggtcatgagtctgttagtgcgtaacgagtttctgaaacttaaaagactgaaatcaatttatgttattttctttctaagctttttgccatttctcataaacggaatcggtcttttgactatgaacgaaaatacagattggaacaaattttatatgtttgtttttaatcagtattcgatcctatttccgactattatttttattttttcaggtttttatttttatttagaatttaaaaacaggacaatgttgaattggatgtcatatccgtatcataaattcaaattgatattatcaaagctagctgcagcttttctatttttgtttttaatctcagctgttaatcatattattcacttatccaccttgtttttcttttttcgggaagatatctcagcaagcgacttattaagattaatagcgacatcttttacttctactactttgagcctgctaaccattccgattgcagctttaattgctttcttaagtaaaaatctagtggttgtcatgataaccggtgtagcttcctttttaataatgacgatactgttagcaagtgatgtctcaatagtctttcctttttcttttatttatcgtttcagtattcaaatttctgaaagtgatatgggatataccaattcaattcttttagtttggggattactgattatggggctgtatgttttggtatccttatcaggattatacgtatattcgaaaaaaaacagaatgtaaatggaggatgagtatacatggagcaagttatttttgtgatttcaatgctcgctttaggagttacactggttacctttttcggaatgattttgaatgacggattaagaggcgtactaaacttttcaagaaaacctgtaaaatttatgactggatcatttctggtatacattgttgcctttgctgtttatattttaataagtgtaaagtaactttttcattttaaggggattcaaagggattcccttattttccttagtaaggggcttggatacaaatgaaagataattgggtgaagcttaatattgagcagtttgcaagggcttttgttttctccttattattgttttttatgcttttgcttataacagacagccaattacagtttaaacagtatagtctattttttgttctaagtatattcggcagtagttgtttatgctttacctatgatgacagaaataagacatatcttcgcagcctgttccgtttttcagaattatgtcaaaagggatccgatgcagatcaattgataaaagaactaaccaatgaaatacagagtgtgctctcaggaaagcagattgctcttataaactatgacaaaaaaacattaaaattgagagaaaaaaacattcaagttcctaacataaacatttcaaattttaagataggagaaatacgtgaaaccgccagcggatcaattctgtttatcggggagaagtgtgatacatttgtttttattcatttatcacatgaaggacaccctataaagattcgtgaaaacgaggcagattggctgcgaatgctggcattctgcacagcatctgcacttcagaacaaattattgattcaaaaaaaaattgatgaaattatcatagacgatcaacataaatgtaagtcggctgtactttctaaggttttattttcaatttcagaaatagagagaaccaagcttgcacaggatattcatgactctatcattcaagagctgatatttgtatgcagagaattagagtatcatgttgagaaatacaaggatatttattacataagagaaattttgctggacaatatccagtatataagagaaaaatgttttgatttaagaccaccttttttaatggagatgggacttcttcgaagcattcaagtcctgattgataaacataaaagcaactatcagcttgatattgaattctttgtagatgtaaaagatgattctatttttacagaagatatcacaataaacatttaccggattgttcaagaactgcttactaatgctgtaaaacattcaaaagccagttatattgttttgacgatgattcaaaaaaaaacaagtcttatgtttgtttacgaagataatggaatcggcattgattggaataaagtaaattcaaaaacaaacagttttgggctgacagggataaaagagcggataaattgtatgaatggtattcataatatatcttcaagcgtaaatgaaggattgctgttaaggtttgaaataagtacgaaaaatgaatagggagcgctgacatgataaagattctattaattgatgatcatattggtgttgctcaagggacaaaagccattcttgaaaaaagcaataaaatgggagtaacaatattgtcttgctgtaaagaagtacttaatcaccttaagcattatgagtatgacttaattttacttgatttatatatgccggagttaaatggaatggaattgtcaaaaatgattcttagagagagccccgatcaaaaaattataatttatactggttttgatatctctgtgcatttcaatcttttggttgaagttggtgtttccgggttcataagtaagtcatcaacagaagaacatatgataaaagtaattgaaagtgtcattgagggagataccattattcctactcatctctttaaacaattaagaagaacagaagcaaatacgttcaacattgataagcttgaagatagaataagagatattactttaaatgaaagagaacaagatatcttagcgggcgtagcggagggaatgacaaaccgggaattatcagcaaagctgttgatcagtcaaagagcggttgaatacattcttactggtgtgtacaacaagctcggagtaaaatccagaacagaggcactgatcaaagcaaatcgatattcattaatttctatgaaaactatatatgagtaaatgaatcgggattaacggaacagttaatcccgattttctttataacctatacttcggaaacgcgcaaaaaaaaagcgcttttccgaatatgacttttcggtgcctataggtaaaagatcgtttatcataggtttatagaaatatatggatcaaaatccaatatatttcaaaaatcaaggggaggaatattaatgaatgagaaaatgtatcgttttgccggtgatttaagagaagaacttgaggaaatttctttaagtgaattcagcggaggaggaggcgcagaacagcgagggatttctcaaggaaatgatggtaagctttgtacgttaacttgggaatgcggtctttgtcctactcacacttgctggtgttaaaacaacccgaaataagaaaatagatttccaatgctctgggagatccagctgtctccctctttttttaaaggagatgaatattaaatgaattcgctaactaatattctattaagtaaagaaaaaaaagctgctgtctctcaatttgatgaaaatgagaaactgtttgatcgaaacttagaactaatctataagaatgatattcaaatggcccaggaaagcatttataatgtgttatccattcaatcaattgataaagtgaaaagcttatatcaaaccccactacataaatccgcttttacagttcatgttttcgaaaacctaaaaaaagggatcgctcaccaagctattaaaaaagaagacgtaaatgaagaaatcatgtttcacgtttttgcgttaaaagtgtcctcttacttcaatgatctacttaaaaaatcaaagtttccttcttatgactatctgctggaacaaccggctctttttcatcatagtatttcaaatcaattagaaaaaatcattttaaaagtatcctatagaacacttgtattggatatgaatatgaatcgggaaaaaggttttttggcaggggagactcctaaagaaaaatatggtgattataataaaactcttttgtgcagtcaggagtatcttgaaaactttttccaacgatatccagtcttattaagagcgattggaaatgaactgagaaaattcaaaaaattcatactggaatttatctcccgttttgaaaaggacaagcctgaactgctctctttatttggtttttcagaacaagtcaaaataagggacattgaagtagggatgggtgattctcattctgatgggagaaaggttactaaaataacattaaatgaaggtaaacttatttataagccgagaagtttagaaattgatctattatataaaaagataattgaatttttgaatgagaaaattagagatcatgatataaaattgagcactccgaatgtccttagcagagacggatatggatggactgaatttatatcttttaaagcatgcaattgtttaaaagatgttcaaaacttttatcagcgtacaggagctcaaatcggtttgttatatgcattgaaagctgttgattttcattcggaaaatctcattgccaacggcagctatccagttctcattgatttggaatccttatttcatcctgcataccagaaaaaaaaggatgggatggacgcttatgaaaaagctgaaacgcagcttcatgaatctgtcagagcattagggctgcttccttttttctttgcgggcaaagccgacatcagcggaataggtcggaaagggaaagcaaagtcgatcattaaagttcctcagcttatcaatttaaagacagcagaaatgtctgtcaaacgagactatgtcgaaattgatacagctaataatcaccctatgcttgagaataaatttgtatatgcaaaagattatgtcgaagaactgaagcaaggtttttcaaaagcatatatgactatattaaaacatgcttcggagctgattcgcataatagaaaagagcgaaaacaagatatatgttcggtttatatcaaaaccgacaataaagtattctgctttattagaattaagttttcatcctagatttttacacaactctattgatagagaaattttcttatcaaaaatatgggagagaccaaagcaagaagatgaatatcaatctattgttaaatatgagttcaacgatttaattaataatgatataccttatttcaaagtgaaattgaatgagaaagacttactaagctcaaaaaataagaaaattgaaaattactttccggaaacaccagctcaaagtgtaaaagaaagaatttcaaatttatcaaaagacgatttaaagtttcagctctatgttatcgaactgtcaatgcttgcttcggaggatgatcggcaaattgttttgaaagaatttataacaaaagaaccaggacaatatgtaaatgttttcagtagtaaccaagaaagtatcttaatagaaaaagcagaggaattggccgcttatatttataatcaatcttacaaagcacacacagataaaggaagttcgtattcttggcttaacgctactcctattggagttgatgaaattcaatggaacttatccgttatgggtgataccttttacgacgggctttccgggatggctttcacctacctggctttatggcgcgtcacgaaaaaagaaaagtatctggacattgccgaaaaaattatgaaagatgtcatctctcgttttattgatattgaggtgaaaccggacgaagacagcagtatgtctgtaggtgctttttccggagtgtcttcaatagtatatactttaatgaatttctatatgtatactaaacgcgaaaaatataaacagaatgcaaaacaaatcgctcagcttattccgtccttgcttccttatgataaagaattggatataatcgggggcacagcaggggctcttattgtaatgatacgttcgtttgaaatagagaatgatacattctttttatcattggctgaacaatgcggttcatttttaatgaaacaagcgatctttcttgatgaggattttgtcacttgggaaggtattgcaaataagccgttaacgggtttttcccatggaaacgctggaatgatatatgcccttcaattactcgagaaacattcaaaacatcaagatataagtatgtacatccgaaaaggacttgcttttgaaaattcaaaaaaagtaaacggtaactggcttgatctgagaaaaacggtaaatgaagctgcaacatctgcatggtgccatggatcccctggaattctattaagcagattagaattgaaagattcaaaacaccctgatattgccgaagtggccaaaaaagatctgaataaaaccgtttctaacattttttatgacggttttggccgagagcaaagtctttgtcacggagacatgggaaatgctttaatactgatcgaatatggaaaaaagactggtgaaagtcaatttgtaaatataggaaaaaacttgattttggagagtgtacaagacaaaaatataggtttctaccaatgcggagttggaagggatgttgaaacacctaatttaatgcttggtttagcggggatcgtatatggaatgctgtatgcagcagacgcagaattgccgaatattctcaatcttgaaataggacgtgtagatacattaggagacatttatgaaaattagaaaaagaaagcttccggttattcttcaaagaaatcaatttgattgcggtattacttgtttagccatggttttgagcagggctgagggaataaaaatcaatcctaacaaattgaaattaaataaagaaattatcggaagagacggcactgatttaatagaaatgaaaaggatttctgaaacattcgattatgatttcaaagcattccgcacagacaatataacgcagcttaaagagttaaataaaaaccatccgctaattgttcattggaatcataatcattttgtagttgtcgacgcatttggcacagataacgttaaaattatagacccttcgtctggcagactgacaatcacattagaagagttcaaaaccttctataatggcatttctattatgttaatcagaaagaacgaacttgagagaaaggataagactgcttcgtcgttaaaagatgtgtcttcatttagaaagatcggaaaatatcttttgaaagataaaaaattgttgggggttattataagtttcacttttatttttcaagcattaaacttaatgaccccttttttgactcaatatattattgattcatttattgacggaaatgagaaaattcttcccataccaatgcttttcatgattgtaattgtttcaatcgtattattctttagtctgtccttaatcagaatgaaatttattatcaaactgcaattaaaaattaataagagtatgactgataaaataattcataaaatatttagtcttccattaaagttttttgaggcgaatactgccggggatatttcaactagaatccataacattgctgtaattcgtgaagtcatttccaggttagcgtctactttgatattagatatcagtcttatatttgtatttttcatagtcatgtttgtttattctccgatattatcttttatagttttattgggagcagctatacaggtgatgagtactaaaattttgcttccgaaaattgaaatgttcacaaaacaggaagtaaatagtcaatccaattttcagagccagctaatcgaaatcttaagatcaatgacatttataaaaacaataggagaaaccaggaatattgagagccaattaaattataactttaatcatcagttagattatttctctaaaagaatgaattattcatctttactgggtgcggtctccaatgcaatcaatctatctttgccattacttattttaattgtgggtacttggtcagcagtatctataggccttacgctaggcgcagtaattgctttttctaacattgccggacggtttatgtctccgctgggatcaattatcggcagtttagagtctattaaattagttgaagaaatggtagacagggttgaggctgtactggatgaaaaagatgaggaagtaaatgataaaagcattgaactatttaacccggccgctcataatatcagcttgaaaaatattgatttcagctacaacggaaacgattatattttgaataatataaatttaatgatccggccgagagaaaaaatcacattaattggaaaaactggaagcggaaagtctactttgattaaaatcattgccggcctttatcaaaaaacagcaggagaaatttgctacggtgaattcaaaatcgaggacgttaatatggttaagctgagagaaacgttaggttatattgttcaagatgtcaatctgtttaatgacactattataaataatataaaatatttcaatgaaaaaataacaatggaagaagttgtacaagctgcaaaagaagcatgtattcatgaggatattataaaaatgcctatggggtatcataccatgattggagaaaatggtattaccttatcaggtggacagcggcagagaatctcaatagccagagtattagcgaaaaatccgcgaattctatttatagatgaaggaacaagcaatttggataaggatacagaattaaatatattaaataacatttacaaaaaggatatcactgtaatttctattactcatagaaccgaatggctcgaattctccgaatctgtctacgagattgaaaatggaaacttaaagacgattaagaccaaatatgaatcacagctccagcagacttattaacttgaaaggaggtgaaatatggaatatgaaagagaacttcagcgcgttgtatgaaacatcagagcaagaattaagagagcttattggagggcaaaactcagtatcaataacaacaattccaataacaaatcatgtttgtccaactatcacagtaggctgcgcatgtccgcaaaggcaagtataaaaaacaatcggggggatttttaatgaaaaaagaatttttagcattggaactaatgactgaggaagaattaaaagaattggcgggggctcggaggcaactccaatgactgtaacaccgacaaccatcacaataccaatctctttagcaggctgtccgacaactaaatgtgcgtctattgtcagtccatgtaacgactgaaatttataaaaaactcaaacaataggaggaattaacatgaaaaaagattttcaagcactgactccaatgactgaagaagaattaaaaaaccttgcagggggttcagatgcaaccccgatgaccgtaacgccgacaaccatcacaataccaatctctttagcaggctgtccgacgacaaagtgtgcgtccattgtcagtccatgtaacgattaaacatatccgaaaaagaatatgtatatgcgtacatattctttttcttttttgtcaaagacagtcaagaatatataaggaagtgataattgtgaacaaaacacagaattcggctaactatgtttatgaaaactctatgttgaatatttttaaagaagaggattatttcgaaggttttgcgcagtattatataagtatttttaaagctcagattgttaaagaaatagatagaataccatccgaaagtctgttggataagggatgtcttgttgaatcgatattaattaattataagaaaaaaatatactatttggcggggaaaacacttatccatgagtttcatcaaacttttgacgagtttgatgaaaaaaatgaatctaaaaattatgatatattctcagaaaggctgaaaaactccgcatttgttgaagaaatactcaataattatcctgtattgcaagatttaatctccagatccacctctgattttatacgcttcactatatctattattaaacattgggttaatgactataaaaaaatccaacaaaaattcaacttttcgttcggaaaaatgagaaaggttaatatgaatgcaggggatgttcataatggcggtaaaagtgttgttattattgaatttgagaataacaaactcgtttataaaccccgttcacttgaaattgatgttttttatgaaaaggtcattgattatgtcaatcagtattatcaaactaatttaaaaacacctttatccttggatcaaggtgagtacgggtggcaagagtatgtacagtctgaaccgtgcgataatattgaacaggtaagaaattattattaccaatttggaatgcatttaggatttatttatgcttttcaagggtcagattttcattttgaaaatatcatagcatgtcgtgataaaccagtgttggttgatcttgagactctgtttcaaagcagcctctttttttctgaggagaacaaggaaaatgttaatttaatggcatcagcacaggtaaataaaacaatattaaaatctgcactttttaactatatgagttttccggaagataatgggctgactaatataggaggcttgataaacacagaaaatcaaaaaggtgaaaaagaagaagtgcttcatataaaaacagataaaatttctataagaaagaaacaatatctcttcaaaaggggaaggaatcttcctgtttacaaaaataaagtagcagaatgttttgaatttgaaagagaatttattgaaggcttcaaaagaatattcttgattttgaaagaagatttatatatacggaaccttataagcgaattaaattatgcccctattagaattattgtcagacctacatatgtttacgcttcatttcttgaaaccctcctccatcctatgtatttaaaagattatggagaaaggataagggttttatcttttattaaggatgcttatacaaaatatgaagtatttgattccatcagtccatttgagatcaaggatatgatgatcggtgatataccctattttaatgctcctattagtgaaaaaagggtttattcaaattcaatacatgtggtggatacagggattatgaaacaaagcgctaaacaagaagttttaactcgtttagcgaatatgtcggaagaagacatgcatcagcaagtgagcttgataaatatggccttaagctccacggcggctaatttggatattatttataaaaatcaaattgatgattttgtacctggatatttaaaaaatgacatacaaatcaaagagctgattcaaatagaaacagattgtatattaaaacaagcaatcgaatcggagaaatatcttcaatgggtatcaatagtctcggctcccaatggcaccttatccgtaggaccgttgagttttgggctgtacgatgggttagctggagtggggctttatttttcagcttatgattttatttataatgatgaaaaagtcaaatcgattcttcgtaaaatagtgaattcaattaatcaaatatatgagcatagtatttataaaacaaatttctctgctttttacgggtcaagttcttatatctattttgtcaataaaatgagaggtaccggactttattcggaaaatgaagtgaatagtatgtgtaaagcatacttagagaaacttcgtcaggaaaccgctcaaataacacataccgattttataggcggactcgcaggtatattaaaggttgtgattcagcttggcaggtattatcggactgaattaatggaagatacggcaagggcagtttgtaaagaaatatgcaaaagaatgattcaaaatagaaatgaagcatattggaaatccgacgcggatgagaatgttgttttagcagggttttctcacggtattactgggatttgttatgcactatctgaatattatgcgcatattgaggcatctggagaagtacttagactgattgaatcagctctcaaatacgaagataaattttttgatactaaaataaaaaaatggagggataacagaaaaaatgagtcggattattcttccgcaatgtggtgtcacgggtcttgcggtattcttcttggaagaagcaggatatacgagaatgtagacgggcgcattcacgttgggtatattaatgagtctttagatgacacattgctgaatggaaattcccatcgtcagggctactcattatgccatggaacgatggggaatatagatgtacttcacgctattaaggaattatctctctttaaaaatcgcaagcaagagattgagaatacaattaatatatgggttaaccattttaaagagaccctgttgaaaaatggctggcaaaatggaataagaaatgatcattcgggacttggtatgatgttagggaaaaccggacaattatatgcacttttaaggttagttaataaagaaattcccaccccattggctttggattgagggggatttcccaaataaaaaagcgatcctgtaaaggacgctttttttagattaattttatcccgctgattaaaataatcgccgccatcacaaactgcagcgggcgcggtgagaatttcggcgaaaagaagctgccgagaagcacacccggcacagagccgatcaacagattcaatacaagcaggtaatcgacgcttccgaagcttgcgtttaacagaccggcaacagttacgagcaaaaaggcatgtgcgatatccgttcccaccacttctgctgttttcattctgaacaggtataacatggcgatcgcaaataatgagccggacccaatagatgtcaggccgacgatgaagccgaaaatgacgccgatcagtatcatgagtgtccgcttttcttcaagtgttttttgctgccagcggttcggccgcagttttttatcgaaaaaaaggcgggcgataatggaaatggcgacaagggtcagcacgtagccgagcgcctgtttgataatctgctcctgatgctggtgaaaagcgggaaacaagtgaagaataccgatggcggctgttgcgctgggaatgctcccgagcgccaagtagccgacaagtttaaattgaacggtgcgctgcttccaatgagaaacgacaccgaacagtttggtgatggaattatataaaaggtcagtgccgacggcgattgaggggttgatccccaaaacgatcagtaaaggagtcaaaagcgccgctccccccacacccgtcaatccgaccagcgttccgacaaagaaacccataaacacaatgcttacagtcatctgtgtgcctcctgaataatcctactatttttatcagattatatatgattaagaggcggtaatcaattaaattttcggaaaattttatacagaacaaaaaatccgcctgcctgctgttatttcgcagatcggcggatgatggccggattatgatttttgctgataaaacggaagttccgtgtggcccatttctctgacatacacgaaaagattgcctttatgatgaatttcatgctccatggcaagctgaaggagagccgcgccggttatttttctgccgaaagaggcagtcaggtcaatttcgcggttcagctgctcttcagtcagctgtgacaggatgtctgtcgttttttcagtacatgcttcagccagtttgacgaggtctgtttccgcttcttctttcggtttgttctggatagctgacccgtttccgtcgttaatgacgtttgcaaacataagaaaagaataaacgatgtgttttacaagttcctgagcggacattgatgtctccgccggcttgtagtcgtaatgctcgcggctgattttttccgccagctcaatcgtcacgtttcgatgtgacagaaagtggctgaccaattgattttgtgctgtcatgtgaaaacccccatttaatacagaataaaagctgcaaggatatgctatatcaacggcacggaagaaacaagcaataagcttgtgatggagataaatcgttgcggatatccgaaattcgacaattgcggtctttttgcgttcttctttttctagcaattatgataaaatatgacatatctcggtcattccaaaagggggatttattgaggatgaagcagactattccgtcctcttttgtcgggctcaaaattaatgaatggtatacccatatccggcagtttcacgtccttgaggcggagcgcgtcaaacgtgaagtagagagagagattgaggatatggaagaagatcaggatctgctgctgtattattcattaatggaattcagacaccgcgtcatgctggattacatcaagcccttaaaggaggacccttctcagcctgagttttcagaattattggaagacattgaaggcaaccagtataaactgacaggactgcttgattactactttaatttttttcgaggaatgtacgaatttaaacagaaaatgttcctaaacgccatgatgtattacaaacgggctgaaaaaaccttgcactcgtttctgatgacatcgagaaagctgagtttgcttttaaaatggccgagattttttacaacctgaaacaaacctacgtctccatgagttatgccgttcaagcccttgaaacgtaccaatcgtatgagacgtacaacgtccgcagaatccaatgtgaattcgttattgcagggaattatgatgacatgcagtatccagaaagagcattgccccacttagaacttgctttagatcttgcaaaacaagaaggcaatccccgtcttatcagttcagccttatataatctcggaaactgttacgaaaaaatgggagacctctctaaagcagccgaatattttgagacatccgtttccatttgcaggtcagaaaagttcgataatcttccgcattctatttactcattaacacaggttctttataaacagaacactacagccgaagcagagaagcaatatcgcctcgggctcagtatcgcccgcgaatacaatgatgaattgtttgtcaatctgttccaatttttgcatgcgttatacggcaaggaaatggataacgcatccgtcaggcacacgtttgattttctggaagaacacatgttgtatccgtatgtggaagaattggcgcatgacgctgccaaattttacatgaaacacggacagcctgaaaaagcgctcacgttttatgaaaaaatggtgcacgcccaaaaacaaatccagagaggagattgtctatatgaaatctaaactgttgtcaggattgctgcttgttgctgtcgggttcagctttacacaggtgatcggccatgaaagccatttggaaaaccaagcggacggcacattccatattgccgcacgcaaccaaacataacataaagacccttctttggaagggtcttattttttgcatgcgtgtccattccaattttatccgaatgcagggtcgatatgctcaagttatctgtcctacgaatgccacctattgatgaaaaaggcataaggagagatgaagagtggggattgaagtgaaaaaacggctcgtatcggctgataaatatgcgttaaaatgtccgaatccgatgacgccggagtatattaccattcataacacggcaaacgacgcatccgccgctaatgaaatcagctatatgacgggaaacagcgaatcaacgagctatcattttgcggttgatgacaaagaagtgatccagggaattccgttggaccggaatgcctggcattcgggagacggcacgaacggtaccggaaaccgcaagtcgattgctatagaaatctgttacagcaagtcaggcggcgaacggtacagagccgcagaagaactggcgattgcgtttgcggcgcagcttttgaaagaacggggctgggggattgacagaatcagaaagcatcaggactggaacggaaagtactgcccgcaccgcattttgtctgaaggccgctgggatgaagtgaaggcgaagattgaaaagaaattaagcggaagtatgccggcgaaaaaagcctctatttcttcttccgcgtctgaataccatgtgaaaaaaggcgacaccttatcggaaatcgccgcatcgcacggtgtcagcgtaaaatcgctgcaaagcatcaaccatatcaccgatccgaatcacattacagtcggacaagtgatcaagctcgctcagacgggttcttcttcaaaaagtcaggctgtgtcttcatatccgcttccatccggtgtgatcaaagtgacgaaaccgctgacgaaagggacaaacgtaaaacaagtgcaaaacgctttatccgcactttatttttatcccgataaaggagcaaaaaatcatggggcggacggcgtttacggcccgaaaacggcaaatgccgtaaaacgttttcaatccgtcagcggattaacggcagacggaatttacggcccgaaaacgaaggcgaaaattgaagaaaaactgtaatcaagaaaacggaagctccccgggcttccgtttcttcttacatacaaactgcggcaagggccttttgaatatcataaatgctttcatcttttttaaactgctttgagacagcgggaagttccgcgcctgaaatccaaattttcagctctgaatcaaggtcaaagcggccggcggtttctacgctgaatctggaaatgctcttgtacggaatggattgaatctccgttttcttccccgtgagtccctgtttatcaacaagaataagacgcttatccgtaaagacaatgatatctcggacaagcttaaatgcggcattgacattctcgccttccagcaaaatacgggccagttctgattttgcttcagccgtcgatattgtcgacgcattgcccagcaatccgttgatgaaccccatgatatctcctccctgatacgtattctatcaaatcatactataaaaaggtttccattcccagatgagtagagtaaactggtgctgactggaaaaggagagcatgttacacatgaaagatagatatgacaatttcgcagccctttccgctgctgaatcggaatacagaattatttatgaagaaaaagagggaagtaaatgtatcgtcctcgctccccacggcggcaggattgagccgggtgtcagtgagctggtgcatgcattttctgaccaaagctcaatttatttatttgaagggacgaagcggtgcgataaccgttctctccacttgacaagcacacgctttgacgagcctctggctttagaaaaagtgaccgcccatcattacgcattggcttttcacgggtatcatgatctgaaaaaggcaaatacactcgtcgggggcgcggatctggaaaaagcaagactgatttgtgatctgctgcgtgaagcgggatttgatgccgagctgacagagaagaatgatcggctggcagggttaaatcccggcaacattgtcaatcggacaaaaaggaaaatggggctgcaattggaagtgagcacggcgcagagacacgcgctgttcagcaattttggctgccggggagaaaaatacacgccaaccgatctgttttttcggtatgtagaaaccgtgaaggccggtttttatgataaatgaacagggggcccgttcttacattcactggagctatgcggcgcatgaagtgcttggcgggcagcacggtgattacagcgtcatgatgcaaaaaccttttctccgatgtcaaaatgatgacattctgccggctgtgttctaagccggcggagaatcgctaattttcaataaaatacggcgttttttcttcagcggcatgcaagtgtgtctgtccgcttccataatacacattcggccgcttgtcggataacagacaagcgagccgcttctgaaattgaatacctgctttacgccgttcaaacagctcgagccttttttccgcaaatgatgccgtcacccggaaagcggctgcgattaaaataacggcgtggctcctccgctggggcagctccatgtttaacagcataaaggtcggcacacagaagtggtacataaaatggttggcctgaaattcctgcagttccctgaacagcttgttcatatgaaaatggttcccggtatgcttcagcacatggcacagttcgtgcgcaaaatcctgccattgctcttcgggtgactttttttgattcaggacgatgctgtacatgccgtcccgcttcagcatcatactgtgcgtatcttcaaaatgaatccaaatgtcaagctccttggcaatcatctgcatatcaatatggagaggggcggtcattcccatgcggcaatataagtttttgacgtattcctcaagatgtgttaaaaaatcgcccaattgaatacaccctttcgaacatatgttcttttttaagcgagaaagaaaagccctgatcggactttgaatcaattcccttttcttttaaaaataaacattcagcttttatatcggctgaacgttaagcagtttaaaggaaaagagcggattatttatgtttcggcctgcggtttttctctttttcttttaaataattaatgaattcaatggcctgctgcttgctttccggggaaaagtcctgcatgtcccgatatgcgatctgcaggtcgggatcggcaaacatgtcttcatctgaaggttcttttccggttaacaaataatcagtcgacactttgaaataatccgcaagcttttgcagcgtgtcgtaatcgggttcagatcggccgttttcataatgagaatatctggcgcgcgagacaccgatatgatttgcgacttcttcctgcgttttcttacctctgagactctttaatcttccgcctatcatccgaaatgacctctcttttttcaacaccctaagttacttatgattatagatacaaaatgtatcaaaagaaagagatgataaaaaagtatcaaaaaggtcttgatgatacgaaatgtatcgtatataatcaacatcatagggatacaaaatgtatcaaaatacgataagaaattgatcaggagggtgagagatgcagccgataatcatccgtttcagcagcaatccggctgaccagagatgtttaggaaaagcaggcggttcgatatcttttaccgcttgcggactaccggtattccgatttgataaccgattgcagtatgaacgctatataggtctgaagaaaaatggagatgtcccttatgaaacgtaaaagctacccgtttttcatctattctggattattgaattcagaacattatgacaaaatagggtccgccatttggctgtttttatggttcatcagctcaacgacaaaggaacatgtaaaagacggcgtaaagtgggggatcgtcctcggacataagcccgtaaaagcaagagaaatggccgatgtattcgcggtcagcgaaaaaaccgtcaggcggtggctcgagagcttggaacagcatgagtatatcaaaaccgtccgcgccccttacggactcatcgtctccgtaaagcactcgaaaagattcacgccgaaaaagacattaacccgcccggaagcaactgaccggacaatatcggcggatcaccgggacaaaaatgtccggagagaaatagatataacaaaaatcatactgctgaagaagcgattaacgacattgctgcccattttatcagattaaggtctgcacaggaggggcggagcgtatacccgtcgccccgggattatcaggccatcgcccgtattgtttccctcggtgcgtcagcacaagaagcaatcaaatggctcggcgaatgctttaccgcttttgaacagcggcgcacctcttcagctgaaacgatcaaggctttcagctattgcgccaagtttatggaagaccgcttgaatgcacgaattgcgggaaggacaatcacaacaaaaaaagagaggaatacgatacatgacaaaacgaacgatcgagcagattcttgccgacctgaaaaacggaaaacgtccattactggcggacagaccggaagaatcagacaaaagccgctttgactgcccgctctgtaaagatcagggcggttatctcaaaaaccagctgggaatggaagtatgggttaagtgccgctgcgccgccgaacggaaagtagaacgcattctcggcgcaagtgagattacagatgcctttcggaagctggatttcaaaggatttatcacgcggggcaagcctcaggcagtcgtcgacgcatatgagtgcgcccttgaatatgttgagaacttcgacaagatgaaaaactgccggaaaaacagcattgcccttttagggcgtccgggatcgggaaaaacccatcttttgaccgctctcagcaattatgtcatgagacagaagcagacaccggtgctgtattttccttttgtggagggctttacggatttaaaaaatgattttgatctgctcgatgcaaagcttggccgtatgaaacaggcggatgtgctttttattgacgatctgttcaaaccgctgaacggaaaaccccgggcgaccgattggcagattgaacaaatgtacgccgtcgtgaattaccgctatttaaatcataagccggttcttatctcgagcgagctggcctgtgacggattggtgcaggttgatgaagccttgggcacaagaatttatgagatgtgcagcgattatttagtcatcattaatggcaattcatttgacgtaaaccacagattagagggggcgagataatgtgtaagctgtgcgggccgaagaaggtcattgtgatggaaacgggtttcggcgctgtctttcacccttgcccgaactgcaaaacaggcactgatttaacgccggtcattaaacggcttgaacgaatggttcaagacgcaaaagcgaggcttgatgcacgtgtgtaaatatatcaaatggcttttttgcctgctgttcagggcaaaacggatagaaaagcaaattgaagcatggcatgaggctgatggaaagtgaggatcaccattgcaagaaaaaaacagccccgctccatggcgggccgtacacagcggagaagaaaaacccatttacatttattccgcttacagcgaagcggataaagagaagttcccttattcaaacggaaggctcatcgcggccgttttcaacttaagttcatactcacagcagatcaacgcggcattgatggcgaaagccccggaactctttgaggcggccgaaacggctctccgcctgctccggggagaaagttctgaagaaaaagaagcgttcataaatgagctcggaagcctcatacatgaagtgaacattttgaaaaagatggaggaagtaaaacatgaatcctaaaaaactgactgacattgaacatacaacattaaaaagccagctggaagaaggcaaggttcgggtgattatagtagacggactgaagaaggaagcatggctcgccgaagcgccggagcacggcaaaacgcttgtcgaaacgcgaaaaggggatctggcccgggtcgaatatgaaatcggctttaaattgaattaatcgaaaaaaacagaatacgtccaagacggaaagcctgcggacactgatcaatcgcgcacatgctgcgcattgattggtgtccttttttgttccgaaaaagaggaggatctacatggaagacttactatttgaatataaacgcacgctgaaagagacgaaaaagtggtacaagcagctggaggcagcggatgaaacggtgtttacttcagaagaactgaaagataaaaaaatcatcagaacgattattacagatttggaatatgtcatcgaatggcttgaaaaaggccggcagcccggcataagaagagcgatagaccgcagagacgcttatcagagaatgctcattaaagatccgagaatcatagaaacctattcgcaggcgctgatgtttgaaccgtccgcaaatgtgactgaagaagacagaatcagactgcgggacgcattagccgttttaacggatagagaaaaagaaatgctgctgctccacaaagcggaatgcttttcgtatgaacggatcgccgccttgctgaatgtaaagaaatcaaccgtacaaacgacggtcaaacgggcgcttctgaaaattcaaaaacagcaggaacaaagaaatcaatcgcctgcttcataagttgtcatacgtttgccacctagaagtgaacagacgatcacaaaaagcggcccgattagaagccgctttttattatagacaatcatgtcggaggtggcggtgatgccgtagcatgaaaaacgcaaaaagagaacaggcatttacaatctatcagtctcataaaggccgcatcacaaatcgcgcccttgccggcaaatcaggcgtatccgcaagaacaatcggcagatggaaaaaagaagggcgctgggacgaggcgcttaaaaagaacgcggaaagcggcggaaaaaacaacccgggcgaaggtgatgagttaaacgaacgccagcggctgttttgtctttattatgtgaaatgctttaacgccacccaatctgcgataaaagccgggtattcaccggaaagcgcgcatgtgacgggaagcaggctgttaaaaaacgaaaaagtcgctaaagaaatcagccgcatgaaaaaggaaatggtcaataaagtgtttgtcgaagcgatggacgttcttcaagtctatgtgaaaatcgctttcgctgacattaccgattatgtaaccttcggaaaaaaagaggttcaggccttcggaaaatcagggccgctctttgacgagaatgataatccgattatgcaggagatcagctacgttgacgttaaagattcgcaccttctggacggaaccatcgtcacggaagcaaaactcgggaaagaaggcattgcaataaagcttgcggacaagatgaaggctcttgaaaagctgtccttgtactttgaccttttccctgaccaatttaaacaaaaaatcgaaaatgaaaaattaaagctggcacagcagaagatggaaaaaacagaagacagccaaaagccgattgacattgtcattacgcggaaagaggaacggccatgattgaaaaagcggtcaacccgcgctttgaagattatttgttcaattggaatgaaacgtaccaatttctcgtcggaggctacggctcgtcaaaaagctatcataccgcgctgaaaatcatcctgaagctgcttcgtgaaaagcggacggcccttgtcgtgcgggaagttttcgatacgcacagggattctacgtttgccttatttgaagacattatcacggagcttgaactgggacatgccgtaaaggccgtttcttcaccgatgcagctcagattttcaaacggaagccggattatgtttaaagggatggacaacccggccaaattgaaatccattcatcatatttcactgatttggattgaagaatgctctgaagtgaagtatgaaggctttaaggagctgatcggccgtctgcgtcatcccgagctttcgctgcatatgatatgcaccacaaatcccgtcggcacctccaattggacgtaccggcatttttttcgtgatgaccaaaaaaaacggttcgtattggatgatcagacgctgtatgaaaaaggcaccgtcgttaagggagatacgtattaccaccattccacagcgtgcgataatctgtttttgccgaaaagctatattaagcagctggacagcttacggcattacgatcctgatttgtaccggatcgcccgcaaaggacggttcggcgtcaacggcatccgcgtgtttccgcagtttcaggtcatggagcacaacgaagtaacggagcggattgcgtccatcaggcgccccctgtttcggaccggcatggatttcggttttgaagagtcatacaatgcggtcatccggctagccgtcgatccggatcaaaaagagctttatattttctgggagtattacaaaaacaaaatgaccgatgatcagacagctgaggagcttcaagaattggcggatcaaaaagagctgatcaaagcggattcggctgagccgaaaagcatccaatatttccgcaggcagggattttgcatggttgcggccaaaaagtttccgggctcaagacttcagtatacaaaaaagctgaaacggttcaaacatatctattgctcagacagctgtgaaaatacgatccgcgaattgcagaacttaacgtacgcaaaaaacaaaaacggcgttctgtcggaagatgagttttcaattgatccccacacactttcagccatttggtatgcgctggatgactatgacgcggcggatctgaaagatgcatcacaaaaacggagacgtccgaatcgggaaaggaggagataggcgttgcctaactatcaaaacgttagagccaccgtctttaaatcaaaaatggccgcgccgcaggcaaggcagatgaacgaagatcaatttgccgatctgtacggcgaagacatcatttcaccgccctataatctcattgaactgaaaacaatcgccgaatactcgacgattcttcagcagtgcattgacgcgtatcgggtcaatattacgggttttgggttcgatgtggaatatacctttgatgtaaatagcccagattgctcaccgtctaaaaaggcccgggccgaaaaaaactggatgaagctggagagcttttacaaatgtcttcattttgatgaatcggccgagacggtcctcggatatgcgatagaagaccgcgaaaaaacgggcaacggttttctcgaagtgcttcgggacggcgcgggaaaaccggcggggattgaatatctggatgtgaaacatatgcgcgtctgcggtgtgactgatcccgttgaagttacattttcatatgaagaaaacggcgcatccaaaacgattaaaaggcaaaaacggttccgtaaatatgttcagatgctgaacggacggaaagtgttttttaaggaatacggcgatccccgcatgatggacatgagaaccggtgaatacgtaaagaccctgtctgaagaataccgggcaaatgaagccattcacttaaaaatcggcagcggcacttacggcattccgcgctgggtcggcaatatcgtcaatctgtacggcgcccggaaagcggaagaactgaattttatgtatttcaagcagggccgtcacgtgccggccgccattacggttgaaaacggcatgctgtcagaaacctcgtacaaagagcttcaggattatatgaatgacctggaaggggtggaaaacgcccacaaatttctgctgattgaggcggaaggcattgcgaaggaaaaagaccttcacggaggcgaagacattacgcccgtgtctgtggaaattaaatcacttgcggaaattctgcaggatgatgcgctgtttcttgaatatgacgacagaagcagaaataaactccgttccgctttccgtctcccgccgctttatacgggagaggcgcaggaatacaacaaagccacagccgatacggcacggaaaataacggaggagcaggtgtttcagccggagcggaaaacgctgattaataagctcaacacgttatttttgcctgaactgggtctccacgatgtacagctcacattaaaagggcctgattttcgcgatccgcttgaaattgcgaaggtgcttacgccatttatttccgccggcgcggtctctcctaatgacctccgtgatctggcgggaagagtgctcggcaagacgcttgaggaatggcctgaagagtactacagccggccggtgctgaaagggaaataggagcaatcctgaaagggggtgaaaacatctcgtgccgagagaattgagaaatgccgtcatcagttttgtgagctatgtcgataaggcggcgaaccaaacggaattcttttttacaaaatcagccggaggccttccgtcatttgaaaaaaaggtgcaggtgtttacaaaaaacgaatcggatgagcagaagcttgtttacggcatcgtttacgagccggatgtccccgatgcacatggcgattatatgacggctgaagagattgaaaaggccgctcacggttttttggcggacgcccgcaacatcgatacaaatcataattttgaaggcgggaccggcgaggtggtggagtcgtacgtcgccccggatgactttgaaatcgggaatgctgtgatccggaaaggatcttgggtgcttgtcaccaaagcttccgatgaagtatgggatcagattaaagccggtatcattacgggctacagcatggcgggaaccgctgacgtttacgaagagccggcagaaaagcaagccggcttattcggcgcagtcaagcaatttctcgaccgtgaccgcaaatcaagaaaccgcaagggagaggacttgaacaagatgagaaaagaagacgtaagagaatcgattgaacacgcgctgcacccgcttttaaagcggcttgacagtttggaccagaacacggaagacaaagacggggcggctgcgccgtctgatgaagaaaagctgaaaacacttgttgaggacatgctggcgccgattattaaacgcattgaagcgcttgaaaaagtaagaggcgcatcaaagcagccggaagaagagacgggcggtcaagagcctgttaaaaaatccatttggagcggactgctttaagcccagtcagaaggaggaactgtagagtgagaaatcaagatatcatcagaaaggcggaaatgtcactttccgctttaaaaagcggcggtttaatgaaccccgcacaagcttcagcatttatccgcatggtgcagaacacgccgaccattttcagcgaatcgcgtgtgattcaaatggaaaatgactcgcagaaatttgaaaaaatcggtttcggccagcgtattctgcgtgccgctgaggaaggaaaagccttaactgacgatcagctgaccgtcccgtcaacaagtacggtgcagctgaatacgaaagaagtcattgcggaaattaatatcacctatgacacgcttgaaaacaatattgaaaaagacggcctgcagcagacgatcatgcagattttggcggagcgggcggcagtcgatattgaggagctagtcgtaaacggcgatacatcttcttctgatccgtacttggcacagcttgacggaatccgtaagcagactgtatctcacgtcattgacggaaacggggaagagctgtccagagccacatttaaaaaaggcttaaaagccattccggcaaaatatttgcgactgcctcaggaattcagattttacacatctcaaggcatggagattgaatggaaagaccgtgtggctgaccgtcagaccaatctgggagatcttgcggtgcagggcggtttgtcttcagcattcggcgttccggtcaaaggagtgtccaatctgcagccgtactcagtcggagaaggtgattcccagtacgatgcgtctgacatcattttgactcacccgaaaaatatcattctcggtttttcaagaaatatccgaatcgaagtagataaagatattcgcagccgcaaatttattatcgtactgacggctaaacttgacagcaaatttgaagaagaagatgcaagcgccaaaatcgtaaacgttaaagaataagacgggggtggcagttatgttaattcagccgtctgacgttgtttcatattcagtttatgatcaagtcaaaaacaggccggagccgcttcttatacaggacattctggaggcggaggcggaggcggccagaatggcggggcattcgttcactgaccctgtttactcaccgcttcccgaaaagattaagcttgcgttattaaagctttctcaatattttgcgctgatcaaccagaatgaagcagccgcttccgcctatcaatctgaaaagataggcgactactcgtatacggtggcaggtgaaggcggaatcagaaaaccggcggtgcaccatctgctctgtgaatatatcgcgccgggttattctccggtttctgcacacgcaaaggtgagacctttatgagctacgaacggctgctcactgacagatgcgatatttatcatgagacggtgtcagttccgaaggccggacgcttcgggattcccgccgaaaagctccagcctgtcttttcttatccggaagtgcccgattatgaagacgtgccgtgtctgtttgttgaaaaacagcagcagcttattcagcttgagcctgatcataaggtatatcagcggtttctcgttcattttccgaaagaggccgttgtgcgtgtcaatgacaaaatcatttgggaaggacaggcgtatattctggaaatgccgaagaaaacaagacagcaccattgggaggttatcgctgtgagagatgacagactatgagcataaaaaaccttgaacaatggaatcggtcgctgcaaaaggcatcatccggagaatttgcccgtcaggcaggcgaatggctggaacagtcaggagaggattttctcgacttggtacgggaggagcttattcattcgggcgggattgatacagaaagcctgctgtcttctttccggaaaggagcgcaggatcacgtatggatcattgaaaacgggggactgacccttgaaatcggcaccaatgtagagtatgcctcattcataaatgacggacattggaccgtctcagatgaaaatgtcagatgggtgcccgggtattttcaaggctcccggttcatctatgatccgtcagcttcaacgggaatggcgctcaaaaaacagtggatcagcggaaatgggttttgggacaaagcccttcttttgtatgaaacactcttcgccgaatcgctggacaagcgtttcaatcagtggcttaacacgttggggggagatatcggatgaatcgcgagaccggttcaatcgccgcttttttgtatcagcagtgcggcgtgcccgtatatgaaaatgaactgcctgaacaatttcaggtgccgtcactttacatcccgcccccgtatgcttttgacgagaatgacacagtctccacctttaagaagacatacagtctgaatgtgaagctgttccatgccgactcggtgcaggccctctatgcagccgacgggatcgccgatgcggtgagagaatcaagacagctgattccgctgcttacggaatcaggggaggataccggtgatttcgtccgcatcagccgtatcgaaacaagagtcggagacaaaggcgaggcagtgatcaccatccgctggacgagccgctactactatcaaaaacaaacatctcccgcactgcgggatgtggacattaacagcggggtgaaacaaaagtgaaacaatataaaaagaaaaacgccgcaacggcggaacgagcggttctttatgacacggcggatttaacaaagcacgcgaaggagcttttcggcgtaaaacccgagattctccagggtgctttattcggcgtgaagcaaaaacaaatgacaaaagcgcaagccaagtcttacattgaagcatttttaaccaaggaggtcatgcaataatgaacggcggaacatttacgcaaggaaaagaaaaagaacgtgccggaatctattttaactttaaaacaaccgcccaggagcgggtatcgatcggtgaacgcgggattgtcgcccttcccgtcgcatccggctggggggaagcgaaaacattcgtttccatttcaagcgttgaggatttgaataaaaaagtggggctcagtattgaagatccgtcactgattctgcttcgtgaggcgaaaaagaaagcaaaaaccgttttgatgtaccgtctgacagagggaatcagagcgagcgcagatctttcgcaaggtgttaaagcaaccgctttgtacgggggttcaaaaggaaatgacatcatcatccgcatcagtgaaaacgtccttgatcagaccgctttcgatgtgaccacttacatggatgaagcggaagttgacaaacaaacggtgaaaaaagccgaagaattaaaagcaaacggctatgtcacatttacgggaacgggcgaactgtcggcttccatcccgctgacaggcactgaggaagaatccggggaaacgttaaacccgcaggcaggcatccgtctcgcgggaggaactgataaagcaccggtcaactcagactatacggattttttagctgcggctgaaacggagaatttcgatgtcatcgctcttcctgtcgcggaaaacgatcagctgaaagcgacatttgccgcattcattaaacgccttcgcgatgcgcagggacagaaagtgcaaggggtgaccgcccattacagcggggattatgaaggcattatcaatgtgactgaaggtgtgctgctggaagacggaactgagattaaagctgaagatgcgaccgcctgggtggcaggcgcaagtgccagcgccgcatttaatcaatccttaacattcgttgaatacgaaggcgccgtcgatgtgctgcaccgcttgactcatgatgaagtgatcgaacgtctttccaaaggtgaattccttttctcttatgatgcccgtgataagtcagtcagcgttgaaaaagatatcaactcattggtgacatttacggcagagaaaaacaaaaagttcgcgaaaaacaaaatcgtccgtgtgcttgatgcggtgaataacgatttgacacgtgaactgaaagccttaattaaatcgaaaaaaggcaccggaagcgatcttcctgcgacaaatgacggccttcaattcgtcaaaacgatgattattcaatatttgacaacgctccaggatgcgggcggcatcgctaactttgattcagacaaagacattacaatcgggctgaatgaagaccgcgacggctttttaatcgatctcgccgtacagcctgtggatgcggcagaaaaattctactttaatgtggaggtaaactaagatggcattaaaagcgcaaaacacgatttcaggaaaagaaggccgtttatttctcgacggagaagagatggcgcatattaaaacctttgaagcaaacgtggaaaaaaacaaatcagaagtaaacatcatgggccgccgcatgacgggacataaaacaacaggcgccaacggaacgggcacggcaacattctataaggtcacatccaaattcgccgtccttatgatggattacgtcaaaaaaggcagcgacccgtattttacgctgcaagccgttcttgacgacaaatcatcaggccgcggaacagaacgcgtcaccctgtatgacgtcaactttgattctgcaaaaatcgccggactggacgtagactcagaagccctcgaagaagaagtgccgtttacctttgaagatttcgatgtgccggaaaagctttctgaaacgttttaaccagaatcattgtgagtgaaacaggccttttataggcctgtttttttataaaaaaagagtaagggagttttcatcatgagcgaaaaaaacgaacaagtatatgatctgtcattctttatgccgggtaaaacagtcgaggctgaggagatccgggttccgctttcaaagcgttttgtcgataaaaaaggaaacatcgtgccttttatttttaaagccattacgactgagcgcattgacgaactggagaaggaaagcacgacatataaaaatgtgaagggcagaggccgcgtaaaagacttagacagccagcgcttctatgcgcggatcgcggttgaatctacgatttaccctgatttccggtctaaggagctccgcgacgcttacaaaacggcagatccggtcgaggtggcaaaacgcgttctttcagtcggcggtgagtatgcaaattggctgaataaagcgattgagatcaatggttttgaagatgaattagaagatctggagcaagaagcaaaaaactgataaaagatgggaataaggaagccgtgtatctctattacgcgatgcatgagcttcattattctccatcagaactgaaagagttatatgaagcaccgagacattttaaggcgctgttgtacggtttaatcggttacaagctggacattcttgaaaaacaagcgaagaaagggggagcgacatcatggcaaagctgaccgcccgttttgaattggaagatcgggtttcaaagaaaataaggaaaatccaaaatggcttcagagcgcttgagaaatacaggaaaatgacaaaacgccaaagtgaaattgatatacgcaaagagagtaaatctgttttaagaacaattgaccgcatccagcgctctatgaaaagaaagctgggcgcacaaatgatctctatttcagctgaagacggagccagtgccgtcattcaaaaggtgcaagcccaattagcgggtctgcctgcgtctttaaccgttaaaataggagcaaaagacagcgcgacagcggcatttgagagattgcgggatctggctgccggttttaaaggatttaccgtttcactgtatgcgtcagacgaagtgactcctgccatggaacgtatcaaacgctacatgcaatctgcgttaaagaacgggtactctgtcactatacgcgtcatagatcacgtcatgaaaacagtcggccgaatttcagcggggattgattcgctgacggggaaaaacaatgtcattcaattatcgttaaacgaaaaggtgacagcacagctggctgcaatgcaaaagaatatgccggacgtcggaaaagcttctgcatctgctgctcctgcttcgccgaaaaatgatttttcaatgcttgactccattgcagacaccttcatgaaaaaagtcaatgatatcgcatccaaattttatccggaaacaatcatagcggaactggataaattcgctgcaagctttatgaagaaagcggacgaaatcgcgagcaaattcagcccggagacaatattagcagagctggataagttcacgacctcattcatggggaaagtggatgaaatcgcaagcaaattcagcccggcaacgatattagccgagctggacaagttcacgacctcattcatggggaaagcggatgaaatcgcaagcaaattcagcccggcaacgatattagccgagctggacaagttcacaacctcattcatggggaaagcggatgaaatcgcaagcaaattcagcccggcaacgatattagccgaactggacaagttcacgacgtcattcatgggaaaagtggacgagattgcaagcaaattcagcccggagacgatattagcagagctggataagttcacgacctcattcatgggaaaagcggacgagattgcgagcaaattcagcccggcaacgatattagccgaactggacaagttcacgacgtcattcatggggaaagcggacgagattgcgagcaaattcagcccggcaacgatattagccgaactggacaagttcacgacgtcattcatgggaaaagcggacgagattgcaagcaaattcagcccggagacgatattagcagagctggataagttcacgacctcattcatggggaaagcggacgagattgcaagcaaattcagcccggagacgatattagcagagctggataagttcacgaccttattcatgggaaaagcggacgaaatcgcgagcaaattcagcccggcaacgatattagccgagctggacaaattcgctgattcgtttatgaaaaaggtagacggggtcgtgagtaaattcagtccggaagccatattgaaagaactggataaattcactgattcatttatgaaaaaggttgatgacgttgtcagcaaattcagtccggagaccatattgaaagagctggatcattttactgattcgtttatgaagaaagtcgacgacgttgtcggtaaattcagtcctgataagctaatcgaccgcgccgaacaatttgtaaatgacacgattgaccgaatttctgagaaattcgattttctcaatccggataagattctggaaaaagtggagcagtttacttcctcactgttcggaggcattgataaaaagttcggcaagttcagccctgatgcgatcatcgaaaaagccgaggcatttgttgataaaattgtcagcaagattgccaagaaatttgagaaattcagcccggacaaaatcatcgaaaaagccggggaattaatagaaaaaatattttcaggaatcgctgaaaaattaggcaaactcaatatcggcggattattaggaggcggcacgaaaaaagaaaagagtaaggggagcctttctgccggcggcaccaacagcccgaagcgtcctgagctgacaaagggtccgcagcgcacgggaccatcaccgaaatcttcaggaaggtcagccaaaaaaaccggcggggctttggggggcggctgctgctgtaccggagtgacgaggggcaaaagcagtaaagtcgaagggcggaataaatcttcgaaaagaggttcctccgtaaaggaaagcaaacaggcatccgtaaacacgccgaaaacaaaaggggcaggtaaaggcatcggcgggcttttgaaaggcttaggagattcaaaggcgctgaaaggcggtatgaaagggttaaaaggtgccgctaaaggaattcccggcataggtgaattgttatcacttactgatttagccggcatcaataaagataatgcaggagagaaggtcggctcagcaggcggcggtcttgcaggagccgcggccggagcggcaatcggcagcgttgttcccggagtgggcacattaatcggcggcgcggtaggcggcatcgccggcagtttaggcggttccagcttgggagaggcctttgattcaggggctttgaaagacacatggaatgatatttccgaagcggcgcaaagtgcttggacaacagtacaagatacttggggaagcgtttcatcctggttcatggaaaatgtatggacgccggtttcatcagctgtcgccggagtggcgacaagcatctggtcaaatatcgtgaatgcatggacgacgattcaagggattttcagcacggtgtcatcctggttcatggagaatgtatggacgccggtttcatcagctgtcgccggagtggcgacaagcatatggtcaaatatcgtgaatgcgtggacgacgattcaaggtgtcttcagcacagtatccggctggtttatgagcactgtctgggagcccgtaaaatcggctgtcgtcggagtagcgacgtccatttggagtaaaatcacaggagcttgggataaaattaaatctgttttcagtacggtatccggctggttcatggatattgtctggaacccggtgaaaaacatggtggaaaaagtcggaaaaggaatatcagacgctttcacgactgctttagatacggtaaaggatatatggaaagggttaagcggctggtttgagaaacatataaaagaacctcttgtaaaagtgggaacagccatatcagatgctttttctgcagcattcgactgggtgaaaaagatttgggataaaaccggcggcaaattgatttcaggcgtaatggactttgtcacaggaggcggcggagataaaaagaaaaaaacggacaaaaacgccacgggcggctacattacaaagccgaccatttcctggatcggtgaagccggtaaagaatttgtcatccccgtcgacaacaatcgcggccgcgggaagatgctgctttcacaagctgcgtctaagctcggcatgcgtgttgtcgatgatatgggcgcggcttcggctcagtcttccgctgtgccggcgggagcgggcggtgtttcttcttcggcgtctgtatcggccgctgcgtctgtggatgcttccggatttgcggggacggcttcatcactcggcaaacagtttactgaaggctttgacagcggaatcagcaataaagcggtggatatggacggctggaaagagaaaaacatcggaacgccgtttaacgcccttatttcgtcttcgcccgattacggaaagcaagtcgctgcgggctatgccaaaggtcagaatacatcgccgacgggcaccgattcgtttttaaaaacaaaggtgaaaacaccttatcaatcggaggttaatcaatcgtcatcatggggcgccgccacagtgaaaggttattcggccggacagaatgcaaaagatacgggaacgtcgcaatacgtaagcacacatatcaataaaccgtttgttcaatcaagagattccgcgaacggctgggggtcaggcctgatcggacacttcgtatcagggatgactgcaaaaggaagcgaagtcaaacaggcggccaaagatatggccaaaaaagtcgaggacgcattcagggaagagcttgatattcactctccttcccgtgtcatgatgagtctcggacgctttgcttcagtcggcgtcgtcaaaggtctcagctcagttgacgtgaaaaaatatgcggaaaaacaggcaggctcgcttgcagcagccttttccggcatgggtgcagcgggaggaagcgtcaaagaatggcttttggccgcaatgaaagcaaccaatacgccgatcagctggcttccgggattaatgacgatcgcacagcatgagtcaggcggcaaccctaattccattaatctatgggacagcaacgccaaagccggacacccgtcacaggggcttatgcagacgattccgagcacctttgaagatcacaaagcgccgggcatgaatgatatcagaaatccaatccacaacgccgctgccgctatcggctatattaaaagccgatacggctcgatcagcaatgtccccgggattaaaagtatggctcatggcggcccttacgtcggttatgccaatgggggtctgattaccaaggagcagatcgcccgtgtcggcgaagggaacaaacgggagtggatcatccctgaagagcggggcatccgcggccgttatctgctgcaaaaagcggctcaggcgctcggcatggaagtgtccgatccgtcccggacggaaccggcggcgctttcagccggcacggtttccgcagccgttaaaggcggcggccaaaccgttcaaaaaacgggaacaaaagaaattaaaatcgaattcagcggcgatcagcatttccataacgggcaggacgccgagagcctagccgccaaaatcaaacaggcgctgattgatgaactgcaaaaagacatttataccggagcaaagggggccgttgcttttgactaaatctgtttacgaattttggctgtctcaagggaaggacaagctccggcttcccgttctccctgaagcgattgatatcgcaaacagcgtgcagaatgattccgtgaaagtcaccggacttggagaggtgacgtttatcgaagaaccgggagcgaaagaaatttcgttctcttctttttttccgaaacggtacagcccgattgccgaatatcaaagcattccttcaccggaaaaagccatttcagccattgaagcatggatgaaagcgaaaaaacccgttcagtttttgattacagggacaaaaatcaatgtcacatgcagcattgaaagctttaattacagcgaaggtgacaatgaaatcggcgaccggaattttgatatcgtactgaaagaatataaaaccgcttcgccaagaaaaatcaaacaaaagaaaaaaacgaaagcgaagcgcccgtccaaagcttcacccaaaacatataccgtcaaaaaaggggatacgctttgggacatcgccggcaagttttacggaaaacacacggagtggcggaaaatctggaacgcgaataaaaccgccatgattaagcgcagcaaacggaatatccggcagccggggcattggatcttcccggggcagaagctgaagataccgcaatgaaacgggtgaaaagatgattgaactatttgtcataaaagaaacggagtggctcgagcttgtcacagaaagcgtaacgctggaaggacacagatatcaggcgccccgctccatcgaagcgacgattgtcgtaaagcagggcagccagacgtattacggcgtatcagaaggggatacggttttgttcaaatggaacggaaaagagctgttccgcggcattgtttttgcaagaacgcccgatgagcataccgtcgccttcaccgcatacgatatgctccaataccttgtgaaaaaccaggacgtttacgtgttttccaacaagcgcgctgatcaaatattaaaaaggatcgccagcgattttcaaattcccgtcacatccattgccaacacaggccatactattaaatcactcgtttttaaaaatgatacaagcctttacgatatgatgctaaaagcgttaaagcagacaaaaagccagacggggcgcaattatcagctctattcagaaaaaggcaggctcggcttgcgtgaatggccggagccgtctgacatatgggtgctggaaacaggagttaatattacagggtatcaatacagcacctcaattgatgacaccgcaacccgtgtcgtcatgcggctgcaaaaagacaataaaacgataaaggcttccgcctcagacagcgccggcatgaaaacattcggcgttttgcagtataccgaaacggtttctgacgacattaacgaagcccagctgaaacagcgcgcaaaagtgaagcaggctgagaaaaaaggcattaagaaagagctgaaaaatatacaggcgatcggtattcctgggttggaaagcggattgcccgtctatatttcaattccggaaatcgggctgaagaaaacctattatgtagatacggaccgccatgaattccaaggaacaaaacataccatgacgattgacgtcacggagaaaaattcacttccggaggggacagcctgatgagattaagtgatgccattaaacatttagccgtcggagcggttgacgctgaagcgccggtggagctgatgccggccgaagtgacctccgtttcgccgctcgagctgaaactgaaagatcacgacaaacttttgattccgtctgatgcactcattgtgccgaagcggctgagatccggagaagatgatcagctccaggcgggagatcgggtgatgaccgccgctttaacaggaggacagtctttctttgtactggacaaaatttaaccggcatccggacggagatatacgggaatatcagcctattaaagccgcttcatctgccgaagagggcttttttacatgaacaaatctaaaaggagcgggtgcaatggccctgacaccggaaatcgaatttgaagatttggaggatgcgagtgaggctgttgagacttcacaaacctaccgaattgactttgaaaacaaccggattaccaatgaactgataaacggactggacgcaatcagacaattcgtctatatcgctcttcacacagaacggtattcatattcggttttcagccatgatatcggaaacgaacttcaggaagtgctttcagatcagaacacgacggatgcttataaaaaaatggagattccaagactgatagaagaagccttgctgtatgatgaccgtattttggccgttaccaattttgagattgagaaaaaagatgatgccttcatcgtctcttttaccgttgaaactgatgagggcatgcttgagatagaggaggtgctgggtgaggatgtttgaagctcagacgtttgacgacattatggacagaatgctggcgcgcgttacggcggatattgatacgagagaaggcagcgtcatttacaatgcgctcgcgcctgcggccgctgagctcgcaaagtcttatatttggctggataccgtgctggagctcgtgttttccgatacggctcagggtgaatttctggacaggcgtgctgctgaggcgggaattgaacgaacacctgccactaaagcggtcagagccggagaattcacagcgggcatcaccattccgccaggctcccgtttcttcgttgataacctgtattttcaatatacgggggatggaacgcttgaatgtgaaacagccggtgaagcgggcaatgccggcatttcggggcagaacctgctgccgcttgatacgatacccgggcttgagaaagcagtcatgcgcgatatattaattcccggccgtgaggaagaagatgacaacagcttaagggcgcgctattttacccgtgtccgccgggaggcagtcagcgcaaataaacagcattataaacaatgggccgaagagattgacggcgtcggcagggcaaaaatcttcccgctttggaacggagacggaacggtgaaagttgtcatcacaaatgcgaatttggaaccggcatcagatattctgatcaaaaaagtaaaggattatattgatccggacgaagggcagggagaaggacaggcgccgatcggagcggcagtaacggtggaaagcgcagtatggaaggaaatcgaaatctccgcttccgtgctgcctgagctgaacagctcgatcgatgacgtaaaagcggagattgaaaaaggcgtactgaatttattcaagaaaatggcctttgaagaaaacaccgtccgtttatcacaaattaacaacatcgtttataactcggcatccgtcagtgactacgccgatattaaaatgaacggtgcggcagaaaacctcgtgctcagtgacgtggaaattcctaaactcaaagaggtgaaaatccttgagcagactcgatgagatgacggcgtacctcccgccgtttttaacccgattaaaagagatggcacaactgcttatggcggaagctcctgagtttgagcggcagaataacgatattttcgatttgacggatcagctctttatcacgacggcgacatgggggcttgaccgctgggaaaaaatattaaaaataccgcgggaatcaggtgacacggaggatatgagacggctcaggctgatctcgaagatgtcgaatattccgcccatcacacatcaagcgatcgagcaggcgctaaaccgttttttaaaacatccgtcagcttatgttcggatgtttccggggcagtatcgtttttatgccgatatcgggcttgatgacctgcagcacatgaacgagctgattgaaacgcttgaaaaaatcaaacccgctcatttggcgtatacactgagagccgcattaaacgaaacactggaaatcaaagaccgggtcattctcaacaatcggagataccgaaaagtcagtgaactgaaggtcggttattccgtcacactcaacaataacgaggtggtcttaccatgatatcagccgcttacagacagcgtgccgcagccgatctgaaaaacaggatcacaaaagtgctgttaaacggcaaagaaactccgattgcggacatttccgtaaaagatgccgcagtcaccgttctcacacgcagggaagaagacgtcaaacacattgaaaccgtgcagatgcttgacgaaacaggaagcgtcattacagaacgaaaaacaaatttagatctcagcaataacagaacgcttgatttaagatttacctttgaggtggtgtaacgatggcttacgaagaaaaaacagactggcttccggacgatccgattaatgaagatgacgtcaaccgctgggaaaaaggcataaaaaacgcccacacggatctggcggcccataaaaacgacatgaacaacccgcacaaaacgacaaaggcgcaaatcggcctcggaaacgtggacaatgtccagcaggcagcaaagaaagattttgaccggcacaatcaagatctggaccggcatgtgacgaaagaagagcgccagaagtggaataacgggcaattgtctaaaatcacaaaagatgatggctccgcttttattaatatctctgacggacaggattttcatcagaccgctgccagccagaataagacctttactttctcagcagctgcaaccggaataaataccccgcctaaaccgtcagagggtatatacctttattcttcaaagaataacggagaggcggccgctttctcagatgacgggggattttggagaaaaacgctgaaaaacggcatctggacggaatggatgccatttgaaacagctgccggagcacaagcaaaagtaaatgagcatgccgacaaaacagatcttcatgtaaccaagtctgacaaagacaaatggaatgcagggcagttattcaatctgactgacaatgacgggaatgctaaaacggtaacagaaacaaacttagacaatataaaaacgtccggcatctactatatatcagttcagcatacagaaaataagcctgcggaatacggacaattaattgtcatgcaaagaacccgcggagcatcaccgacttttgtccaaatgtttatagacacagtgaccgccggaaatcccatatacgtccgaagtttcagcactaaaggcgtatggtcggaatggagccaacaagaaacagattcaggctctcaagcaaaagtagaggctcacgccaataaaaaagacattcatgtcacacaggcggataaagatatgtggaacggcgcacagctttcgaaaataacaaacgataacggcggctatcttctgacaattggtgatgatgataactttcttgaaaaaatcgttaaaaacggcagggcgttcggcaccttttattcaaccggcaaagcggcaaacagtccgagcaacgcttcaacccgcggcatgtttcattttacctctcttgacagtgaggggaaaggaacgtttgggtatgtcattgccgtcgattataaaaataatatgttcacgaactatttggatttgaacttgggctggcagggctggcgtcgcctcgttactgaacttgatactgagaatgtaccttggataaatgttccttataaaaatggcgctaaatcaggagacaggccgcttcaataccgtaaagtgggaaacacccttcacctgaacggacacgttcttacggacagagaagtggtattcgggagtgtgccatcctcttgtgcgccggccaaaggcgttgtaacgatggttgcagccagcggcaccaccggttacagcaaatttattatctattctaatggagatatgaagctgacgggaattatggccaatatagaaaataacgtgaacggctattatattgaccttgttttggcactcacgtaaaggagcgagaatatgaaattaatatttccgtatgacaatgacaacatttatacaggcactccggttgagctttatccggattctgagacaggagattatgtgatgccgcctaacgctgcgggctttccgccggaaataaacggcgaaggcatgtggcgcccattttttgatgaagagaaacaagaatgggtggaaaccgctgacgaagcatataaagagagcttaaaaaaagatacggctcccgattcaaaccagcttgcaggcctcggcggacagctggcgaatgagaaattggccagaaaagcagccgaacaagcgcagcagtcactcggcaggcaattagcgtctttaaaactggaactcttaaacgtaaaaggagaatgaaaaaaatgaaaaaacttaacttttgggtttacgccttgttttatgagtgggcctcaacagaaatggtaaaacaggctatgggctatgatgactgctctgccgaagatctggctgaaggggtggccgcgaagtatatcacgcctgaggaatttcaagaaataacgggtgaaacatacgaaaactataaaaatgctgtgtcataagccaaacggctttttttatttgtcatttttaataaatgagaacaggaggacggccgatgaaaaagcattcatttgaatttcccgccgatcaacttggcaggcccggcgccgtaaaagcttatcgcggtaacaaaaacgattatgtcacaccggttgctgatttgtccggaatggcagagcttcttaccaatacgccgctagaagcgattgaagtctacagccaattcggacaagaccgtttaggagccgtcttaatagacagagcacaggggtgggcttattcggaccgcagcggaactctttttatcgaagagagcgaggataacaattcgtggacagcttcacattttgtcgcagtaaaaggcggagtgctgaccgcttcggggtgggtcagcctgacaaaaagatattaccggttccgttttgaaaatggaaatcaaaagcagtccgaatttgttttataccaatctgtcggtacgggcggtgatatggcgttttcatatacagacgtgatttttcatgaaaatgcagcagaggcgggcgagggaagcatcttctcagcaggcgcttggaaaaaacttctcgtcgaaatcaccggtacggctgagtcgggccatgtcgcgttttgggggagatccatctcgggaaaaaatgtgccgatcagaggaatcaggtctgatgacgggacatcagccgccggtacgtcaggcacagaagaagtgtggtcatttgatattgccggctttaaggaaatcgtcatggaaatcaagagcatttccggcgggagcctttctgtcaaaggcacggcattttcttaagaatgaagcttccgaagggaggtgagaacaatgtaagaggagggagcggaagtgcttctggatgaacaagcggtgcaaaaagaattcgcagacatcaaaggtgaacaaaaggtgcttgaacagcgggtagccgcattagagcgggtatcagaccggcaggatcagcaaatcatgacgctgaatgaaaaactgaacaaaattgacgaaaacacaacatggattaagcggaccattacaggagcgatcgtgacagcaatctgcacgggcgtcattggcggagcaatcgccatcatgtacaatctgctgcaaaagtaagggggaaaccgatatgaaattcgcggacaaaggcacggtcgtcaggacggtgcttcttttgcttgctttattgaatcaaactttgctgatgttcggcaaatcgccgctgaatattcaggaggaccaggtcagccagcttgcagatacgctgtatgccgccgggtcggccgtttttacaatcataacgactgccgccgcctggtttaaaaacaattatgttacagcaaaagggaaaaaacagcaggctttattaaaaataaacaatttatcgaaataggagagatgagaatatggtaaaaatcacacaggattttatcccggcaggaaacaataaccgcccaggctatgcaatgacaccgatttacattacggtgcacaatacagccaataccgcagtcggagctaacgccaaaagtcacgcaagctatgtgaaaaatcccgatacaccgacaagctggcatttcacagtcgatgatacggaaatttatcagcatcttccgctgaacgaaaacggctggcatgccggtgacggaaacggggacggcaaccgtaaatccatcggtattgaaatttgtgaaaacgcagacggcaacttttcacaggccgtggcaaacgcccaatggctcatccgcacattaatgacgtcgcacggcatcccgcttgcgaatgtcgttgcgcacaagcattggtcaggaaagctttgtccgagaagactgctggatacatgggatgagtttaaagcgggaatcggttctgaggaaagacagacgtataccgtccaaaaaggagatacactgtcggcgatcgcgcggaaattcggcgtcagcgtggccgatctgcagaaatggaataacatcgctgacccgaacttgattaaagtcggacaagtgctgatcgtcagcccgccggttgaagcactgtattctcttccggacgaggtgatcaagctgacagagccgtacacgtccggtgaaaaggtataccaggtgcagaacgcgctcgccgcgctttatttctatcctgaaaaaggagctgtcaataacggcattgacggtatctacggtccgaaaacggcagatgccgtggcccgcttccaatctgtaaacggactgacgtctgacggcgtctacggtcccgctgtaaaagcgaaaattctgatgcagctttaacaaaaaaagctgagtcccgttcacattgcgggattcagccttttttcttttttaaccggttcaataacccgagattcctcgcccgcatcctcagcgaataagcggaaagcccgaagcgtccgtaatccacaaactttacgcgtctgacaattttcttcacatcatcacctgtcgcatctctttgttggttttattatatgaaagatatggaaaaaaggaataaggacaagagccgtgtctcctgtccttagtgtaatcaagcttttttttgtttatacttgtcaatcagccgctcgttttctttgaaaattctggcggtatgagggctgacctggtaacttgcgatacttgtcattgaacgttttttaaacattttgaacggtttcgctctttgttccggctgcccgttttgaaatgcctgctccatttaaccgtcaccttcctcttctattggcagcattaaatcataaatgctcgttagcgatgtgaaaagcaaataatcgaattccgtcaacaggttttccgacgtgagtttgatcacgtaatggcggtcctggactgtaaacggaataagcacaagcctgcctttttgatcatagtagacgtctttacggttaagacgggactgaacgtccgccgcatcaggcatatgctccgtcaagcggtccttatccgattgtgcggaatagtcgcacaaggaagccgtgacattcattttttctccataagcggccagcagtctgctgatgccttccgcataagcttctgtacttccataatatacatggatcggttcatttttcaacagatattgataggttttcagtttttcaagataggagtgaagcatttcgttattttcttctaaaatttcccgcgtatccgtctctaattcattgccggcgagctttttgatatacgcgctcaaaaagataaacgcatcaataagggcaaagcagacggcaacaatcaaatattgtctccatgcggcaaagagcgattcgggatcatatgtccaatagaccatggcgcctactacaaatagtaaataccacgttttacggatggcaaacattttttcttttacctttgcttcataccgccaggatgcgtacacatataaaatgagtgcggccgccatcgtccacaccatgatctgaaaaaacaaaagcatgagcatccctcacaattcgaaaaatggtctgctatgttcattctatgtcatgacatcattttcctgtcacaaaaaaaaccgcttctgtaaagaagcggatgtcatcagaaaaagagatctaagatgaaaaaggcgatggcgccgagtgtacctgcaatcggcagggtgatgacccatgtaataagcatccgtttagccgttccccagtttacgccttttacgcggtgggaagcgcccacaccgagaatggaagacgaaatgacgtgcgtcgtgctgacagggagatgaataaacgtggccccgaaaataatggctgcgccggttaagtcggcagatacgccgtttaccggacggattttcataatttttccgccgacggttttaatgattttccagccgccgatggatgtgccgagacccattgccagggcgcaagagagctgcacccaaaaaggaatggcatcacttttatgtaaattggccgtcataagcgccatcgtaatgatacccatcgctttttgcgcgtcgtttgttccgtgtgtataggattgaatggcagccgtcaaaatctgcactctgcggaagcgtttatttgttttcgccagattgctgtctttaaaaatcagcttcacgatcgaatatacgataaagccgagaacaaaggcgataatcggcgataaaataagtgcttcgataatcttaatgaaccctttataattaagcgtcgcaaaacctgacgctgcaatggccgctccggcgatcgctccgataatcgcatgtgaagagctgctcggaatgccgaaataccatgtgatcaagttccaggcgattgcggcgagtagagccgccagaatgacaactgacccgttgtctaatgtataaggattcacaatgtccttcgtaatggttttcgccacaccggtaaatgtcatcgctccgagaaagttcatgatggcggccatgacgattgcgtgccgcggcttcagcgcttttgtcgaaactgaggtggcgattgcgtttgcggtatcgtgaaatccgttaatgaagtcaaataccaaagcgcatatgacaattaatatcgttaaaagtaatagagtatccattataacccctcgttacgcgtttttcataataatggtttcaaggttattggcaacgctttggcaagagtcggcaatttcctcaagcgtttcgtaaatctcgcggtactgaatcactttaatcggatcggtttctgtgccgaacagattttttaatgatttacggtgcaggttatcacagctgtgctcgtattccttaattttaatggcgtgagggtgaatgtccttcaatcggttttctgcaagcagctcaatcgtgattaaaatttccttcgcgcactctctgatgtatccgctgaacttatcgatatgctcatctgaagaagtgatcgagaaaatctccatcattgctgaaaaatgttcgattccgtcaagcacgtcatcgaggctgtttgtcagctcaaggatgtcttcacgttcaatgggagtgataaaagctttgttcagctctttaatcatgacatgaacatgattatctccttttgtttcaaactcttttaacgtatcggcaaattcctttaaagtcgtctggttcgtcactttaaagttgacaaagtattctgcggtttcgtctatgttttttgcgatttctgttaaaaggagtgagaacttatctttttttctttttatcattaaaaaccctccattgtttgaatgagacaatgcacacatcaaattattatatagccttttgtcgaaaaaaaacagataaagtcgaaaaaaacgcctcttgattttttcgtaaaaacgtgtctcatcctgtttttcttatgttacccacttcgccaaaaaaacgtaacatacttcgaattcagacatcttgcttaaaaagtataacaaaagatgtgaatttgctgtcaacttttgcacgtgattttgccagaaaaaaaacggctcccgtaaaaggaaccgtttttgtcagttttttctgccgtttttcagccaaaaataaagcggcagcccggcgaggccgatcaagagggacagcgcgcagctcagtgtatctgtaatgatcgtgctgatcagcacaaacagtgaacccgcgatggccaaaacaggaatgatcggatacaaaggcacgctgtaggcgcgcggttttccgccgcttttttttctgaggataaacacggcgaaaaaagccatgacgtaaaaaatataaatcatgaaaatagagatctcagacagcttatcgggattgctggcgatcatgaaaataatggccagcgcgatctgaaatgacacggcaatccacggggtgcggaatgtcggatgcacccgcgaaatctgtccggcaaacggcagctgtttccgttccgccatcgcaaacgagacacgcggaaaagcgagaatctttccgtttaaacagccgaagatgctgacgatgattccgacgctgatcaattttcccccgatgtcgccaaacagcattccggcagcggtgccggtcgcattttcaccgagtttgacgatgtcggtcgcaggaagaatgtgcagcagcgcaaagttaatgaaaagataaatggcggtgacgaccaagagtccgcccgtcatcgctcttgggagcagcttttccggatttttcatttcgccgccgagtgccgcaagcagaatccatccgtcataagcaaacaaggtggccagtatggcggcgccgaaattcatttccgacatgctgcttgtgacggctgtgaaaatatgctgatcgcctttccaaaggccgaacacgatcatgcagataatcggaatcaatttgccgacagtcgtaattccctgtacgatgccgccatatttcgttccgataatgttaatgatgcttaaaaataaaacggctgaaatcccgattaatttagaccagccggaatcccaattgaacaagtgcgccatcaaagagccgaaatacaagccgattgctccgataatggcggggccgtaaatgataatttgaacccatccgcacaaaaagccccaaaattcgccgtacacttcttccagatatgtataaagtccgcccgttttcggaatctgagtgccgatttccgcaacggtcaagccgccggcaagcgtcaaaatgcctcctaacagccacgcgataagcgcggttttcgcatcaccggagtaggcaagcacggcgcctggtttcataaatacgccggaaccgatgatggtgccgataacaagtgagagggcgatggtaaggccgatctcttttttaagtccattctcttcaatctgcatatcctttccctccagatgtaaaatcgttatgctgaaaaaactattttccatattgtaaaccctaattgctgaaacacgaataaaataaattttctgattttggtgttttgcctaaaagataaaggtttatgcttttgagaaggaaaaaatactgttttaaaagcgaacattaatggttttttaatatcaaaagttcgttattttgagagcggcagtctgcagaccgtctgtgaagcagatgggttgactttacgatccggataacataaattgtatatataaaatatctcgaaatcgagataattgactggaggataacataatgaaagttaatggaatacaccatgtatcagcattgacggctgatgcgcagaaaaatttagatttttatcgaaatatcctggggctgaagcttgtgaaaaaatcggtaaaccaggatgaaccgacgatgtatcacttattttacggtgatgaatcagccaatccgggatcggaattgacgtttttcgagattccgcggatcgcgccgttccatgcggggacaaacagtatttcttcaatcggcctgcgtgttccggatgcacaagcgcttcaatattggaaaaaacgatttgaagagcatcaggtctctcacggtgagatcgtgaaaatagcgggcagggacacactcgcttttcaggatcatgaaggacagcggcttgtgctgacagctgacgaaaaaggaaaagacatcggtgaagcggtgaagcaaagcggcataccggaagaatattctttccgcggtcttgggcccgttgaattgaccgtcccgtatgcagaaccgacgctgcgtgtgttaaccgatgtgctgggcttcactgaaatcgggaaagaaacacatgaagaccggggcgcggttacggtgctcgaatccggaaacggtggcgcgcgtacagaagtccatctcattgaaagaaacgatcttccgcgcgagcgtcctggaaaaggcagcgtgcaccatgtggccttccgtgttcagaatgaggaggagcttgctttatggcaccgcatcattacgaaagaaggtttcagcaactcaggcattgtagagcgttattatttcaaagcgctgtacttccgggaaccgaacggaattctgtttgaattgtcaacggacggtccgggatttatggttgatgaaaaacctgaagagctaggcaaaacggttgcgctcccgccttatctcgaacaccgccgttctgaaatagaagcgcggctgaaaccgattcagtaaatcagaagtaatgaaagatgccttccggcttgacgggggcatctttttttttgcttttttacccgttttgtcattctttttacctatttgtaaacggcaaaataaatgtctttgtttattaataaatttttcacatttggttgttacacttgttcaaagttaaacaaaaggagtgaaaacacaggtgaaaatgaaaaaacgcgagatagacgcagtcttaatccttattttactcgcttccgcattcttgaatatgtacaacatctggaatgacgatacggtgaatccttattacaccgcagcggtaacgagtatgcttcaaagctttcataatttcttttacgcttcatttgacgcagccggatttatcacggtagataaaccgcctgttacataccagattcaaacgatcagcgcgctgatattcggtatgcacgggtggagtgtcatcctgcctcaggcattggcgggggtaggttcagttctattcatgtacttattaataaagccgacgttcggaaaaacggcggcgcgcatcgcttcgtttgtcatggcgtgtacaccgattgctgtagccgtagcgcgcacaaacaatgtcgatgctttactggtctttttcctcttgttcgccacatggcttctctttaaagcgattcgaaaaggaaaactgatctggcttttggcggcattttttgtcgtcggagtaggctttaacacaaaaatgcttcaggcttatatgatcttaccggccttcttgctgttctatatgatggcggcaaataccgcgattaagaaaaaaatcatttcactggtaagcgcgctggccgtattagcagccgtttcattgtcatggccgctcattgttgacaatattcctgccggcaaaaggccatatgtcggaagcagccagacaaactccgtattggaattggctttcggatataacgggattcagcggctgacggggcaaagttccggcggcggccagggcgggcccgacggaaacgcatcgaaagggatgtcttcttccggcggttcttcacaaatgcaaaaaccggccggccagtcagcaagcggagacaaatcacaaaccggcagtatgacggcacctccatctaacggacaaatgccaagcggcggtcaaggaggccctccaagcggcggagacggcggcaaaggcggtcctggcggaggaaaaagcggtacaggcaccggctcgaaaatgcagtcagggtcaggaatgttcggtacgggaacacccggtccgctgagactcttccaacaagaattatctgatcagatcagctggctcctgccgtttgcgatttttggattggccggtttattgatcgccggggcgagagaaagaagaagattatcagcagaacagaaggaaacgatcttttgggcagcgtggcttgtgccgattgccggattcttcagtgtggcggaatttttccaccattattatctcattatgctggcgcctccgattgctgctcttaccggtgcgggatgggtcgccctcgttcatctgtaccgcaagcaggcgggatggaaaacttggctattgccggccgctattcttgtgactaccggatttgagctgtttatccttaaaaactacaatgatcaaatcggcgcaggctggagcatcggagcaggcgttctcggtgcagtggcggcaatcgccctgttcgtattcaaacagcgccaaaaaccgctcagttactatgtttcacttgcagcccttctcgtcttgatggtgatgccgatttattgggcgagcacaccgcttctgtacggaggcaacagctcattgcctgaaacaggccctcagcttgcgtcagcaggcggaaaaggcatgggaatggataacgcatctgtcaatacaaaactgatcaactatttagagaaacataacgccggagcggattatctatttgctgcaaccgattccaacacagcggcgccttacattataaaaacgaaaaaagcggtcatggcgatcggcggattcagcgggtctgacccggccattacgctgactcaatttaaaaagctcgtaaaagaagggaaagtaaaatacttcttaacatccggaatgggcaaaggcggaaacaacgatattgttgaatgggttgagaaaaccggaaagaaagtatcttcatacaaatggcaatcaagcacagatcagaaaacgaaaaatcatgatgcagctgatacaaaaagcagcaaggccgcgggtaaaaacagccgaatgagcggcgggccgggcggaatgaatcagtcagcttcactatacgaacttcaatctgatgaataggaggaaaaaacatgagcagacatattcaatattcaatagtcgtcccggtttataacgaggaactcgtcattcagacaacctatcagcgcctgaaagaagtcatggatcaaacaaaagagcattatgaattgatctttgtcaatgatgggagcaaagaccgcagtattgagattttaagagagcaaagtctgattgatccgagagtgaaaattattgatttttccagaaacttcggacatcagatcgcgatcacagcgggtatggattatgcagaggggaatgcaatcgccgtcattgacgccgatttgcaggaccctcctgaattaatccttgatatgattgagcagtggaaagaaggctacgatgtggtgtacgccgtcagaacgaaacgaaagggagaaacctttttcaagaaacagacggcttctctgttttaccggctgctgcggagcgtgactgatattgatattccgctcgacaccggggatttccgcctgctggacagaaaagtctgtgatgagatgaaaagattaaaagaaaaaaatccttttgtcagaggactcgtcagctgggtcggctttaagcagactgctgtagaatatgaacgagatgagcggcttgcgggggaaacgaaatacccgcttaaaaaaatgctgaagctttccatggacgggatcacaacgttctctcataaaccgctcaaggcggcaagctatgcgggaatgctcatgtccggagcgggttttctctatatgtttatcgttttatacatgaagctttttacagacagcaccattacgggctggtcctctctgattgtgatacagctgttattcagcggcatcgttctattaatgctcggaatgatcggcgaatatatcggaagaatttatgacgaagcaaaagatcgtccgctctatatcgtgcaaaaagcgtacggtatgaaaaacgaaaagatttatcgggaccagcatatgtcttaacaaacaccctgtccggccagcggacagggtgcttttatgtaaaataaaagccgcgggatgacagaatgtcccgcggctttttttattcatctgcggccggtctgggtgtgcagagagcgcatgatcagtccggttcacgaaaaatttcagtaaaatgcttgcaccaagcgtcattccccaagcagcgttttgctgaggaagctgaatgctcagctgcagcaagatcaggccggtaacgaccagcaaaagtccggtttgtttcatgtgtatgtatcctcctttgtacactgagtcatacggctgatccaggcctaaagtttcatctgtatataaaaaatccaaggcggctgccttggatttttgttaagaagatgtttcttctttttgagtcagtttcatttttttcgtcatttccttgccatttctgataattttcacgtcaacggtgctgccgactttcgtatttttgtagagaatattgcgaagttcgctgcccgtgtcagtttctttcccttttaagctgataatgatgtcttctgcttttaatccggctttggctgcaggtgatccctgcgccacttcacgaatataaacgcctttattcagctgtttgccgaagaggccgagtgtgccttcctgatagttttgcggcacttgttccaagtcgatcatgctcacgccgatataagggcgctccacctgtcctttcgtgagaagctcttcggcaatcggttttacatcgttgctcggaatcgcaaagccgatgccttctacatcattttcactgattttcatgctgttgatgccgatgattttgccttctgtattcaagagcggtccgccgctgtttccgggattgatggcggcatcggtttggatgacgttgatgcttgactcaccggctgacgtagagatcgagacggttctgtttaagccgctcacgatgccctgtgtgacggtgcgggaaaggtcttttccgagcggatcaccgatggcgatgacggattcacccgttctgagagcggatgaactgccgaagcttgccgtttttgttacgtgtttatcactgatttctaatacggccaagtccgtcagcgaatcacggccgacgagtttagctgttacatcggtgccgtcatataatgacactttaagggaagaggcgccttcgaccacgtggttattcgtaatgatatacgctttgccgtttgctttcttaaaaataacgcctgaacccgatcccgtttccgcatcatcacccgatgcattagagtttgaatccgagcttgatccgaatccgaataaatcggaactgctttgctgcttctgcagattggtgattccgacgatcgccggtgaaatgtcttccaccatattcgaaatgctgcttgaatttgccgatgagctgtttgccgatttgccgctgtctgattcaaaagatgtctgcttggcggttaccgatgacgtttcctgagcgggagccggattggaagtatcttgagtctgatggtctccaagcggcgtaaatgtatagatgccgagggcgagccctccgccgatcactccgccgagaagcggtctgaaccagccgaagcttcgttttttcttgtcctcgtccggctcggaatatccggccggctgcgggttttcttttactaaaaggacttcctgttctttttggtctgtccgattttcatcacgatagttatccatcatgttcactccgtttctctatttcatcatagcatgatttgcctattattactgactccatcttaaacaaaaagtgtgggataataatgaaaagattgtgggaaattgtgaaaaagacgaaatcggacggcggcgctttatattgacaatttccatcggatttgaaataataaatgggatattatgttcaatccttcacatgaaaagatataaaaaattctgtcaagctaatgggggaaatctgttagctttttcactttgtcaaatagttaagaaaggagctgtcaaatgaaagaaaaacatcactggatcatttctctgcttgctgtgctggctgtcgggccggggctgatgtcgaataccgctctttcggctgtccaaagccttgtccggcagacggtcggcggggaaaactttgactcttttcatccgattattatcggtaatatggcatttgccttattcgtgccggcggggccgtatttaagaaaaagattcggctcccggcctgtctatatgatttcgatggccgcgggtgtcatcggagcgctgcttgctgctgtgacaaatgatatttatccgctcgccgcgggccgttttttacagggagctgcggcgggcactatgctgatgattatgattccgatgctggtgctttcgtttccgattgaacgccggaattacgccttatttgtgttaatcggcggattttacgggtccgtcattatggggaccgttttaggcacggcggcggcaagcgccggccattggcattggctgttcggcatttttggcctgctgtcttttttcggcctcattttcagttatatgtggctgcgggatgacgctcataaaaatactgaaaaatctccatttgacggcatcggttttctgttagcgggtggatcagccgtgctgaccgcctatacttttattcatctgccgaaatggggcttttcatcatggcagacattggcgggatttggaggaagcatcgtcattctgctgatcctgctgattatgcagtacagaaacgaacatgcgctgatttcgattaaacttatgctgattccaaagccgattttgggtgttttcatgatcgctgcgggcagtatttccatagcggtcagtctttctgcatttcacggggagcttcagaccgcatatcacatgtcacaaactcaactgatattcttatatgcgagccttttgggaggcgtggccatcgccgctgttatcagtgcattagcatatgataaagtcggtccgggcatgctcggcataacaggctctgttatactggtgttcgtgaatttccaatggatgacggcgggtcatcatataccgtttattctatttgcggcgcttttcgtgatgctggcggccgggacagggcttatcgtagcagccggactgatgggcgccgcgttgggcggaccgcttccggaactggtgaaacgcatgacggccgttcagtttttaaggctgttcatttatatgggcgcacctgttttaatagggtattttacgaaaagagatgcttccggcatgcttcggggcgcgcgcggcacacaatcgccgcatgacctgctgatggggacatacagcgatttgtttcttattgctttcatcttaagcttgcttttagtgtgtttatcatttgtcatgaatgcgaccggcatgggacataagctggcgcataaaccgcatgccgtccgtaagcaggcggatgaaaagccttcgccgcaggctcctggaccgatcaggcatcaggtcattcccgatcgcgaatacagaagtgcggtcagacagtttcggggtcaccctataaacaaaaacggtatgtaactttttctatcagcaaacccttttcccggtgaaaagggtttgttttttcccataatggcagaatggtatattgcatgtttcatccttttttaatataatttgttagaatattcataatttaatatcgaaattttaaataaaaaaggaggcattacatgaaactgtatctatctgtggatatggaagggatttccggactgcctgatgaaacatttgtcaattccagcatgcacaattatgagcgcggcagggttctgatgaccgaagaagcaaactggtgcatcgcagaagcgtttaataacggatgcacggaagtgaccgtgaatgacagccactcaaagatgaataatctgctcgcggaaaaacttcaccctgaggcagagctgattacgggggatgtcaagccgttttccatgatgcaggggcttgatgaatcgtattcaggtgtgatgtttatcggctatcatgcgagagcgtcgatgccgggcgtcatgtcgcacagcatgatattcggcgtccgccacttttacataaatgataagcctgtcggtgaactggggttaaatgcctatctcgccggattttacgatgtcccggtcatcatggctgccggagatgattgcgccgcaaaagaggcggaggagctgatcccgaatgtgacgactgccgccgtcaaacaaaccatttcaagaaccgcggtcaaatgcctgtcccctcaaaaagccggacggctcctgacggaaaaaacagcctatgcgctcaaaaataaagataaggtcaaaccgctgactccgcctgaaaaacctgtattaggcattgaatttgccaattacggacaggctgaatgggcccatttaatgccgggcacagaaatcatcccgggaacgacaatcgttcaatttcaggcaaaagacatgccggaagcctatcaggccatgctcgtcatgacagaactcgctatgagaacaacattctgttaaaggggtgaacggcattgctgcggtattttatcaaacgttttatcgccatgattatgaccgtcctcgtcatcaccactctgacatttgtcatgatgaaagtgatacccggctcgccttttaacgaagagcggggcacaaacgaagcggtccagcgaaatcttgaatcctactaccatctgaacgaacctcttatcactcaatacgccatctatctaaaatccattcttacctttgatttcggtccttcaatcaaaaaaccgtcagacagtgtaaacgccatgcttgaacgcggatttcccgtctccttcgagcttgggataacggcgatcatcatcgctgtgatttccggactcgcgctcggcataacggccgctctcaggcgcggcggctttctcgattatgcggccatgagccttgcggtgctcgggatttccattccgaattttataatggctacgctgctgattcagcaatttgcggttcatctgaaatggtttccggcagctacctggacgagtcccgttcacatggttctgccgactgttgcgcttgccgtcggtcccatggccattatcgcgcggctgacaagatcaagcatggccgaagtgctgactcaggattacatccgcacggcaaaagcaaaggggctttctcccgtcaaaattgtgatcaaacacgcattgaaaaacgcacttatgcctgttgtgacagtactcgggacgcttgccgcaagtattttaacgggcagtttcgtcatcgagaaaatttttgccataccgggaatgggcaaatatttcgtagaaagcatcaatcagcgcgattacccggtcatcatgggaacgaccgtattttacagtgtgattctgatcgtcctgctgtttctggttgatttggcatacggcctgttagacccgcgcataaaacttcataagaaagggtgatcctgatgaatctcccgcaagaaacggtaaaacacacagaagtgcctgatgactggtttcagccgggcgcggaaagaaagggtgaaaccgagtcggtcaagcgtccgagcctgtcttacagtcaggatgcgtggcggcggcttaaaaagaacaaattggcgatggccggacttgtgatattatgctgcctgtttctatcggctgtgttcggcccgctgatatcaccgcacagcgtgacaaggcagacgctcgccgagcagaatcttccgccttctttttcacactggttcggaaccgatgaacttggccgggacgtgtttacaagaacgtggtacggagcgaggatctctttatttgtcggtgtgatggcggcgctgatcgactttttgatcggcgttatctacggaggcgtcgcgggctacaaagggggccggacagacagcgccatgatgagaatcatcgaggttctctacggtttgccttatctgctcgttgtcattttgttaatggtgctgatggggccggggctcagttccattatcgtcgctctgacagtgacgggatgggtcggcatggcgcggattgtgagagggcaggtgctgaggatgaagcatgatgaacacgtattggcatcgaaaacgtttggagcgaaaacatttcggatcattaagaaaaatctgctgccgaatacgatgggagccattattgtccaaatgacgctgacggtgccggcggcgatttttgcggaatcatttttaagttttctcggactcggcattcaggcgccgtttgcaagctggggagtcatggcaaatgacgggctgccggcgattttatcaggccattggtggcggctgttttttcccgcttttttcatttccttaacgatgtacgcgtttaacgtgcttggagacggcttgcaggacgcgttagacccgaaactgaggaggtaggaaaaatggcgcagcaagttctttccgttcaaaatctgcatgttactttttcaacatacggaggcactgtaaaagccgtaagaggcgtcagcttcgatttatataaaggtgaaacgtttgcgatcgtcggtgaatcgggatgcggaaaaagcgtgacgtcacaagccgtgatgggtcttcttccgaaacattcggcaaagattgaatccggaagcatacaatttaaacagaaagacctttgccgaatgtcggatcgggaaatgcggggaatccgggggagcgatatttctatgatttttcaggacccgatgacggcgctcaatccgactttgaccataggggatcagctctcagaagcgctgttggaacaccgcgccatgacaagaaaacaagctgaatccgaggttctcgccatgctggatctggtcggtatcccggactcgaaatcccgcctgaagcagtacccccaccaattaagcgggggcatgcggcagcggatcgtgatcgcgatggctctgatctgcgagccggaaattatgatcgccgatgaaccgacaacggctcttgatgtgacaattcaagcacaaatccttgaattatttaagaagattcaaagaaaaacaggcgtgtctattattctgatcacccacgatctcggcgtcgtcgctcagaccgccgacagagtcgccgttatgtatgcggggaaaatcgccgaaatcggcacgaggcatgatattttttaccgtccggctcatccatacacaaaggggctgcttcgttcagtgccgcggctggatatggaagatagtgagctttcgccgattgacgggacgccgcctgatttattcgatccgccgccgggctgcccgtttgccgcccgctgcccggacaggatgatcgtctgtgaaaaggtatacccggcaacaaccgtgaaatccaaaagccgtatcgtcagctgctggcttcaggatcaccgtgcagagcggctgaagcagcagctgactgcagcagaggaaaaagggggattgaaatgaaaaagagatgggcgattggtgtgattgctgttgtttcgtttgctctgatgggctgtacagccaatgaacaggcggggacagaacccggcaaagcaaaagaacaggggggagagacggtgctgcggctcaataacgaaaatgagccgacctcacttgatccgccgatcggatttaataatgtttcctggcagccgctgaataacatcatggaaggattgacgaggctcggaaaagataataagcccgaaccggccatggcggaaagctggaaggtgtccgctgataagctgacatataccttcaatatccgagataacgccgaatggacaaatggcgatcccgtcacggcggaagacttcgtgtacgcctggaagcggatgctcgatccgaaaacgggcgcatcttccgcttttctcggctatatgatcaaaggcggagaagaatttaacagcggaaaaggcaaaaaagaagacgtgaaagtcacggcaaaggataaaaaaacgcttgtcgtcacattggcggccccgcaggattattttttgagcgtcgtgtccaatccggcgtatttcccgattaatgagaaggtcgccaaggctgatgcgaaatggttcactgaagcaaaaacttttgtcggcaacgggccgttcaaactgacggaatggaagcatgacgacagcatgacgatggtcaaaaacgagacgtattgggataaaaagacggtgaaactggataaagtgacatgggcgatggtcagtgaccggaataccgactatcagatgttccagtcgggggatttggataccgcctttgtgccggcagagctgagcgagcagctgatgggaggaaaaaatgtccgcacgtgggatcaggccggactctatttctatcgttttaacgttaaaatggagccgtttcaaaatgaaaagatcagaaaagcgttcgcggcagcgattgatcagaaagaaatcacggattatgtgaccaaaaacagtgaaaagccggcacatgcctttgtatccccgggatttactcagcctgacgggaaagatttccgcgaagcgggcggcagtttactaactccggatgaatcagaagccaaaaaactgctggaaaaaggcatggcagaagagcattatgacaagctgcccgccgttacattgacatacagcacaaaaccggagcataagaaaatagcggaagcgattcagcagaagctcaaaagtgtgctcggtatagacgttaagctcgccaatatggaatggaacgtctttttagaagagcagaaaggactgaagttccagttctctcaaagctcatttttaccggattacgcagatccgatcagttttcttgaggctttccaaacggataattccatgaaccgcaccggctggggaagcgcggcatacgacggctgcatcaagcaggcaaaacaggaagccgatgccaaaaaacgttttgcgctcatgcataaagcggaaaagctgctcatgaacgaggctccgatcattccgatttacttttacaatcaggtgcatctgcagaacagcggcgtgaagggcattgtccggcaccccgtcggttacattgatctgaaatgggcggaaaagtcctgatcttacagcggaaacatatgccgctcttttgccgttaaaggagcggcgtgtttcacttttcaatccggaaaggagattgaaaaagtcatgaaccataaaccgaaagcactgcaaaaaggcgacacggtcggtgtgattgcacccgcaagcccgcctgagagcgggacgctgcaaaccgcgctgctgtttttagagaatgagcttggccttcaagtgaaactcggccgggcgctgaagacccgtcacggctatttggcgggagaagaccgggcgcgcctcaatgatctccatgacatgtttagtgatcagaatgtcaaagcggtgatatgcgcgtgcggaggattcggcacgggccgcattgccgccgacatcgatttcggcttaatccgccgcaatccgaaaattttctggggatacagcgatattacgtttttacataccgccattcatcaaaatacggggctcgtcacatttcacggcccgatgctgagcacggatgtcgggcttgaagatgctgaacccctgacaaaagcgtcgtatcatcagctttttacagaaacggaattcacctatacggaggacatttctccgctggaggtgctgacaggcggaagggccgagggagagcttgcgggcggcaatctgtcgctcattacgtccacactcggcacgccgtttgaaattgatacgaaagacaaattgctgtttatcgaggatattgatgaggagccgtatcaaatcgacaggatgctgaatcaattaaagatggccggaaaactgtcagacgcagccggaatactggtctgtgattttcaccaatgcgaaccgaagcataaagaaaagtcgcttactttagagcaagtgctgaacgattacattgtcaaatcagggaagcccgcgctcaaaggctttaaaatcggccattgttcaccgagcttcgccgttccgatcggagcccgcgcggttatggatacggcggccaaagcggtaacgattgaatcgggggtttccggaagggagtgatcaggcgtgaggattacagatattcaaacgggacggatgtccgtgccgctgaaaaagccgtttaagaccgctttgcgcacggtttacaatgctgaatcggtcattgtgaagctcacatttgacaacggtctgaccggctggggcgaggcgccgccgacggttgtcattacaggcgacagcacggacggtattgaaagcgccgtccgcgatgtgctgaagcccgctctcttggggcggagcctttccggcatagaagctgttttgtatgatatcagccggctgttggaaagaaatcaaagcgcaaaagccgcggtggatatggctgtatatgacggatgggcgcaaatgcacggacagccgctttaccggcttctcggaggctatcggaatacactggaaacagattttaccgtcagcgtcaattctcctgaggagatggcgggggatgcagaccgctatgtgaacaaaggatttcatattttaaagataaaagtcggcataggtgacatatcggacgatgttgcccggattcaggcgatcagatcacgtgtcggcggaaacgtcaaactgagattggacgccaaccaaggctggacgccgaaagaagccgtgactgcgatccgaaagatggaagacgccggcctcggcattgagctggtcgagcagcctgttcataaagacgatatcgccgggctgaagcaggtcaccgatgccgtagacacgccgattatggcggatgagagcgtctttactccccgtcaggccttttgcgtgctgcagacgagaagcgccgatttaatcaatattaagctgatgaaagcgggcggcataaagcaggcggaaacaatcaatgcgatggccgaaacgtgcggcgtggaatgcatggtcggcagcatgattgagaccaagctcggcatcaccgccgcggctcattttgccgcgggcaaacggaatgtgacaaggtttgattttgatgcgccgcttatgctgaaagatgatttgattaaaggcggcatcacatacagcggcagtcagattacgattcccgatgaaccgggtctcggcattaccggggtgtcgaaacaagaggaggcgaaaagatgagagcagccgttacagcggcggcagccaacgtatggacgatgccgtcatctccccgttcgtatgatgcgccgatgcttgaaaacccgccgcagatcagaaaatggttagcgtctatgggatatgaagagcggctgcaattatgcacagacaaccttgtccaaacgcaagcgcttttcggggaagaggtgatcattctcaaagaggaaggggaatgggcttttgtcgccgttcccggccagccctcaaacaaggatgcgcgcggatatccgggctggataaaaaaaagccagctttcaaaagacggctttttttcatcttcgcccgccgtatggattaccaaaccgacagcttttttatatcacactaacggcgaaccggacttggaagtaagtttcttaacgcgtcttccggcatcaggacgtgagaaaggcttttttcgggttgtgacgcctctcggagaacggttcgtaaatgaagctgacgcagacgagtgccggcatacggaaggacgggcggccgaggtcatcgaaacgggcatgatgtttctcgggcttccgtacttatggggaggactgagcggtttcgggtttgactgttccgggtttatgtattcgatatttaaagcaaacggctatacccttccccgtgatgcaaaggaccaagcaaaagccgggtgcggcgcggcggtaaacgatatccggccggctgaccttttgtttttcgcctatgaagaaggaaaaggcgcgattcaccatgtcggtttggcgctgggagacggccgaatgctgcactccccgaaaacgggaaaaacaatcgaagtgctgtccttggaaggaacgatctatgaaaaagaattatgcaccgtacgccgctgtataagcgaaaagggggaatagaaaatgacggcatctccgctccttgaagtcagcgggctgaaaatgcattttgacgcaggaagaaagaaagccgtaaaagcagtcgacggtgtcagctttcacattaaaagaggggaaacattcggacttgtcggagaatcgggatgcggtaaatcgacgctcggaagagttattctccgtctgtatgacccgacggccggttcggtatcatatgaagggacggatatacaccgtgccgcggccgaacagcggtcggtcttcttccgcaagctgcagatgattttccaagacccttacgcctcgttaaatccgcgtctgaccgtaagggaaattattatggagccgatggaaatccacaatctttacaatacaagaaaagcccgtatgatgatggcggatgaactgcttgaagctgtcgggctccatccggatttcggcagccggtatccccacgaattcagcggcggacagaggcaaagaatcgggattgccagagcgctctctctgcatcccgaatttatcgtggcggatgagccgatttccgcgctggatgtgtcggtacaggctcaggtcgtcaacctattaaaaaggcttcagaaagagaaagggctgacatttttatttatcgcccacgatttatcaatggtcaagcatatcagcgaccggatcggcgtgatgtatttgggccgcatgatggaaattacagaaagcgctgcgctttaccgggaaccgcttcacccttatacgaaggcgcttttatcctcaatcccgattcctgatccgcttcttgaggacaagcgtgaacggattattctgaaaggggagctgccgagcccccttaacccgccgagcggctgtgtattcaggacgcggtgccctgaagcgatggagctctgcggtaagataacgcctgagcttgaagaagtgaaggcggggcgttttgtcgcctgccatttatacaaaaaagaaagctgacaatataaagtcagctttctttttgattaaatctgatgcagaaatgacacgcagaccggatacggaaccggaatgtcggattgaagcagagtcaatttgcctgtttccggatcacgttcaaacaaaaccagatttcccgtttcttcgtttgacgcgacaaggaatgtctcggaagggtcaaacgcgaaatcacgcggccagttgccttctgtcggcacccattcaataagagacaattcaccggaatattggttgatcttaaagatggcgatgctgtcatgtccgcggttggcggcataaagaaatctgccgtctttagatatgcggattgcgctgccttgcgatttgtccgtaaagccttcaggcaaagcggaaatgacctgcagctctctgaattcacctaaggtcgggttgtattcaagcgcgatgacttcattgctgatttccgtcatgacataggcgtatttttccgccggatggaaaacgatgtggcgcggccctgaacccggtgcgaaagagtgagttttcacctctgtgagcgaaccgtttttcatttggtacgtatacagcgtatccgtccctaaatcgacggctgcaatgtagttatgctcaggtgtatagccagcgaaatgggtatgcggtttctcttgtctttcatgaggacctgttcccgtatgagcggcttcggcagccggctcctgcagacttccgtcctcattgacgggaaaggcgtgcacttttccgctgtggtaattagcggttaacacatattcatgtttatcatcaatgctgacgtggcatggagacgggccttcaatcagctggtggtttacaaacgttaattccccgctgttctgatgaatctgataggctgcgacgccgccttttccgtctgctttttcaatggaatacagcatgctgttatcagaattcggagtgacgtatgtcgggttgccgagctttgctgccagcttcggccggctgagccttttcgcttctgtatcaagttcaaaacaataaatgccttcgcttccgccttttgtatatgttcccgcgtatcctatgtacttagccattcggtttccccctttagagtcttgtcttctctatattaacgtatcttgaaggaaactgccttgtaaatgtttaagatgttctggcaagcggcaaggtgcagcagcggaaggaaccgcctgatttgataatttcggaaaactcggtttcaatgaccgtataacccctttttctgagctcgcggttcgtatgacggtgctgcggcaggctgataattgtctgattgccgattgacaggatattcgggccgagcgtgaattgctcttcttcaggcacttctatcatctcaaaacgttcggcgagaagatcaatttctttctgccgcaagccatttttacagtatagcgcttccgtttccgagatcatattaaatacacagtccaaatgtaagaaatcctccttgagagggatcggcacaacagtcatctccggcagcgcctcccgcagctcccggacagccgctttatccgtacgcttgctcagcccggcgtaaacggtgccgtctgcgatcaagatgtcgccgccttcaatgttcgcttttttcagtcgcgtataagggattttcttatcgtcaagcaggtcttgaaacactttttcttctccctgccggactgaagccgccatgtttgaaataaacgctgtctcgcctaagacaaatccgatatcccgggtgaatacctgctcaggcaaagcgggatcggcaggcagcaggacgacttcaatctgatgagatcttaaaatgtcaataaactcactatgctgtttgagggcaacgggtatgttaatattttcttgtttgaaatgtttctgcgttccgttaataatatccttgatggtcatgtgttccggccggcataagatgactgtctgcaaagcatcaaactcactgcggcaagccggtttccgcgtggatttgggtatggatacgtccatgtgatatcctcctatcggtattcaatgtgcgtttattattcccggatgtgataaataatgaaacatttctgatagaatatctaaccaacttaatatttaaaattttagacaaaacgatcaaagtattgtttaatagggtacagatgaaatgtcaaaacgaccagacaccaaaggggagtttaaataatatgaagttgccagaatcaagattttgcaaagaaacaagggttgtcaagacaagcagggtttttccgcttgatacgaataatcacaatacgctgtttggcggaaagctgatgagctatattgatgatatcgcttcaatttccgcggcccgccactgccggtgtgaaacagtcacggcctcaatggattctgtggattttttgcgcccgatcggccaacaggattccgtatgtcttgaatcctacgtcacatgggtcggcacatcgtctatggaggtgtttgtcaaagtcattaaagaacatctgatgacgggtgaacgcgagcttgcggcaacgtcgtttctgacattcgtcgcgctcgattcaaacgggaaatcggtgcccgttccgcggatcgtgccggaaaccgaggaagaaatcatgcttcacaatacggccgttcagcgcgccggagaacgaaaaaaccgcttaaaacacagcaaggccctggccgaggcgctcggaacagataaaccttggtaatcgtcaaaccgctttttttaaaagcggtttttttatgctgaaaaaggacttttcctgccgggtccataatttattacagggaaaggagacgtggcgtgcatgatgaaacataagtcttccggcaccatcctgacaaccgggcgtatccgtctgcggactatgcgggatgacgatgaagacaatttgtacgggctgtttaccgacagagaggtcatgaaatattatccttctcttaaaagcagacgggaaacgaaggaatggattgcctggaacaaacgattggccgcaggatacggcgtcagtctttggatcgcagaggataaagtgtcgggtgcatttctcggtcaatgcggaatcgttccgcagacgataagcggaaacactttgatggaaatcggctatatgtttgcccgctgccgctggggctgcggctatgcgacagaggcggcgaacgcctgtctggactacggttttcatacgcagcaatacggacgcatagcggcgctgattgatccggaaaatgctgcctccgtccgcgtcgcggaaaaaatcggcatggtgcccggtgagaccgttaccaaatgggagaggcggctgacggtatttgacatcacatctgacgttgaacgtttcggcgaaatgtagtatgatacgaacagacatgttttctagggttccgcatgttcatacatggcctggtccgagagaaaacacatatgcggacatatcccgcatatgcacacggagggaaaaaagcccgggagagtcaatctcatgtgagacgactattccgggctttttgtattgcccggaaacagaaaggatgaagaacatgaaatggggtttagtggtcatagcggccgtatttgaagtggtatgggtcaccggcctgaaacatgctgattcggcactgacgtggggcggcacgattacgggaatcatcatcagtttttatctattaatcaaggcgacggacagcctgcccgtaggaacggtatatgcggtctttaccggactcgggacagcgggcaccgtgctcagtgaaatcctgcttttcaaagaacaggccgatccggtaaaaatcgtgctgatcggcgttttgctgatcggtgtcatcggattaaagctggtcacacaggataagcctgagacgaaggaggagaaggcgtaatgcattggatcagcctgatagccgcgggtctttgtgaaatgctcggggtcattttaatgaatcaatttcaaaaagaaaagaaagtcaagtggatttttttcattatcgtcggatttgcggcttctttttccctgctttcttatgcgatggagacgattgcgatgggcacggcctatgcgatctggaccggtatcggcacggcgggcggcgcactagccggcattcttttctacggcgagcagaaggatgcgaagcgcatctttttcattgcgcttattttgtgcgcagccgtagggctgaaaattctttcgtaaattgatttttatcaaattttcagtataatctataataagttacgaattatgaagatacgagggattaaaacagatgaattcatatatgacacagcggctgaaagaataccgccgcggtaatgaggaaaaagggcgcctgcttgtcagctgccccgatcagccgggaattgtatcggctgtttccgcgtttttgtttgaacacggcgcaaatattattgaatcaaatcaatatacgactgaccctgaaggcggacgtttttttctcaggatcgaattcgactgcaagggcattcgtgagaaaaaagaggatttacagcaggcgttcgcctcaatcgcccagacattcggcatgacatggagcctctctctggcaagtgagctgaagcgagtggcgatctttgtatccaaagagctgcactgccttcatgaactgatttgggaatggcaaagcggcaatatgatggccgaaattgcggtcgtcatcagcaaccatgaagaggcgaaagaagtggtcgagccgctgaatattccattccattacatgaaagctaacaaagatatccgcgccgaagttgagcggcgccagcttgagctgctggagcagtataagattgatgtgatcgttcttgcccgctacatgcagattttgacgtctgattttgtatctgcccatccgaatcggattattaacatccaccattcatttctgccggcctttatcggcgctaatccgtataaacgggcttatgagcgcggagtgaaattaatcggcgcgacctctcactatgtgacggacgatcttgacgaagggccgattattgaacaggatattgaacgcgtcgatcacagagatcacgcagaggatctgaagaatatcggcagaacgattgagcggagcgtgttggcaagagccgtaaaatggcatctggaagaccgtgtcatcgttcacggaaacaaaacgatcgtatttaattaatgacggtccgccggggaggcgggctgttttttatggatgaaaatgtcttgacaagaacctgttttctttgcataatataaaaaaatcattgagcgttgaagaggatcagtacgcagaactttctgtgacagagagcaaaatggcccgctgaaacattttgccgcatgaaacctgccgaacctgccttggagtcctgaggggaaaactcaggcgcgatacctggcgttacaggaaagcgggacgcgtgaaaaacgcgttcaaacaaggtggtaccacggaaagcccatttcgtccttatttttcaggacggaatgggctttttttattgacgagagccggtttggattgattgccacggaggagaaacgatgaaaaaacaaagaattgttgtgaaaatcgggagcagctcgctcaccaacagtaacggaagtattgatgaagcaaaaatcaaggaacatacggaagccatttctttattaaaagaaaacgggcatgaagtgatcctcattacctcaggcgcggtggcagcgggtttttccgctctcggctatccgtcgcgacccgttacgataaaaggaaaacaggcagctgccgcagtcggccagacgcttttaatgcagcaatatatggaccatttaaaaggatacggtctgacgccggcacaaattttattaacaagaaatgatttctcaaaaagagagcggtacagaaatgcctatgccactgtaatggaactgttggagcgcggcgtcgtgccgattattaatgagaatgattccacatcagtcgaagagctgacgttcggtgataacgacatgctgtcggcgcttgtaagcggtttgattcatgcagaccaattaatgattctcacagacattaacgggctgtacgatgccaatccgaatgaaaacccggacgcaaagcggtttgactatctgaatgacatcacacctgaattgctcggatatgccgggtcagcaggctcaaaggtcggcaccggaggcatgaagtcaaaacttctcgccgcccagaccgcattgtcgctcggggtgaaggtgtttatcggaaccggctccggacgtgaaaaactgatggtgattttaaacggaaaaggcgacggcacttatatcggcgataaagacctgtcctcagtgaataatacacggcaatggatcatgtttcattctccgatatcaggggaaatcatcattgatgggggagcggagcaggcgatgatccataacgggtcaagtctcctcccggccggcgtcgccgatgtctgcggcagttttccgaaaggagccgtagtggaagtcagagggcccggcggcattatcggcaaagggcagacacagtactcatccgatgaaattttagaagccaaagggaagcggagcgaccagctttcaggaacgaagcaggtggaagtgattcacagagatgattgggtgaatttatttgacaagggggaacacaaatgagtgaagtattgcaaaaagcggctttggcaaaagaagcggctgccgaaatggtcatgaaaacgacggctgaaaaaaacgaagcgctccaatgtattgcagacggactcagaaatgaacggcagctgattttaacagagaatcagaaagatattgaagcgggacggaacagaggattgacacctgacattattgacaggctgacgcttgatgaaaaacgcctgctcgatatcgcggacgccgtggaactgctaatcggtcttgaagatcccgtcggtgaatcattggagaccattaaaaaagagaatggattatcaattgaaaagatccgcgtgcccctcggagtagtgggcatgatctatgaggccagaccgaacgttaccgtagacgcggccacactctgtctgaaaaccggaaacgcggttgtgctcagaggaagttcttccgccatccacagcaacatagcgcttgtcagtgtgatgaaacgcgcacttgggctgtcaaagcttccgattgatgccgttcagctcatcgaagatacaagcaaagaaaccgccaaacagctctttacattaaatgatgggctggatgtattgatcccgcgcggcggtaaaaatttaattgatcttgtggtcagggaatcaaccgtacccgttttagaaaccggagcgggcaattgccacgtgtacatagatgagtcagcagatccccttatggcaagcgaggtcgtcatcaacgccaaaacacagcgtccttcggtctgcaatgcgattgaatctcttctgattcatgaaaaatgggccgaagaacacggacgaaagctgctgaatcagctgacagaaaaaggggtggagctccgaggagaccaggtgatttgcggactggagcctcaagcgaaacaagcagaagaagccgattggggagcggagtacctggcgcctattctcagtgtaaaaacggtgcaggacgtacaggaggcggtccgccacattcagcagtacggcacaaaccattcagaagccattctgacggagaacgccgagcatgcggcttacttccagaccgccgttgacgccgccgccgtgtatcataatgcttcaacccggtttacggacggttttgaattcggatacggagccgagatcggcatcagcacgcaaaagcttcacgcgagagggccgatgggacttccggcgttaacatctacaaaaatcatcatcaaaggaaacggacaaatccgggtataatcttttaagcttatccttcaaaaagggtaagctttttttatgcggaaagattgacggtttccattatatttcgtaaaattaaattgtacacaatataatagaggtgaatttatatgacaaaaccattatttactgcaaccgtttcagccgcaggcggacgtgaagggaaagtcacgtcttctgacggggtgctgaatcttgatgttgccatgccgggaacgccaagagcaaaaaagctcgaacaagccacaaaccctgaacagctgtttgccgcaggatattcagcctgctttgacagcgctcttcaactcgtagcaagaaaagagcgtctgagtattgaaacagaggtcactgcgcatgtcagtctgctgaaagatgaaagcgaccaaggatataaactcggcgttacccttgaggtcaaagcatccggcattgagaaacaggagcttgaagcccttatccaaaaagcgcacggtgtgtgcccgtattcaaaagcgacagcgggaaatattgaagtgaagcttctggcagcagaataaaaataaggatgcccattcggggcatccttattttttgccgtgcagcgttttcaaaacctcataaagcgactgttttacctgctttaattcctcttttgacagtcccgtctgttccagcatggcaatggggatatctgccgctgtattctgcaaggcccgtccttcatctgtgagcctgatcgtcacggatcgctcgtcttcagccgaccgctttctcatgatgattccgtgctgctccatccgtttcagcatcggtgtcagcgttccggaatccaggtgcaaaagctcacccatccgtttcacattcagttcttcgtgctcccataataaaagcagcgccaaatactggggataagttacgttgagcttatcaagcagcggtttgtaccgtttcgtcatttcccttgagcttgcgtacagcaaaaaacaaagctgattctccagtttcatatgttcaaaatctttttctgccattctttcaccaactcttttttgttaacgttacccctattgtagccgaaaaacggcccatttcctattgcaatcatgtttaaaaatatgagcaggggcaatatatacagtaagtacaatgaggaggctgataataatggcattatttacttcaaaagcgaccgcagtcggcggacgagcaggacatattaaatccgaagacggggtgctggattttgacatcatcatgccgaatgcaaaaaaagacggagaaaccggcacaaaccctgaacagctctttgcggcaggatatgctgcctgcttcgggggagcgcttgaactcgccgcccaaaaacaaaaaatcgacatgacctctgaaattgaaggacaggtcagccttttaaaagatgagagtgacgggggttacaaaatcggcgtaacgctcgtcattgatacaaaagatcttgataaagaaacggcggagaagctggtgcacgccgctcacgagttctgtccgtattcaaaagcaacaagaggaaatgtagacgtcaaacttgaattgaaataaagaaacgaacgaatatcccggatttcatatccgggatattttattaacgaaaacatcagtaatgatctcttctctcccggaataagaatacgatatagcacttttgcataatgacaccaagagaaaagagggagaaatcgatgactcttccaaacataccgaacatcacccccgacattacactctccagatgtgagaccctgaacctccttctttcatccgtggctatggaagaaatcggactatcccatattctgcaggcggaagcggaaaggattcaaatgtttctcagcgcttccggcgatccctccttaggggaattatcatcaatcaatagaagcactgaacggctcctgcgcaccgtcatgaaatcacaactccttttgcagacgaagcttgaagacattatctacttacaggatgctgaagcctgtatagacccggacgatccaagtaatccgagtgatccaggcgatcctgatgacccgtggaatccggacgacccaagtaatccgagtgatcccggtgatcctgatgacccgtggaatccggacgacccaagtaatccgagtgatccgggcgatcctgatgacccgtggaatccggacgatcccagtgatccggaagatccgtgtgacgacctgttttacggccgtattggctgctgtgagtgcggggattgtgaggactgcgattggaagaaaaaaggcggggagcgttcataaaaaaagagacgggtgaagcatatgccgtatccgagcatctcaaaagcgaaacagacatcttttgaagccttgcattgtctcacgatggcgctgttaaatatattatctgtgaccgtggataaaagaaggggttcaaattacaaagaagaaatcaggctgttctccgcattgtgccgctggcagatggaaacgggcggccggctgtttttaatgatcagcttggaagaagaacagaagcagatgtatgcgcggcactttcatgaaatgaagacagtgacggaacgaacgaaaaaattcatttgtgaaagcccgcgcgaattccgggcgcatcccattacgaagcgggctgtcaggcagcttcaggaatgggatgcagaatcaactgccgaacctgccgtcagatgggtgcggcctgtcatcataacgatgaacggcactcctggacggccttggttcaatcaacaactccaaaatcgggaaaggtgagaaaatgagcggaaatgctgaatgtaaactgactctttgcatgattgtgaaaaacgaggagagatatatctcccgttgtttatcaagtgtacaagacatcgctgatgagatcgtcatcgcagacaccggatcacaagataatacaaaagatatatgtaaaagctttcaggcaagagtgtttgatttcgaatgggagaatgatttcgcaaaggccagaaattacgccctgcagcatgccgaaggggattggattttagtgcttgacgcggatgaagagctcgatcaggagacgggccgttttttaacttctctgcttcatgacggattaccgagccggggacttttgaaaatcatcaattatacggggaagcagctcgatgaaaacgaagcgtttgaaagcatgcagccgaggctgttccgcaatcataaaggccttctgtatcaaggcagaattcacgagaatatctcggctcccaatgaggaagaaaacaatgcttttttcacgctcccatgtgtgattcatcactacggctacttggagcaggaagaaaaaatcaaacaaaaacataaacggaatatcagcatattaaatgaagaactttcagaggaaaatcctgatccgtggctagtctatcatctggcaagtgaatgttacagaataaaagactatgaaaaagcattacatcttgtcaacggctcaatatttcaatttttaagtgagaaacgaatgcctccgtctcttctgtattttctaaaatatacaatattgcttgagctcaagcgatatgaagaagccgaacaagggattgaaaaagtgctcaagctttatcctgattacagcaatcttcattattataaaggccttgtattatatcatttggaaaagtacagagcggcaatcaaagcatttgaagccggaacgcaggttgaaggagaaaacgctgatcacttcattttaaaaggtgccgccgatttcagagctttttattatatggcgaaatgccatgctgcattaaaccatgatatgacggccatcgcttacgccaaaaaatccgtgaaattcaatccgcaatttaaacccgcgcaagaacttctgtctcaattaaaaaaggatcagcggacaaacgcctgatcctttttttgcatgttccattaagataatcgaataatgtttaaagctgcgccggcacttcctctaagcaatgtggccgcacccaataatccgaacagctggagctgaatggtgctgcctgctgtcaaagtcacaataaaggagttattgaagtttgccaaagacgcgaccggagcaataatcgaacttgcagccggagtgccgttgattaagatgcgcgaacttactagcaggccggccgttaaattaatatggtaggaaatatagtaccgtcctgccggagcaacggtgaatacagtatttgcggcattagcggtaatatccgctgagaggttttgttcattcggtaaggaaatggccgtgccgccgttaataactgcgacaacaccgccgcccgtattgctcgcatagccggaagtggctgtcagacttgttccggtgcttcccggaggccctgtaatgccggtagccccggtaactccggtcggtcctgtaacgccggtaattccagttgatccagtgccgccagtagccccggtaattccggtccgcccggttgaaccagtagcgccggtgcttcccgccgcagctaaaagtgtatagtcagctgaggtttcaggggttcccgacgggctgtttacgtttgcgacataagagctgccgttatacaagacaacctgtccggtcgtgtaagtaggggcgatcagcggattaaaagcaacaatcccttgaagacccgcacccgtggccccgtcggccccgtggcccccgtcggtcccgccaatgtagggatatttgagatactgtccaattttgaaccgagaaggagctcctgtttcattaagctgtcaagcgtatcccggacgctctcattcaggttaagaatatccgcaagacttgacgggggtcctgttaatccgggaatcgttccgagcgcgtattggattttttccccttccgcattcagaatatgtgccattcccagctcttccatagcaattgacgaaagaagaaggttaatggtatcgtctctggaaagtgtaacgacaggggtgatattgggcatattaggctgtgacacaatgtccctccttatgagttggctgaaaatcattttattgcgaacaaagttcccccaaatgagcgtaagcagtactgtatcattatattcactgattctgtccaagtttctgaacgaattcccttcattaatttcatcatatatgaaggaaatactttaaatatagagaaaatacatcgcacagcattcacaaaatcggtcaaaatgacagcgggacatgtgatcgtctataaagcgatggctatatatcttgtgcgtttcctgcaaaaacgctctttttcatttcaagttttctgtataaaagggcgagaagcatggacggtatcgtacaaacaatcattccgataaaggcataccggggttcaatttcatataaaaaacctccgaaaatagtaaataccgcagtgctccagctgagagcaagcgctgaatatataccttgggctttcgggatttgcgcgggtgaaatatttttaattaagtatttcataaatgcatagtgtcccatcgcgaatgaacaggcatgcagcgtctgcgcaagacagaaaatgatgacatgcggaaaggcaaatacgagtatccagcgtacggtagcaccaagcgccgccagggcgagcaaagagcctgccgtaaattgatgaaagtatcggtcagcgattgcaaagaagataatctccgtgataacggcgatgttgatgatgattccgatggcatatgcgggcgcatcgatttcctgcaaaaagagataaccgtaattgtagtaagatgcatgtgccgcctgcagtaagataacgattgcgagcaccagaccgaaatatttgatgcggaataaggcaaacatgccctcttttcttgcacggtctgtttccggccgttttgaaagaacagctggcgcatgcataaagcttagggatgcgaatatcagggcgcccaaaagcagtgcccataaaatcgcttgatctccgaatatacctgtaaagacggacaggatgacgccggctgaaacaaaacccgcggatccccactgtcggctagtcccataagcctttaattcgttatgctgtacaaggacgccgcaagcgctgtctaaagcaggcattaaagccgggtaaaacacatgcagcactaatgtgacaagaagcaggctttgaaaagaatcagccggaatataacataaaagtgcgagaagcgtcccgattctggcgccgtttaataaggctttgctgctgaattttcctgataaataagggaagaaaaataatgtggaaatccctcttgccgccaggcccagactcataatgaaactggcttcggatacggaaaccccttttatatgcaccatccatcccgtccaatagggcagaaaaacaccccatgtcataaaaaaactaaaaaaatgcagactcatccagcgatatgctttcattcccgttcctcctttaattggcatgttatcatgtaaggacataaagacaatatgagatatctcatatttttggggtggacgatggaaatttataaaggcgagaaaaagcggcatcagttagaaaaacactcaatcgcgcatttattctctttccccgctgaagagtttatggaagtgcgcgaatatgagcgggacgaatggattattcaagagggcaggaggccagacttcctgttttacgtgattgaaggaaaagcgaaaatatatgtaacccaccaaaacgggaaagtttctttaattaattttatcaacaaaaatgattacatcggagagatggaactattacatgaagtgtattacacaaaaggaattcaagcctcagcgaagactgtttgttttgttctgcctatttaccgctgccgcgtgcaattgctgcaggatgcgaaattcctgcgtgagctggctaagtttttaagtgctaaggcaacgcttatggcttcgaaatattcacaaagtctggcgttcccgcttgaaaaccggcttgctgattttattttgcagacggcttataaaggggtttataaagagaagcacgtaacggtctgtgattatttgggtgtatcttaccgtcatctcttgcatgtgctgacgcaattctgccaaaaagggtatttgcaaaaagaggggcggggctatcaaattaagcagtatgattcattgtatgaactggcagaagcgctgcagaataagtagcatgcccagaaaaaacagccacccgcaatttacggatggctgttttcattatacaagctgagcttgtttttttcgtgcctgtttcgcggcgtcgaccatattttttaatgccgcaacggtttcttcctgctgtcttgttttcagtccgcagtccgggtttacccagaagcggtcagtcggacacacctcaagcgcgtcatcaataatttgatagatttcttcagttgccggcacacgcgggctgtgaatgtcgtatacaccgagtccgaggcctttcacgtaaggatgttctttcaggtactctaaaaatcctccgtggcttctgctgtgttcgattgtaatgacatccgcgtcaagatcattgatcgtatctacgatatcttcaaagttgctgtaacacatatgcgtatgaatctgcgtctcattttgcacagaagacgtcgttaaccggaatgcttctgcggcccaagttaaatattcatcccaatcctgcgtttttaacggcagtccttcgcggagcgcgggttcatccacttggataatctgaataccggcatcttcaagcgcttttacttcttttctgagggcaagcccgatctggaaggcgatttcttttcttgaaatatccacacgcgggaatgaccagtttaagatggtgacaggtcccgtcagcatgcctttcatatgtttttccgtcagcgattgggcgtagaccgtatcttttaccgtcatcggttcgataaattcgacatctccgaaaatgacaggcggacgtacgcagcgtgaaccgtaagactggacccatgcatatttcgtaaaggcgaatccggccagcttttcaccgaagtattccaccatgtccgtccgctcaaattctccgtgaacgagcacgtctaagccgatttcttcctgaatgtcaacccagcgcttcgtttccgcattaataaaggcttggtactgttcatccgtccaatcttttttccgccatttttgccgtgcgctccgcacctcggcagattgagggaagcttccgattgtcgtcgtcggcagaaggggaagaccgagtgattcattctgcagcgccaatcgttcttcaaagcttgccggacgggagaaatctttttccgtcagctgattcagctcttctttttgagcggagttcgctcctgttgcgaatgcttttaaagccttaagtgccgattttgattcttcgatctgctcactgacggccgctttgccggacagaagcccttcttttaagacgccgagttccgccagtttttctttagcgtatgacaggccgttcagcaaatccttttcaagatgctcgtcagggtgtttcgccaccggcacgtgcagaaggctgcttgaaggctgaatccataactcctcaacatcagcgtggctgaggatatccaaagccgcatcaaggcgttcttctacatcgattttccaaatgttccggccgtcgaccacaccggctgccagcactttatctttcgggaagccgtgctttttcaattgctcaaggtttctgcctttatcatgcacgaaatcaagtccgattccctgtacgggataagaaacgagttcttcatatgcatcaactgaatcaaagtatgtctgcaggaggacattcagtcctgaaagctcttttgtaatagattcatagaggtcttttgcggcgcggacatcttcagaagaagctgtcacaagggcaggctcatcaatctgaacccatttgacgccttctgcttcaagctctttcagcagctgcacataaagaggaacaaggcgtttttgaatcgctttcgcttctgattcttcgtatcctttcgcaagcgtgacgaatgtatacggaccgacgatgacaggtttcgtttccgctccgaattcttctttgatccggcggtagtcgtcaagctgtttgtttctcgtcagacggaattcaatgctttcgtcatattcaggaacgatgtaatggtagttggtattgaaccatttcgtcatttcactggaaacggcgtcttttacaccgcgggcaatcgcaaagtatgtatcaacgggatccgtgatgctgcggaatctttccggaatccagttaaagctgacggcggtatcaagcacatgatcataatgagtgaaatcagagaccggcacgatatcgatatgttggtcaagctgtgttttgacagctgataagaataaaccgtcaagctctttaagaaacgtttctttatcagtgtttcctttccaataagcctcaagtgcttttttccattctctgttcaagccgattctcggaaaaccgaggttcgaagttttgattgttgtcattaagtctcctcctttaagtgagatgtaacaaaaaagcctctttctcatgagagaaagaggctttaacttcaaaatgcaagcctctcttatctctcagatcacgtctgatggaattagcaccgtgccttatgagacaatcgtctcggcgcaaaaatcacgcgccccatttcacaatggaattacggtcggttgctgttggggtcaaaaggccaatccctcgcccaactctcgataagagaaagtatttcaatttttttgaaaagttacatcatttgttggttatcttatcagcttattcagatcactgtcaatagaaaatctcacaatttaaaaattggtgatgtgacaaactgatcaatcattatacgagaaaaatatcagaaagacagcagctgtgcctgttcggctctttccatcagcacttcaggcgcgtctaaatacagaaatccgttcccggccaatgttttggcgatgtccaaaggaagggtccgccgcacgagctgggcgtagacttcagcctcagaaagcgtccgctgaaacgcgtcctgttcaagcccttttattaaggcaagcgcaccgctcacatgcggggcggccattgaagtgcccgtcagcttcccgtatttatggttgggaagggtggagagaatattttctcccggagccaccaggtcaatctctttattagcgtttgaaaattcagacgatttacgggcgattgagactgatccgactgcgatcacttcgttgtaagcggccggatacgacagttcctctgtacgctcgtctccgtcgccttcgtttcctgccgcgcaaacgaccagaacaccgctttttaccgcatttgtgaccgcttctttcagttcaggcacatcgcttggcccgccgagtgacatggaaataatgtccgccttttgttcaacggcgtagttgatgccgttaatgatccattcgtatttgccgctgccgtttttcccgccgagaactttaacgattaaaaggcttgcttccggcgcgacacccgaaattccgccgtttgaatcattggctgcaatcgttccggaaacgtgtgtcccgtgtccgttgtaatcggaaatcacgtcttctttgcctccgtcatcatcggtgaagtttttcccgccgacaatccggtctttcaaatcaggatgattgatgtcgcagcctgtgtcaaggaccgcgattttaatatccttgcctttaaacccttttgcccacaactctggcgccttaatcactttaatcccctcaggaagctcgttcacatccatgatctgttcatccgtgacataaggaatcaaatgcatttcaccattcataaaaaagccctccttttttatgcttgccagtggatacaagggtgttgctactattttatggcagagcatgccggccggaaagagtcatttgaagcattttcataaaaaaggcgtaatctatcggactaaaaaatttcaaataaatggatagtttgacagctttcattttcattcatgacccgctgacgctataattggaaatgggaaaggagaagagagatgaagataaatgaagcgttatacagctatttttcagaacaagtggatcaaattgcgaaagagtggatcgaaacgatggaagattcggatccgaattcgatttattctttgacaaatcccgtcatcacagaagaactgacggagcaggataaagaattttaccggcatattaataaaatgtatatcatgccggaaaaagaatttttagaagaattcgagcggtgggtgattgagcttgcgaaagaccagaagcatctggatactcccgtccagtatgtggtccgtgaattcatgagaaaccggagactatacatcagttattatgatgcgtttgccgataaacatgaatcttcgtttgccgagggagaaaggaagaaatgggagaatttaattgcacaagtatttgattttacgatttacacgtttgtcgatcatgctgagcataactcaaaaatgcagctgaatgcgcaaagagaaatgattttggagttaagctcgccggttatcacgctgagcaaacggacggcgctgctgccgcttgtcggcgatattgacacggagcgcgccaaattcattcttgaaaatacgctgagcacatgtgcaaaacggctgattgaacatctgttaattgacctgtcgggtgtagtggttgtcgatacgatggtggcgcatcagatttttaaattaattgaagcgctgaaattgatcggcgtcacgtccactttatccggaatcaggccggaaattgctcaaaccgccgtacagctcggcattaatttctcagagattacggtcaagtccaatctcgctcaggctctcaattatcatcaataacatacataacaaaacaggctgccgaatcactccggcggcctgtttttatacaaacaacaatgaaatgagccagcttgcgccgaataacagaagcacgagcaggaaaaagcaccagtcggcgcggcgcacagtaacagttctgtaaaacgtgcggtttcggctcccagtaaagcctttagattccatcgcgatggccgtgcgttccgcctttctgattgcgcctgccaatagcggaatggtgaagcgcctgaaggcggagagctttcctttcagcccggaatcagacgccgcacccctgattctgtgcgcctgccggatgatcaggatttcatctttcagaagagggagaaaccggaatcccgcgataacgccgtatgcaagcttgggcggcagcttacactgctgaatcagactgagcatgaacagaatcggatcggttgtaaaaagaaacatcatcgacaaagcggaaaaacataaaatacgaaacgcgatagaaatcccgagcgccgcgttatcactgttgacggcaatcggcccgagtttaaacagcagattgctcccggttgtcgggacgtttccgaatacggcggctgtccataaagaaccgaaggccagaatgacaaacggaatcgtgaacagcagccattttttcagcggcacacgccccgccgagaggacgcctcccgcaatgatgatataaaacaaagcaggggtgtacggattataaataaatgacagcataatgacgcataacaatacagccgccgcctttattgacgggttaacagcctccagccgcaagttcatttttccgcctcctgtcgtgtttcatccattcataccgcaggggcaaagctaaatgcgcccgctccgcgattccgatatgatcagaaaacaatgagtcgggcgttccgcggtacaccagcttcgtgccgcagagcacaaggatcgtgtcggcataatccgagacgagttccatatcgtgtgtcaccatcaaaacagccgttccttccttttgaatctcacggagcatttgcatacactcccgcgccgttttggcatcctgtccgaaagtcggttcatcaagcatcaaaacgttcacattgtgcataagcatcgtcgcgacgctgagcctgcgtttttgtccttggcttaaagaaaacggatgctgtgaggcatggcgtctcatgccgaatcgggttaacagctgaagagctttctcctttgcggctctgttgctttcaaaaccgaacatcagctcttgaatgacggaatctgtgacaaactggtgttcaggattctggaaaacatatccgatctgtcgccgcagctctttttcagaataggaatcaatcggtctgccgtctattttgatgtctccgcccagcggacggatgagcttggccgcggcagaaaggagcgtggattttcctgttccgttaggaccggcaatcgcggtgattgaacctttttttacggaaaagctcacatcctgaaaaatgacttctgctcctcttgagaatgacagttcgtgaacgctcagcgcgtcttctgccgaaagcgcggcgggccggggttcgggcagagatggtacaggttcgtgaaacagattttctttacacaatgtaaaaggaatgctgacgtgctcctgcaatgagatcacacgcggaatcggaatgccgagctgtatcagctcttcaatccttgtttcaaagataacatccgtctctccgtccatcaccttctgacccgtttcgtcaaggacaatcgtcctgtccatccacggcgcccagtgatcaagctgatgttcgataacgagaaggccgaagcctttttttgcttgaagatctttgatcagccgcactaattcacgtgccgaatatggatcaagctgtgccgtcggttcgtccaaaataatgagttccggttccatcgcaatgatacaggcaagcgccactttttgttttgaaccgcctgacagcgaagcgatcgttcgcgttttcagatgagtgatctctaatttttctaaaacgtcatcgatgattgcgtccatatcttcttttgtatattgcaaattttccaggccgaaggcgatttcatcttcaacggtcagcatgcaaaactgctggtccggatcttgaaacacgacgccgatagatctggcggcgggttctgtcaggtgtgaaagaggtgttccgtataaagaaacggttcccgattgaaccccatcgcatgcttccgggtacagaccgtttaaacagagagcgagcgagcttttgccgcatccgctcggcccgagcaataaagcccgctctcctttgcggagctgaaaggacacgttttgaaaaatcggcttttcatcctgatcataagaaaaggtaagacggccggcggatagaaggggttcagatgcctgcatcttggttcacctgtttctttttcttcttgaattgttttccgagcgccatgccgttcagcactcctgtgtaagccagcgcatcactgattgctttgccgagaaggccggcaagaagcgcacctgagaccagacggatgagaagcatgacggctaataaacccggattcaaaacagagtatccggaaacgaacaagtcataaatgaagcttgtcacagaagaccccataccggataaaagaagcacgggcagggtatacacccgccagcgtgtcgctaaaaagattgcttccgcaccgattccctgtgcgatcccgatcagaatcaccatcggtcctgacggatttccgagtaagcactccacaaacgcggcgatgatttcagaaacgagagccgctcccggtttttgaataatgtacgcggcaatcaccgagacgataaaccagataccgtaaatcggttcgtagctcatccggccgaaaaatcctgccgctatattgcttgcatgagttgatactaaataaatgacagcaaatacaacactgatgacggacatgacgacaatttctctcattttccaatttttcattgtgatctcctgctttcttatcgatagtcgtaagtatgaaagagttgattttacgaaagacgattgatcgtaagtttcatattgcggtgtcctcccccgttttttaatgaaaaataaaaaactgcatatccgagggaatatgcagcagcagaacgaaaacgcatggggaaaaaccctgcgctccggtcaatctgcacttccccacgctggtattatccagatcgggttataagggatcaaaacacgcctgccgcatgttttatctcagccgataacagcacccctagtgcgtttcctatacagttttttataatgacatcatcatagttgatcatgtctgatttgtaaacagcctttctccgaacagagtttggaatcggaccggaagatcattcataaagataagaagagcccttttgatcaaaaggaaacggaggacatctatgtttgttcatacagtgcagtctggagactcgttattttccatcagcagaaagtacggataccctgttgacagcatcagaagcgtcaacgggcttgaggaaacgaatatcgttccggggcaggcgcttttaatccctcttaatgaatatacggttcagccgaatgatacgtatgccgttatcgcaggtaaggcttatgtgccgcagatgcagctgatgcaggcaaacccggatattccgccgaaccggctgcggacgggtatgaaagtgaagatccctgatatctctaactatcttgcgggaaccctgcaattttatgtcattcggacgcctgaagcggatagagagctgattaatgattttgcgccgtattcttcggcgatttctttgtttgaatatcatttcggcccgaatggagatatcatgaacgatttaaacgacagaaccgcaatagaaaccacatggcagaacagagtgcgcccgcttgccgtcattacgaatctgacagaagggggattcagtccggaattagcccatcaagtgctgcagaatccggcggcaagaacgaatctcgtcaacaatatcgtctccttaacggtaagaaagggatacggcggtgtaaatatcgattttgaacgggtcagagaagctgacagggatctcttcacaggatttctccggcagttaaaaacccggctttcagagcatcagctcgcgttaacgatatcggttccggcgaaaacaagtgatgcagtgccgtggctgaggggatatgattacggcggaatcggagccgtcgtcgattatatgttcattatggcgtacgactggcaccacgccggcagtgagccgggacccgtggcgcctttaacagaggtcaggcaaacgatcaattttgccatcagcagggtgccgagaagaaaagtgattctcggtgttccgctgtacgggtatgattgggtgattccgtaccgtcccggaacgatcggatctgccatctccaatcagcgcgccatggaaacggcgatgaagcatcaatcaatgatccgttattcccagcaggagcgttccccttacttccggtatactgatgaaaatggaagaacgcatgaagtgtggtttgaggatgtgcggagcatgagtgaaaaaatggttctcgttcgggagttcggactgcaggcgatcggcgcgtggcaattaacgctcggtttcaaaccgggcccgtggctgcttaggaacttttttacgatccgaaaaatatagctgcatgtcccgttccgcaagtgattttttctttcctatgataacggagcttcttttggacaatctaaaattgagaaggaggtctgtcatatgaagaaaagggaagagcagtatatcaacgaggctgagtatgtaccgcatccgacaaaagaaggggaatacgcgctcatgctgcatgaatcctatcatttcctttcagaagacgatgaaagcgatttgccggaataagggctttatgcctttattccgtttattttataggcatgtgctgaaatcacaaatttaaggttgacacattccttttttttctgtaatctcagtgtgtcaattcaaataagaacttcgttaggtgaggctcctgtatggagatacgctgctgcccaaaaatgtccaaagacgccaatgggtcaacaggaatcatcgacataaggtgattcttaacgcagctggatggctgtcctatgccatacagtgctaaagctctacgattggaggccccgcacgtttatttgccgtgcttgttttcgccttcatatcggaaggttttttttatgcctcaaaacgtacacgactgagcatgataaggaggtgcggagtatggattctccccattcgagtatgtcagaagaagtacccatatacagccagataaccagtgacgacatgatgaggagacaaaccgccgcacttcccttgacggacggcgcgtctccgtaaaggaggtacgagtcccgatggtccaaaacatgacctatgacgaactcatattacgcattatcattttattgcgggacggaaaaataaaagaattccgaaacatgatagatgagcttcagccctatgacatggcatttttatttaaagaaatgccggaaaagcaccgggcccgctatctgtcatatatgacggttgatgacatcaccgacatgatcggagagctggagcgggaatttcagcttgccgttttgcataaggtcggtaaaacgaaagccactctcgcaatgaataaaatggataacgacgatctcgccgcattgcttgaagagatggatgaagaactgaaagaacagcttttatccagtatggaggctgaggaatcaaaggccgtacagcttttgatgaactatccgcaagaatcggcgggccggatgatgacgaaccgcttcgtctggattccgcagcattatacagtaaaagatgcggtcgtgaagctgaaaagctttgcagaaatcgcagaatcaataaattatttgtacgtgattaatgacagcaagcagcttgtcggagtgctctcttacagagatttaattctcggcgagcctgacgataaagtgcaggatctcatgtttacgcgtgtcatctcggccggggtgctccaagaccaggaagaagtcgcccggctgatccagcggtatgactttttagccattcccatcgtggaagaaaataatgtgcttgtcggtattgtcactgtcgatgatattattgacgtcgtgattaaagaagccgatgaagattacgaaaaattcgcagcctccggtaaggcgattacatttgatacgaaagcatacgtggcggcgtaccgccgtttgccgtggctcattctgcttttgtttatcggattgatttccggaagcattctgaattattttgaagatacattgcaaaaagtagtcgccctcgcgtttttcatgccgatgatcgcgggaacgacgggtaatacaggcacacagtcacttgccgtcgtcatcagaggactggctaaagaagaaatgaataaaaaaaccatctttaaactgattttccgtgaattaagaaccggtatctacatcggcatcgtctgtgcgatcgcgattacgatcgtcgcaaccgtctggcagaaagacttaacgctcggttttgtcgtcggttcatcgctgcttgcaacgttgattatcggtacgatggccggaacgatcgtccctattattcttcataaactgaacattgacccggcgattgcgtcaggaccgctgattacgacgctgaacgatattttgtccttattaatttatttcggcattgcaactgcatttcttcatgctttataaaaaaagtccgtctcacaggaggcggacttttttgatcagcggtttttatacttaaaatgagcattaagctgtccttccagcatttttttgcggagctgcgggtcgtttttgagagcctgttcttttttccgcatgtcttttaaaatctcagccgtctgcacgccgtcttcccgcttgttggcaatatccatcagccgctcaacgtccgcgaaggaatactttctcgttccccgtgatgatcgctgcgggtagattaatttccgttcttcatagtatctgatctgtctgactgacaatccggttaattcgcttacaatgccgatcgagattacttttttatctttgtaagattgttcgtctgtcgtcatttttccacccctggatgtcttttactcatattatataagaaaaaaagagaaaaaacctgacgcttgtcaggttttctgacgcggaatagaaaattttagaaaaaaagcggcagaaaaattgacaaggttaatgcatggttctgtgcccccgttttatgcttattgtacagatacaatgaggaggaaggataggaatggagaaagaaaaagcggtttcgctggcaaaagaaatcattgaattagatatgaaacgcgatgaaatgctggaggcgttcatgcagcttgccggggaacacgcttttccgctgctcagagccgtccagaacggtctttaccgaaaaacatcataatctacagaagttttacaatggctttatacatctttgatataaaagcgttattctgatcatagaataacggaaaacaaaggaggccgtcatgagtcgtttgcttcaaaatgcattggataaagagagaaaccattattccaaaaagcttctgcagatcggagtctatacgaaagaaatacttaattccatgacaattacggagctgagaaaggaatacgcgtatttttttcggaacattccctataaagaacggaacccttatacaaattaaatgatgtataagggtatttttttatataaaaaagaaggaattctgaaaaacggcacgaatagaatataaaacaaagaacgactcttatgaattgtaagggtttacattatttttttataaaaatcttaaatacggggtagatatgatgagattatcatttaacgaagaagaagtgatgcgttcgatgaatttgtacaaagtttttgcaagggctttcaagagtgtgtctgaacacagcatccgcgatagtaaagaacacggttttaatccgactgaatttgccgttttggagctgctctatacgagaggaccgcaaaagcttcagcaaatcgggtcgcgtcttttgcttgtcagcgggaatgtcacctatgtcatcgacaagcttgaaagaaacgggtttttggtcagagaacaagacccgaaggacaaacggtctgtttacgcccatttaactgataaaggaaacgagtatttggataaaatttatccgattcattcattgagaattgcgagagcgttttcaggacttatgcctgaggaacaggaacagctgatagccttactgaaaaaagcaggaattcacagccagcatttgcttttccgttaaaagaaagcggatacagacactcttcttcatgaagagtgtttttttctgtttcggacagtagagcctgaagcggtttttgcataagctgatacagggctgcatcattatttaccaatcataatgtgtcatgcctcatgccaaaatatgagggtgctttgaatataaagaaggtgaacatgtgagaagctgtctgctgtctatatggtacttacttgatccgctttatttcttctttacccggctgacgctgattgataaacggcaatcgaatgtattccgcgtccgtttgactagatataaaggaaaagatgtcatcctgagcgacggaaccaggattaaaaaaaacgacgtgttagttaagattcatcttcataatgtcaaactcctgaaagagctgcagcctattgaaagcgcggtcagaagggggattatgctatatcagaaggtatatcaatccatgcctcatttagcggattatattaaccagcataaacggaaagacgagattaagggagtcgtcggcattacaatgcttcataaaggagcggcgagactcggttttgatgtgataaaaccgtccagcggctgctacaggctgtttaagaaagcggcccatcttccgattttatactttactgcaaaacagctcaccctcaaaaacattccttactcctgctatttatttatttccaaagaaaaattgatgtgcacgtatcagactgaaaagagctgaccaaaagcgtcagctctttctcttgatttgctcaagcacgattgaaagcgggccgtcctgcggattccggtaaaaatcataaaacggatctccctctgtcctgacgcggttcactactgtatcgatcgtataatcatcaggtgttaaagaggagttgacttcgctccaataaaggggagccgcaaccgttcccaattcgttgccccgggtcgaatagggggcgataatggttttcccttcggcatgctgcaaataatctaggtagagcctgccgtttcggtttttgataaaccgctctgtcgtaaaaagatccgggcgcgtcctgacgcaataatcggcgatgagcattgtgaacgcacgggtttcttcataggtgaatgcttccggtgaaagcgggatgtaaagctgaatgcctttatttccggagagcttcgggaatgacgtcatgctgaatgagtcaaacagctgtttcagcacatgcgcagcctccactgccataggaaaatcattccttgacggaggatcaagatcaatgacgatttctgcgggcctttcagaatgcactgtctgaaacggaacgtgaaattcaagcgccagctgattagccagccatagaagtgacggtacgctgctgcatacgatgtgctcgtggctcccgtcaaacacgcttgtgacaaagtccggcgtgtagtccggtttgtttttttgaaagaaagattcgccaggcgcgccgtgcggataacggatcaccgtgacggcccgatctttaagaaagggcatcagaaaatcgctcattttcaccatataactaaggaaatctgctttcgttttttcacgttttttaaaaacgatcttatccaggcttgtgaactgcagcttcggcggcagcgttttagagcggaggataagctgctgatacgtgcattccgtccaatccatttcaaactgaaaggacacaaaagatacttcacgcagcgtgtcctgcaatatggttaaatactgcacggtcatgcagatagaaggctcaagtgtatactcgccgcttttttgtttttttccgtgggtctccataatggttctgacggcgtttttttcttccgcctgcatgccgtgggaaacggaagcgatcgggacgacgatgccgtctttcaaaacagaggccgtcacatacccgttcttcggattgaatccggttaatagcacgtgagccgttttcatatgtttatacttctgccagtcgggagagcgtttattttccgcccatccgctggaagtccttttggctacgataccttctccgtcatggcggacgaccttgtcccaaagcgcgtcaaagtcagtgtgctccggaatgtattgaatcgcttcttccgctaagtgatgagggcaggcgggaagatttgcttctttaagcagattggaaagggcgcgcttccgtttcacatacggtaatgagacggtgcccgcgccttccagaacgaggagatcaaatgccagaaagcggcacggccgtctatcagcggtgcttttaattgcttcggttcgttttaaacgtccgcggatttgaagatgctcaaagtccgctctgtacggattgattaaatagacaagctctccgtcaagcgtaatggggaacctgtctttcatgtgctgaaaacaccgggccgcaaaagccgtgatttccggaaattgattcgtcagcgtctgtccgtttctgctggttaatgtaacaccgttttcgtctatgcggagaagacagcggaatccgtcatattttacctcatagcgccactcactgccttcaggcggtacagaggtcaaaatcggctgcatcgtcagcaccatgattaagacgttccggctttttgtctggtcgtcttctgctttttgcctccgccgccagctgacgctgtgtcttttgtccgtgccggtgcagcctgttcgcgattcggccgcttcgtccggtcaatgcttgcctgaagcgcgctgacaagatcaatgacatcttctcgcgggccggcaggagcaggtgtcacgcccgcttcttcatgttcgagcttatcgttaattttggcgagaagggctttccggtatgtgtcttcgtattgttccgggtcaaactcggttgtcagctcattaattaatgtgatcgccgtctgcagctctttttcattaacggctgtctgctcaggaacgcccggcacatgtccggcatttctgacctcatccggataatgaatggattccatcacgatgcagttgtcatacacgcgaagaatcgcaagctgctgtttagagcggatcgtaatggaggcaatcccgattttacccgtcgtcctcagcgcttcccgcagaagtgtataggcttttgtgccgttgtctcccggcccgacataatatgaccggttaaaataaatcggatcgatttcctgcagctggacaaagtcaacaatctcaaccgctttttcttcatgttcctgttttacgtctttcaagtcttcgtctgtcataatgacgtatttcccttttacatactcatagcctttcacgatttcatcaggctccagactcttttcacatccggtgcagattttttcgtatttaatcggcgcatggtcttctttatgaagactgcggaattttatatctttatcttcagtggccgcaaagagcttgaccgggatattgacgaggccgaaactgatcgaacccttccacatcgtgtgcatgaataaaaactcctttttgtctttattgtggataaacgggtccgttccatgtgtagcaacttatgggtgatgcggcgttcatggagcggctattctatttcctcatgcggtaatagccggctgaaaaggaaatcgcatgtgaatcggtaagttctttaaatcgctgaagtccccgaaaatcatcaatggttgatcaaaaaaattatacagaatcattccccgggaaatgcccacgcatttccatgtagtgaccgagagaatttcccgctcccataaaaacagattcggcgatggcaaagatcccggcaaaacgcactgcccatatgaactgaattccggtcagcgccgcttaccgcaaatggtaactttccggagatcttaagtgatgtaaccgccgccagacgagcattcaggagacaggcgggacgttgtattgcgcatgtcattccctcccgctataccgatctgaaacgactatatttataacgggcatgtctaaaagatatttcagcctcaaggttttgtgttaaaatcattcttaagtttcagaatatagacgtaagccgggagtgatagatcatcgaagatttcatcatatcaataattgaagcgtttaaaagcttatcttacgccggaatttttttggcgctcagtatagaattcatcccggcggaaattgttcttccgcttgcgggctattgggtctcaaaaggggatatgacgcttgccggagccgtgtttgccggttcgctcggcggtgtttcaggtccgcttgtcttatatgggatcggcaggctgggcggtcggccgtttttgctgaaatatggaaagtacatatggataaaacccgaatttctgcagaaatcagatgatttctttcagaagcacggaggtttggtagcgttcagcggccgttttataccgggggtcaggacgctgatttctttgccgtgcggcattgcgaagatgaatatctgggtgttctctctctatacatatgcagcgatgctgccgattacatttgcttacgtatacctcggtatgaaactcggggaaaattggaaaagcgtcggttccattctcgatcaatatatgctgccgctcggtatattcattgtgttgcttctcgttctttggatgtttttgaagagaagaaaacagcgggtcaaaacagaaaaaatttctcaatttgttaaaaaagttaagcgttgacaaatgatgaaacaggctttatcatgagcgtataaacaaatatttcttgaaatcccaaaggggagtagcgtccggatattccggaaacaaagtcgtcaattcatggatcatatccatcgactttgttggcatgccaatcattcatgtctagcaagacctttgccttatatcggcaaaggtcttttttgcgtaaaaaaaccgccggtataagctcggatgatagaaaaaagaaacggagggaatggattggactttgcattattattggagtatggatgggttcttctcgttttaatcgggctggaagggattttggcggcggataacgcgctggtgatggctgtgatggtgaagcatcttcctgaaaaacaaaggaagaaggctttattttacggattggcgggcgcatttattttgcgtttcgggtcgctgttcgccatttcatttctggtgaatgtttggcaggtccaggccgtcggcgctttatacctgttttacattgcggtcagccatttgctgaagcggtatgtattcaaagataacgccgggcagaaaacgcagaaagaaagcgggttttggcagactgtcttgaaagtggagctcgcggacatcgcttttgccgttgactccattttagcggcggtcgcacttgccgtaacgcttccgggaacacggcttcctgccatcggcggcttggacggcggtcagtttctcgttattttagccggcggcgtaatcggtttaatcattatgcgttttgcggcatcaatgttcgtatccttactgaaaaccaggccgggccttgaaacggcggcatttgtgattgtcggatgggtaggcgtgaagctcgctctttatacgttggcccatgaggaactcggtataattccggcagatgtcatccattcggcggcctggaaaatcattttctgggcggttctggctgccattgcggtttgcggatggtttatgtcaggagcaaaacaaacagagtccggcgcggcatcggaaaaaagagaacacgcgtaaaatgatcaaaaagggagtctggctttttagaaagcaggttcccttttttgtttgaagcgcttacatttaagacatatgataacaattttataacagcattgttacaaaaaacacagagaaaacccccttaattctgcatgggggcacgaaatcatgtatagtacgtcttattggcttgtcataattgagacaaatgaaatcgatttctctttttcttcctttgcgaatccctactaaattagctatgattatgagtagttatagggaggaactgaggtgaaaccagtgcttagccttttgtttaaattgggaaaaaagaagcaaacgcttgaaacatctgttgaaaaaatacaaaaaggcgacaaagatctgcagaacgatttaatacagcaatataagccttttatcgcgaagacggtttcatccgtttgtaaacgatatatagatgaaaaagacgacgaattcagcatcgggctgatcgcgtttaacgaagctattgaaaagtattcggctgaaaaaggtaattcgctgcttgcatttgcagagctgattataaaaagaaaagtgatagactatatcagaaaagaagcaagaaccgctcagcatatcaatatggatgtgcaggagggcgacgaccaggaatcttcgcagagccttatcgaagcggagctttccattgatgaataccgcaaacagatagaacaggaacagcgccgggaagaaattcttttttttcagaagcagctgaaagaatacggcctgtcttttaaagagctgctggaacaatcgccgaagcatactgatgcgaggcagaatgcgattaaggtagcctacacgcttgttgaaaatgaagagctggcgtccattttgcaccagaaaaaacagcttcctgtcaaacagctggagcagcttgtgtcggtcagcagaaaaacgattgaacggaaccgaaaatatatcatcgccatgagtattattattaccggtgattatatttatttaaaagattatcttaaaggggtgttgcactcatgagaagagggatcatagtagagaaaaataaaaaattcgtcacgttgctaacccctgacggacaatttttaaaaacaaaaaatgatcaccgcacttgtgaaatcggagaggaaattacgttcgaaggcgaaacgcgtatgggaagaagggccagcttttttgattttctgaaactgcgcccttttaaattgggagtgtttacgatgactgctattattttgtttattttaattttgctcccggttttttctgataacaaagcttacgcgtatatgacgcttgacattaatcccagcattgaaatggctttaaacagcaaatatgaagtcattgaactgacaccgctgaaccatgacgccaaacaggtcatcagtgacatcggagattggaaaagcagcgattttaaggaagtcatcaataatattattaccgattgcagcaagcatggatatgtaaaggaatcaaaagagattttaatttccacggtttatgaaaatacagatgacaatacatataaaaaaggcgttaaaaaacagctggctgacatgactgaaaaatataagggcacctaccaggtccaatctcttgaatctgatatggaaacaagagaaaaagcaaaacaggaagggatgtcaacaggcagctacataagaagaaacgaaaagaaaacagaagaaaaacagtctgaaaagcaaaccgacggcaatgaaacagatcaaaaagataccgaaacagacgctgatcaaagcaaacagccggacacagaaaagccggcggctgatgaaaagacagctcctgatgaagaaaaggcagcagagaagccggaaaacaatgaaacaacgcccggcacggaagaagcgaagccggacagtcaggacggcagtcagcaaaccgacaaaaatgcagcttccggatcagaagaaaacacacagaaggaacaagatggggaaacagagcagcccccaacacaaaatcctcaggaaaacggaaatgacaaagagcctaagcaaaagtattacaatcattactggaatcagcggaatcatgatcgcaatgaacattgggactcctatcggcatcatgaagattcgtcagaccgcaggaatccgaacggctaccggcacggaaaggagaatgccgataaatatcaaaattcgccgagaagtcccggcgaataagctgcattattgatttttcccgtttaattgtgattgagcctgctgtacaagacgttttgtcatttccccgcctacagagccgtttgcgcgtgctgctgtatcagagctaaggttcacgccgaattcttgagccacttcgtatttaaattggtcaagtgcctgctcagcccctggaactaagagtttatttctgctcgccatctttttcatctccttttctctggcaagatgtgtttacgcattttagtttcaaacggaacggtattgattatgctggcaattgttgtacagcaaaaaaccccggcgcagacaccggggcgaagaagcgttatgaattataataaatggctggtcattttgtaggctgaggcttgaatatggaaagtcaaaacggagagcaccgtgacggcgatgatggatctgatatcgttccattgtccgcttccgagttctttaaagcagcctttgagcttgtccgtctgctcttcgacgagctcctgcaggctcgtttccttcatcggcgggtttgctttatgatgaagataatcaatcacttgggcgcagctttcatagtagctgatcgggctgatgacgtcgtctgatctgtctgtgatcgtgttaaaagcgatttttaatatgccgcgtatatgttcgaagtcataaattgattttaaatcacgtacaatgagaaggatgacagcttgttcaattgtatattttttgccgagtaaggggtggccgattaaatctttaatatcgcgcttcacccagttttggacggcggttgattttaaagacgtcagctcgcacagatttcccagctcgacaatctcgttagttgaaagcccgtattcctttttctctttttttcgttcgaatctcgtcagaaattcagggatatgcagacggctttccgcttcatccaatgtcatttccgctgattgcaataagatttggagaggagttgcgtctccttggccttttaacgcgtaaagaagccggaccatatcagttcgggtcagtttaaacgtgttcatggttcacctctgattgattacgtgttcactttctgatatcactgagaattacatttacatcatacgtcgaaattgttgcattttcaaacagatcatttataatttaattaaataagttcttttgatcttaaaaaagacggaggtaattatggcgaaaagaatatttctgtttattttaacgaaccttttggtcattacgacaatcggaattgtgcttacgattattacaagcgttaccggtgtcggctcgtatatacaaaatggccgcattgatctgatggcattgctcgtgttcagtcttgtcgtcggttttgtcggttcttttatttctctcggaatgtccagatggatggccaaaacgatgatgggcgtccgggtgttaaatccgaagaaacagtcactcagctatgaagaacagcaattggttgaccgtgtgcacagattgtcccgtgccgcagggatgacgaaaatgcctgaagtcggcatttatcagtccccggaggtcaatgcttttgcgaccggaccttctaagcgccgttcgcttgtcgcggtttcttcaggtttattgcagcagatggatgatgctgcggtggaaggggttcttgcccatgaagtcgcacacatcacaaacggtgatatggtcacgatgacgctgctgcagggaatcgtcaatacgttcgtcgtattcctttcccgaatcgcggcatgggttgcaagccgctttgtcaaagaagacctcgcaccggtcgtgcattttatcgcgatgatcgtgtttcagattatcttttccattctcggcagtcttgtcgtcttcgcctactcgcgccacagagagtttcacgctgaccgcggcggtgcagaccttgccggcaaggataaaatgattcacgccctgcgtacgctgaagtcttatacaggacatgtgaatgaagaagaccagacggcggtgcagacgttaaaaattaacggcaaaaagcattcgtcactgttctccacacaccctgatctcgatgagcgcatccgcaggctggaagcaaaataataaacaaaacctctgacaatcgtttcagaggttttttgtttaaagatcggcaaattacataaggtaatgaaaaatctttcaaaaaaggcctttaaaaattctcccaatatcattagaataattacgtactacatttgagaggcagaaggaactatcttatgaaattaaaactgaagaaattcatacagatcttgtcgcctgcacagctgattgcattatactattttcttgctgtgacggtggcatttattttgctaagtctgccggccgcccacaaacaaggggccagctggtcgtttatagacgcgctgtttacggctgtcagctcagtcagtgtcaccggtttaacggtcgtcaacacggctgatacattcagcacggccgggattgtcattttggctttcgtgcttcaattcggcggaatcggcattatgacgctcggaacattcgtctggctcattatgggcaaacggatcggtctgcgggaacggaagctcattatggtggatcagaatcaatcgcagttttccggtatcgtcaacctgatgaagcaagtgctgtttttgattttattaatcgagtttttaggcggcatcatcttaggaacatattttttaacatactatgattcgtttgaacaggcgtacttgcacggattctttgcgagcgtcagcgccacgacaaacggcggctttgatattacgggaaattcactcgtcccgttcagacatgactatttcgtgcagtttattacgatgcttctgattattttcggtgcgatcggttttccggtgctcgtagaagtaaaagactttttgttttcaaaacagcgcagatactcattcacgctgtttacgaaaattacgaccgttacgttcggaatgctcgttttgttcggagccgtgggcatttacgcgcttgaagcaagccatgttatgaaggggaaaagctggcatgatgttttatttttatgtctctttcaatcaactgctacgcgaagcggcgggcttgcgacaattgatatcagccagctgtcggcgccgacattatttttcatctgcgccctcatgtttatcggcgcatcaccgagctcggtcggcggcggaatccgtacgacgacgtttgcgcttaaccttcttgctctgtttcattttgccagagggaataaagcggtcaaggtctttaaacgcgagcttcatcaggctgatgtcatgaagtcgctggtcgttacgatgatggcgattctgctcgtgttcgggtcgacgctgattctttccgtgacggagacaaatcagacgctcctcggactgctttttgaagtgtgttccgctttcggaacgaccggcctgtcgctcgggattactccgcatttaagcgatatcggaaaatgtgtgatcatgattgtgatgtttatcggccggatcggcattttgactttcctttatttgatcggccgaaaagaaatcgaagcaaattatcattatccgaaggaaaggatgattatcggctgacaccgcttttcagaaagcggtgtttttttattgccgtaaaatggatgagtggaaacagtttctttggagattctacttgtaaagaggtgacgtcattgtttgccgtattttggaagtcggtagttatgatcgcggtcggtacctttttattgcggattgccggacggaaatccatcagccagctgtcggtgacccagacagtcatcatgatttcgatcggctcgattattattcagccgtttattgaacataatttatgggaaaccattttcgcggcggcgatttttattgcggtactgattctgatggaatatttagaaatcaaatcaagcttttttgagtttctattttcaggaaaaaccgtcgccgttgtcagaaacggaaaaatcatcccggaaaacttaaaaaaaatgcgttttaccgaagaccagctgtcaatgaggatcaggcaggaaggcctcggagacattcaagattttaaatatgtgctgcttgagccgaacggacagatcggctatgaactcattgatgaggccaaaaacgtgacagtgcgcgacttaaaaaaaatgcttaatgaattcaaaacagatttgctgacagaaggaggaaatcaaatgaaacgcaaagcagcaaagaatgaagctttgaccaacaacaatacaccgactgagagcatggacaaagatgcatacaaaacacaatatgacggtgatcccggactgagaggcgcaaaccgcaaatcaaaacacggcaaacaaggaggcgagtaatatgacgaaaaaaaaccgccacagcaaagacatgcaaaaccataaaaagccgatggaccctaaattgcttgaagaagagttttcaagcgagctcggtgattataacgccggaaaatggattgaaacgcttgaacagacgaagccgaagaaaaaagaagacggcaaaaaataaaaaatacctcttaagcggcaacgcttaagaggtattttgcattatttcgaataagcaccgtttcttgttcctttcaccgcttgaagcaagccggttatccgcagctcaataaacggctgtgcggccgttttcaccgcattgctggagagaatggacgtaagagcggccgttaacattaagagcatgactaaattctgataatcagacaagtgatcttcaagcccgatctgccgcagcgtttttataatgaatccatgcagcagatacacgtaaaacgttctcgtaccccatttcgtaaagaaataacgcttttgcggaacgagcgccaaaaagctgaaagtggcggcaaaggccaaaacataccagccgatgcgcgacagaccgctcaacagcgacactgtgccgaatgtagaataaggctccgatccgaacagccacgagtaatcaaaatcaatgcaccagcataagaggaaaacaatccccagtacgcccgcggcaatctgcctgcctcttttagcccgaagcaaatcaaagtgccgtttctttaaataaaacccgacgagaaacatcggaagaaagacaaacgtccgtgaaagactcagcgtgctgctgatgaaatcgagatacccgatcatgacggcaagcccgcagctcgccccaagcgcccacattttcggcagcttcgtaaagggataaagcagcagattccaaaagaataagctgactaaaaaccagagagaccactgcggatcaatcggattgacgcttgccatgctttcatcctgaatcaaatagtaaaaaaccgagtaaatgccctgaaaaatcaggtacggaataatcagcttcacagccagcttcttcacataacctttccgcttaaagttttttgcgaaatagccggaaaccaggataaaggccggcatatgaaaagtataaatgaatttgtagagatggagcataaactcatttccgttaataaatgaccggaggatatggccgaacaccaccagaaaaatcaagataaacttggcgttgtcaaagtaactgtctcgcgattttgtcatagcatcaccttctcttcaaaaatcatccactgcatgattatttcctgttggtgttcattttaaaataaaaaacaaaaaattgaaggaggacaaaagggattgttaggatgatgtaacggggaggtaaggatcgtagaaaaagactttaacttgtcatatcattgaaattttctgaaatgtatagggcgaatgaaggaagatgaggtattttgtagaaatattgaaggataggtttttgaagaaggagtgtactgaatggctgaaactctggatttgcaaacaaacgagtcgctgaaagagcagctgaagcggatgaaagaggaaaatgaccgcctgaagagtgatttgaaccggtatcatgtgattatgaataacacgcttgatgccatttttatatgccgtaaggaaatgaaaatcgtccaggcgaacgaggctgcggcccggatgatgcagattgaggcagagagccttattaaccgctccgtcctggactttttatattccgtgcctcaggaagaactgaataaggccgtgaaaaagtttttaaaaaaaggccatctgtggaaagaggtgccgattaagcttgacagcggcgcgacgaaatacattgaattcctcgccagagacggaattggggaggattatttttttgtggtgatgagggacatctcctctaaaaaaatattagagcgcgaattctccatgaacgagcagctgtttaaagatttgtttgacagggctgtcgacggcatcgtgctgtttgataaggacggcgggtttattgatgcgaacctctctttttgcaaaagctttgagatcggccagaatgaattgtcccatctgtcgctccgccattttaccgacggcgaaaacaaaaagcatctgaaagaaatctgggaaaccctccgcagaaaaggaaatgccaaaggagaactgcccgtcaagcttcggtccggcgaagagaagctgtttgaatttacgattacgtccaacttaatcagcgggttctacatgtccattatgagagatataacagagaaacggttgatggaattgaaactctttaaaagcgaagagcgattccgcgaaatttttgaaaacgcgatggacgcgattgtcatttggtctgatgacggaaagattgccaaagcaaacgaatcggcgtgccgcattttcgaactgccgatggataagctgctggagacgaatttatgtacgtttatcgttgatccgcagaaaaaatacaagcagattaagaagaaatatgaaaaatacggggaaatccgtgaagaaatgctgtttcagatggcgaacggccaatacaaagagcttgagtttacatcaaaacgaaccatacttgaaggtcagcatttaaccattttaagaaatgtcagcgatcgtaagcggatggaaaaagaattgcgggaaagcgagctgaaattcagaaaagtattcaacggctcaatggacggcaaggtcttatttgacaaccaattccgcattattgacgcgaatcctctcgcaagccgtatactcggcatgccggatgaggagctgagagcgtacaccgttccggatattctttctttatttgatattgaaaacgcgggtgttcccgccagaaagattgatttagaaggaatggataatgaaatccccttcctgttaagcagcagtgacagccgcaaactggaattctccttcaaaagaaatatcattcaaaatatgaatctggccatctttaaagatgtcacagaggccaaagaacttgaagagaggctgcggaaatccgacactcttcatgttgtaggggagctggcggcgggcatcgcccacgaaatcagaaacccgatgacagcgctgaaagggttcattcagcttcttcaaggaagcattgaaggcgaatattccctgtactttaacgtcattacctcagaattaaaacgcatcgagtctatcatcactgaatttttaattttagcgaaacctcaggcgatattatatgaagaaaaagacgtgacgcagattctgaaagacacggctgatcttttgaatgcccaggccaatcttgtcaatgtgcagattcatctgaacctgaccggaaacatcccgccgatttactgtgaaccgaatcaattaaaacaggtgtttatcaatattttaaaaaacgccattgaagtcatgccgggcggcggcaatatctacgtgaccatccagccttctgatcaagaccacattttgatttcttttcaagatgaaggaacaggcatttccgaagacaaattaaaacgtctgggcgagccattttacacgacaaaagacaggggaacgggcctcggtctgatggtcagctataaaatcatcgaagaacatcagggacgcattcatgtggaaagtgaagaagggaagggcacggtttttcatttgacgcttccgatccggcagaataccgaagaaagaaggagcggggaatgatctgttttacaagtgtaaaagcgccgtttggaaccgttatcgtaacagaggaagagggctttattaccggcctgtttctcaccggggaagattttgaggaatggcggaaagacgcgcccggcgtaaagccgtgcgaaaccgctttgctgtcggaggcgaaacagcagctggcatcctatttttcaggagaaagaaagcaattctctctgcctttgagacaaaaaggcacaccctttcaggaaagggtatggaacgcgctgacgatgattccttacggggaatcccgaagctacggcgatatggccgaagcgatcggaaaaccgaaagcggtgcgcgccatcggacaagccaataaacgaaaccggctgccgatttttgtcccgtgccatcgggtaatcggcaaaaacagcgccttaacgggatacgcgggcacgaagacggatgtaaaagcggtgctgctgaacatcgaacaaatatcctataaagaaaaataaaacatatggcacgttccgtttttttgcgtccgacatatcattttattaagtgaaaaaagttggtctggtgaaaaaggaggacgaagcctgatgaaaatgagccgtccgcaaaagatagccggttatgcagagctgttttttaaaatgcatctcattacagccgcccaaaaagatgaagtgattacattgtgcagacaaaaaaaccgctgacattgcccgaggcaacatcatcagcggtttttcagctcagctgacagtctgcgaataattgttcaatttcttccgtgtaagaaccggtcacaattcctttctcggtgataatgcctgaaatcaggctgcccggtgtgatgtcaaaggccggattgaagaccggcacatcttcgggagcggtgcgtatgcctgagatctgtctgacttcatccggatctctttcttcaatcggaatctgatcgccgttttcaatctgcaagtcaaaggtcgaaagcggtgcggccacaaaaaacggaatctgaaaggcgtttgccaaaatagcgaggccgtaagttccgattttgttggccgtatctccgtttttagcaattctgtcagcgccgacaatgactgctgatatatgtttttccttcattgtatgggcggccatgctgtccgtaatgagtgtgacatcaattccgccctgcatcagctcccacgccgtcagccgggatccctggagaacgggtcttgtttcacatgcgtagatatgaaggccgaggtctttttgtttcgctaagtaaaagggagcaagcgccgtaccgtaccggcttgtagcaatcgagcccgcattgcagatggtcatgatctggtcgccttttttaaaaaggtgcagcgcattttggccgatcattcggcaggtttcttcatcctcaatctgaatttgaatagcttcatgaacgagcgttgttttcgcttcattgattgagattgcatccctgatggaatccgtcagtctgtcaagcgcccacgcgaggttgacggcagtgggcctcgaactgtttaaatacgctttgacatccgcgaactgacgtcggaaatctgaaaggtcgcgggcttcaaatgacttggcggagagcgcgagtccgaatgccgcggttataccgatggccggggcgccccttactttcagcgtgacaatcgcgtcgaatacatcttcctttgtttcaagttccacatactcagtgacgtcgggaagtttttgctgatttaaaatgcggatgtaggtttctttccattccacggaacgggggatggcaaattcattggtcatgctgcatcattcctttacacggagcttaaattggtccagaacttcggtgatatgcttcagttcttttctgttttcgatataataggcgccgatctcaagcgccagcttcttccgttcgattcgtttgtcaaacggagtgatttcatctaagtcagccacatgggcgagtccgatcgtgcgccggatcaattcgcatcccgcaaaaccgaccgcttcctcaaacgcgtttttcagtgtgtcttccagcaggtgtctgtgggaaggcaggcagtctttctcccatgcttcactgaatgttttcacaaatgtatcccatacggcggcagtatggtcatataacggctgtctgtcgtcaccgtcgcggctgagggcgtttaacagcagattggcgataaattggccgatgtcaaacccgatcggtccgaagaaagcaaactcgggatcaatcacctttgtttcatgttcatcggcgaagatgcttcccgtgtgcagatcgccgtgaaccaatgtttccgcggaattcagaaagatggctttcaattcgtcagcgccttctttcagccgggaattgttccaaactttttctgcgtacgggcgcagctcctcttcaaaatcgttggtctcatggtcgagaaacggttctgtaaacacaagcctttctgtaatattgcaaagctcaggatttgtaaactgctttgcgagctgctgctttactttcgcatcaagcgcataatcggatgagtaaaaaagcgttttccctaaaaattcaccgatatgaaccgataagttcggataatgctgcccttccagcagcccttttcttgaaatctgcaaatgtgagaggtcttccattaccgtgacggccatttcagtatcggaatagtaaacggccggaacgaggtgcggcacgtgttcgccctggcggatgagggcgctgctttcgattctcgcccgatcaattgtaagcggccagctttcaccgacgactttcgcgtaaggaatcgcctgtttgataatcagtcctttttggttttctttatcgtaaacatgaaagacgtaatttaaattgccgtcgccgatttcacggcatgtcagagtgcttttgctttggaataagccgagcttgacggctaacgcggcggcggagctttctgttaattgttcataaagacttgttttagttgctgacatggatttaccctccaattatgtagtggcagtaagagatcgtgacggagaatacgcccgaaaaaaagcctccttctctgaaagagaaggaggctgaaacagtgcagtccgcctcttatctctcagataacatctgatggaattagcaccgtgccttatgagacaatcgtctcggcgcaaaatgtacgcgccccatttcacaatggaattacggtcggttgctgttggggtcaaaaggccaattccctcgcccaactctcgataagagaaaatatattgatttgtatcacaattcggattaatcagttgatgaaaatattagcaggtgccggatattcttgtcaacatttttttgaaaattaatataaatcacgccgcaagtcttggaaaaccggaatggttccgcggacggccgcgctttctgacacatcgatttccgcccggactgcgccttccgtccggtctccttcggctaaaatccggccccacgggtcaataatcaggctgtggccggcaaattcattatcgggattggaccccgtgcagttagaggctgcgacaaaacattggttttcaattgctctggcgataagcaggcttcgccaatgatcaaggcggggcagaggccattccgcagagataaacaggacattcgcgccctgggacgtatgctttctgatccattcggggaaacggatatcatagcagatcagcccggcgcacttgacaccgtcgagctcaaaggaaccgtcgctgtttcccgctgacaagtaaaggtgttcatccatcagctgaaacagatgggctttctgataccgcttcacgatctgtccgctgttatcggcgatgtacatggtgttatagacattttcgccttctttgaccgcaaaagatccggcaacgaggtgtacgttgtatgtttttgccgtttctttaagccattgttccgaaactttgccgttttcatccgccagctggtctagccgtgtgagatcatagccggtcgtccacaactcaggaagcacgattacatccgcatggcggctttcttgctcaatcaaagattccgcttttttaaaattttctgaaggatttccgtatgaaatatcaaattgcaaacaggaaacggtccatttcattttttaacacctcaagtttctctttactttttttatttaaccatatatgatgatggactatcatttcaagacatttttagaaggtgaaaaatatgaactttgaaatctcagatgtactcaaacagctgccggaacaatttttcgcatcattggtgcaaaaagtaaatcaaaagctgaaagaaggcagagacgtcatcaatttagggcagggaaaccctgatcagccgacgcctcagcatatcgttgaagaaatgaagcgcgccgtcgaaaggccggaaaatcataaatactcatcattccggggcgcttacagcttcaaaaaagcagccgctgcattttatgaaagggagtacggggtcacgcttgatccggacacggaagtcgccgtgctgttcggaggcaaggcgggacttgttgagcttccgcaatgtcttttaaacccgggagataccattctggtgcctgatcccggatatcctgattactggtcgggcgtcgcccttgcgaaagcgaaaatggaaatgatgccgctgacggaagaaagagggtttctccctgattacagcgtaattcctgaaaaggtgcggagcgaggcgaagctgctgtatctcaattatccgaataatccgaccggcgctgtggcgacagaggcgttttttgaggagacggtcggttttgcggaacaaaacggtatttgtgtcgttcacgatttcgcgtacggagccgtcggctttgacgggcataaaccgctgagctttttgcagacggaaggcgcaaaggagacgggaatcgaagtctataccttgtccaaaacgtataatatggcgggctggcgggtcggatttgccgtcggaaacgcttctgtcatcgaagcgatcaatctttatcaggatcatatgtttgtcagcctgtttcccgcggcgcagcaggcggcggcagccgctcttttagaggatcaggcatgcgtcgcagcgcaaaatgacagatatgaatcgaggcgcaatgcatggattgaagcctgccgcggtatcggctgggatgtgacggctccggctggctccttttttgcatggctccctgtgcccgacggttatacgtcacagtcgttttcagatctgctgctcgagaaagcggatgtcgccgtcgctgccggaaacgggttcggaaaatggggggaaggctatataagagtcggtcttctgacaagtgaagaaagacttaaagaagctgcggaacggatcgggaaactgaatcttttcacccgaaaaagcattgacatatctggataacaatgcgataattcaaaatactttataaaatcattattcttatcaagagcaggcagagggacgagcccgatgaagcccggcaaccgactgataaagcacggtgctaattcttgcagcaggagctgagagataagattcggacataacacgaagcctctttctgctcatacggaagaggtttttttatgttttgtgaaagaaagagaggcgttcacgcatgagcgaagtattggcaacatatcttctgacagacacaacggacagtgaaaagcgggcggaacagattgcggcggggctgacggtaggctcctggactgacctgcccctggtgaagcaggaacagctcagaaaacataaaggccgggtcgtaaaagttgaggagaaagaaggaacctcagaaaacgaaacacaatccgtcatcactatcgcctatcccgaggcgaacttttcaagagatattccggccgtcctgacgacggtattcggaaagctgtcattggacggaaaaataaaattgactgatcttgaattttccgaagggtttaaacgctcccttcccgggccgaaattcggtatatacggcatccgcaaactgctgggcgaatttgaaagaccgcttctgatgagcatatttaaaggcgtgatcggacggaatctcgccgacattaaagaacagctcagacagcaggcgctcggaggcgtggatctgattaaagatgacgaaattttctttgaaaatgaactggctccgtttgaaacccgcattatcgaaggaaaacaagtcctgaaggaaacccgggaggagacggggcataaaacgctgtatgccgtaaaccttacgggaaggaccgctgaactgcgggataaagcgaggcgcgcggcagaactcggggcggacgcgcttttattgaatgtgttcgcttacggtttagatgtgatgcagagccttgcagaagacagggaaatcccgcttccgatcatggcgcatccggcagtcagcggcgcgttcacttcatctcccgtttacggcttgtcgcatgcgcttttgctcggcaagctgaaccgctattgcggcgctgatttcagtttatttccgtcaccttacggatccgttgctcttccgaaggagtccgcgcttgcaatccatgatgaatgtgtaaaagacgatgtctttcatccgtcgtttgccgtcccgtcggcaggcattcatcccggtatggtgccattgttgatgcgcgatttcggcatcgatcacatcatcaatgccggcggaggcattcacggccatccgaaaggagccgagggcggcggaagagcgttccgcgccatcattgatgcggtgcttgaagcgcagccgattgaagaaaaagccgcgtcgtgcaaagatcttcagctcgcattagacaaatggggaagggtggaagccgtatgacccgcacaccgctgattatttgtgatttcgacggaacggtcaccatgaacgacaacattgtcagcatgatgaaagaattcgcgccccctgagtggattgaattaaaagacggtgttctgtctaaaagcctatcaatccaagaaggagtcggccggatgttcggactgctgccgagcagcttaaaagaagaactgacagactttattctgaaggatgcgaaaatacgggacggctttttggattttgtctcgtttgtccggtcaaacggcctcccgttttatatcgtaagcggaggaatggacttttttgtgcatccgcttttggaagggatcgtagaaaaggagcggattttctgcaatcatgcatcctttgacaatgaatatattcatatagactggccgcacgcctgtgacggaggctgcaccaatcaatgcggctgctgcaaaccgtcagtcatccggaagctgtccgatcagcagaaatttctcattatgatcggtgattcggtcacggatgttgaggctgcaaagttatccgatatgtgttttgcgagagattatcttttgactgaatgcaaagaactcggcctccggcatctgccttttcaagattttcatgaggtgaaaacaggcattgaaaacatcggggaggtgcaggcgtggctgtaaaagaagaacgctggcgcgaacttgccgaggtaaagcgcgagctggccgaaagagactggttcccggcaacgagcgggaatctttccatcaaagtatccgacgcgccgctgactttcctcgttacggcgagcggaaaagacaaacgaaaagaaacagacgaagattttctcttaatcgatgagaacgggaagcccgctgagaccggccattctttaaaaccttcagcggaaacgcttctccatacttacttataccaaaagacagaagccggctgctgtctgcatgtccataccgttaataataatgtcatctcagagctttacggggatgaaaaacaaatcacgtttcaggggcaggagatgattaaggcgctcggattatgggaggaaaacgcgtccgtgaccgttccgatcattgacaacccggcgcacatcccggcattggccgaaaacttcgcgcaccatgcggacgccggctcaggcgcggtgttaatccgtaatcacggcattacggcatgggggcggaccgcatttgaagcgaaaagggtgctggaagcctatgaatttttattcagctgccacctcaagcttctgtcactgcggccgcagcttgtaaaataaaaggaggaacggaaaatggcgaccatcagaatacatgacgaaaagaatacgctcattgaaaatcaggaagaagtagcgcgctttttagacgaacaagaggtgatctatgagcagtggaacattgaaaaacttccgtctgagctttcggagaaatacaatctgacagaagatgaaaaagaacggattctcgcggcgtttgacacggagattcaggacatttcagcccggcgcggatatcagtctcaggatgtcatttctttatcagataccacgccgaatcttgatgaattattaaaaaatttccaaagagaacatcaccacacggatgatgaagtccgctttatcgtcagcggacacggcatcttcgtcattcaaggcaaagacggcacatttttcgacgtccgtttaaatccgggcgatttgatttcagttccggagaacatccgccactactttacgcttcaggaagaccgccgggtcgtcgcaatccgaattttcgtgacgactgagggctgggtgccgatttacgaaaatgaaagtgtgcaaaactgatagacgcccgaacctctcatgcccccgccggtatgagaggttttttattgtaatataaagtcagctgtggctgttttttaaatcttgaatatgccgcattctgtttatatcattacctgaatgggtattattctcgtattcatgctaaagattccaatatgaaatgaaaaaataagttatttagtaaaaaaatgtttacaaataaagtataatctgtaataatgctcaataacccaatcaaacttgtttcctattcttttagcggtgaggggtgaagtgaatgggcagttattctgaacaagaaaaattgcttgtatctattgataaaaaaagaaaaatgatgatagatgcggctaacagacaagggtttaccggatatgacacgatcaggcacagccaggaactggactgtctgatgaacgcgtatcagcagctggtaaaccgtgatcgcacacatcaccaaggaatacagggccttgtgaagaaaataggcttgttctcccgcggtgacgtcatgcctgcatatgaagcaaacaaatgattgatgataaaacagataacgaagactgaatgcgcttcctgatcaagcgccgcatccgaaagatgaccgcgtacagtcagcagatttttccgctggcacggctcacgaagcgcctcgtactatctgccggctatgatgccgttcctctggtatatcctcttacacatattcttctttaaataaaaaacaccccgacccagggtgtttttttcatcgtgaagcggcaggaagggtaatggtgacctctgtgcccttatcgacttcgctttgaatgtcaatcgaaccgccgtacatcagcatgattcgtttacatacgacaaggccgaggccggtgcctttttcctttgacgttacaaacggaagaaaaatgtgttcaagcatatcttcagaaatgcccattccgttgtcggccaccttaatgactgctttatggtcgcgggcttctaaatagatggacagccggccgccttcctgcatggattccagcgcgttttttgcgacatttaaaatcacctgtttaatatggtctttcgtgcagttgaccttgagcggccgattgacgagaatctccacattcacttccacattatacagattcccttcagaataaataatcggcataatctcatcaagaatatcctgcagcgagttcacttccaaccgttcagcagtgggtttaccgagcactaaaaactcactgacaatctgattgatccgtttaatctcctgctcaataattgagaaatacagctgatcttcctccgatttgtattttttctgcaaaagctgaatgaagccgctgatccctgtaagcgggttgcggatttcatgggcggtgctggcggcaagcgttccgatcagctccaatttctgcgcttcattttgagcgcgctccagctgggtcttgcgcttaagcagataatattggacgaggatgaacagaatattcagcagcacggcaatactggacatcggcagcagtacgcttttggtcagctcgttcagctcaaccggtttcggataaacattgatattccaattaatatcatccagatagccgctgaccggtttcaccccttctgattgatcagcccgtccgctggcaaatatcactttattctgattggttgccttgacataaacgtcagggctcagcatattgatcatatttctcaaataatcgacttgaatggcggctactaaataatccgtgacttcccgttttgcgtctaacaccggcacgcagatcgtgaagatgcgctggcctgtaattctgctggagtagtcatttgtgataaccgtttttttcgtctttttcgccttcgtaaaatacggtcggtcggccaaattcacctttgatttcagatcagtcgtgcttgcgatgacatcacctttggaattcagcatatacagaccgctgaatctgggttcatcctcaaaagcctgatcgagaatatcaatgatcttttcttcattgacaggcttatcgacagcgatcgcaagtgttgtcatccgggcttttgtttcaccgattaaataattgagcttattgcggtgaaggttgagcatcatactggcttcctgtatgtgtttatcggctattttctgcttttctttttcataaatgaaaaagctgataataagtgccgggatgatcaccaatatgagataaagtttgatctttccccgggcacctttaaatgtattcactctgcatcgctccaacattacacttgaatagaggtattatatcatttttatacttctttaataagaaaaaataaccaaaatgatagaaaaacaaattattttattaaggccagacaaaaagaagagaaattttggaaacatttttgttgacatttttcattttgtttattaatgtttctctgtaacggtttcttttgtaaaaggatgattgaatgtatgacggataaaacagaaaactcattgaaattatttattgtactgtcacgtgcgtaccgatctattaacgaccatatgaataaacatattcataagcacggtctgaacccgacggaatttgcggtgcttgagctgctgtaccacaaaggcaaccagccgcttcagcagatcggcgacaaaattttattagcgagcggaagtattacatatgttgttgacaaattagagaaaaaagaacttctcatcagaaaagcctcgccgactgacagaagagtgactttcgcacaaatttccgaaaagggaatccgtcttttggacgatattttccctgatcatgctgaagaaattaaagaaatgatcagtgtgctgagtgatgaagagatagaaatgtgtacggaaatgctgaaaagagtggggttaaacgctaaacattttcatcagaaataaaaaaggaagccgtttgaaaggcttccttttttatattactgattttggtcagtcgcggcgtttctaggctgtatcaatacctcgacgcgcctgtttttgctgcgcccttcagcggttttgttcgacacggccggtttatactctccgaaacctttggcgctgaatacttttgcgtcaagtttcgggttttccgtgagaatagccatgaagttgacggcccgcatgacgcttaaatgccagttagattgatattgtgagtttttaatcggcacattgtccgtatgtccgctgatgataatattcctcggcggattcagcacaaggagattcgagatttccttggcaagcggaatatcttcctgacggatgtccgcccgtccggaatcaaaaaagatactgtctttaatggtaattaagagtccttctttagtcagctttgtttccagctgagtttcaagctttttgttttttataaattgattgacttgcttttgcacgccttcaagttcttcgcggtcggctgcttctctttctttctttttctgttctttatctttttccttgtctttttttaactgatcaacgccgtctttttcgttttcaggaggggtgacgcttgaatattcaagaacacccgtgcctccggtaaacacggcgttaaatgatttagacagcatttggaatttcgccgcatcgaccgagctcatggcgaacaatacaatgaacagagccaaaagaagggtgagcaaatccgcgtacgggatcagccaagactcatccacatgctcgtcatcatgcttcttcttcttttttctcgccattgtttgcctctccttcttgttcagcgacttttgcgcgttcattcgcaggaagatacatgagaagtttttgttcgatcactttcggggcctgtccttcaagcactgacagaacgccttcgatcatgatttcacgcagtttgacttcctgctttgatttgcgtttcagtttgttggcgaagggatgccatagtacatatcctgtgaaaatcccgagaagggtggcgacaaacgccgcactgatggcatgtccgagcgcctcggtattgttcatgttggaaagagcggcgataaggccgatgaccgcacccaaaacgccgagtgtcggcgcatatgtgccggcttgtgtaaagatggctgcgccggcctggtgtctgtcttccatcgcttcaacttcttcagtcataatatctctgataaattctgcgctttgtccgtcaaccgccatgctcaggccgttttttaaaaatgcgtcatccacgtcttcaatgcttgcttccaatgcgagcagaccttcacgtctggcgatttgcgcccattgagagaacataggaattagttgcgcaattgtcagctgtttgttttctttaaacagcactttaaaaagggcaggcacttttttgatttcttttccggggaatgcgatgatcaccgcagaaatcgtaccgaacaaaataatcagaatagctgccgggttagcgagtgcgcttaagctgacccctttcagcaccatgcccacgcttaaagcaatcactgcgaggatgataccgataatcgatgttttatccatagttttcaccaaatcctttatactagctttctatggttaatatcggtggcagtgcatggaactttagggtgattgaaaaattgttcccgaattcttcacagtttctcccttccggcatggagaaagaaacaaaaaagcagctccccgcgaggagggaaccgcttttttcttattgtgcccggactttgatgccgtcctcttccattacgacatggaaggctttgatttcgttgtcatccaatagaagatctgtcatttcgtcctcgatcaattcttggatggttcttctgagcgggcgtgctccgaaagcggggtggtagccgatttcagcgattttttccttcgcatcatcggtgacgctcaggctgatgccgcgctcttttaatgtgtcttcaagctctgtgagaagcaggctgacgattttcacgagatgttcttttttcagggattggaattcaataatgctgtcaaaccggtttaaaaactccggtttgaagaacgcgctcagtgaatcaatcagcgtttgttcttccatgacgctctcttcagattggaatccgactttcacctgtttttcgccggttccagcgttgcttgtcataatcaaaacggtatctttaaagctgaccgttctgccctggctgtctgtcagacggccgtcctccataatctgcagaaacatatgctggacatcagggtgggctttttcaatctcatcgagcagcacgatgctgtacggattgcggcgcactttttccgttaattgaccggcttcatcgtgtccgacatatcccggcggtgaaccgataatttttgatacggcgtgtttttccatgtattcactcatatcgagacggataatggaatcttttgtaccgaacagttcatctgcgagtgtctttgataactcggtttttccgactccggtcggtccgacaaagaggaaggagccgacaggtctgtttttggattttaaaccggcgcggcttcgtctgactgctttcgccacttttttcacggctttttcctgaccgatgacacgctgatgaagatgctcttcaagttccttcattttgacttgttcatcagcctggagttttccgaccggaatgcctgttttttgttcaatgatggcttgaatatgctccgcgccgatttcaggtgaagaggccggtgtttcatgcgccagctgcttttccaaagctgcttcttcatcacgcagtttcgcggcaagctcataattttcttcctgaagcgcttttgttttctccgcgtcaattgcattgagtctctcagccgcatcttcttcatttacggtatcaagttccaggttcgccttagagccggcttcatctaataagtcgatcgctttatccggcaggtggcggtcctgaatgtaacgggatgaaagcgtaacacaggcgtttatcgcttcattgctgaatgtgacgccgtggtatttctcgtatttatctttaatgccttccagaatgctgatggcttgttctattgtaggctcgtgaaccatgacaggctggaagcgtctttcaagcgccgcatctttttcaatctggcggtactctttcagcgttgtcgccccgatgacctgcagctcgcctctggcaagcgccggtttcaggatgttcccggcatccattgatccctcggcagagccggcacctacaagaaggtgaatctcatcaatgaacaagatgacatttttccgttcttttaattcgttcattaattgtttcattctttcttcaaactggcctctgatccctgtattggcgacgagagaagcgacgtcaagcaggtaaagctctttgtttttcaacttgttcggcacatcgccttcagcgattttaagcgcgaggccttctgcaatagccgttttaccgacgcccggctcaccgatcagcaccggattgtttttattccggcggttcaaaatttcaattacgcgcgccacttcattatcgcggccgatcacagggtcaatcagacctgcttttgcgccgtttgtgacgttttgagcgagctcgtcaagcaggcctttttcagggccggcctgctgtttattttgattgggagcgaaaccttgctcaaacgggaatccgaatgattgcggccccatgctcatagacggttttcgggttaattctgtataacatgtttcacataaaacgaattgtttttgaatggaattgacttgcatgttcaggcgaatcgtcgcctcgtttttctgacaatgttgacaacgcatttgccaaaacctcctcgaaaaatatttgatcatctttgaccaaatgggttagaaaataaggtcgaaactttgaccttctttgattattagtatactctgaccttctttgactttcaagtattttgtttcaaaccccgaaaaataaatgtttacagcatgataagtgatattcgtgaggtttgattatttttgaccaatatagtcggaaaggaaatgaaatgctttgacctttcttgatgaagagtatacgccggccctttttttctttcaatatttttgcttagaggagagagctgaatctgttttttccggggaaggacgatttgttcgtcttttcgggagacttgtctcataagcatatataaaggcctggacaaatctgcgtttagccggagggtgaaatgggacaaacaaaaggttctgcaagtcagcttgcatttgtatacgtaggcacggttgtaggagccggttttgccacgggacgggaaatcgttgagttttttctgaagtttggctggatcggtctgttcggtatcgtggtaagcggtctgatgtttacatatttaggcgccaaaatcatgattatttccaaacggattcatgcagcatcttatcaggaattgaacacatatttattcggccagtccatcggccgcgccgtgaacatgtttatgatgtttatattgctgggagtgacctctgtcatgctgtccggagccggagcgctgtttcatgaacagcttggctggcccgcacaagcggggatcctactgacgatcgtactgagttttgccgtcatgacaagcggtgttaaaggtgtgttcggcgtcaatatattggtggtgccgcttttaatttctttctcttttatcgtgacagctgattcatttgtatttacaagcacgagaaacgcggacgaatgggtatggcctgacaagtggaactggcttttgtccgccgtctcttacggcgcgttaaatttatcgctcgcccaagccgtccttgtgccgcttgcgaacgaaatgtcttcagagaaggtgatcagaaggggagcttatataggcggcgttctgttgacactggtgcttgccgcgagctttttatcattatcggtgctgccggatgtgctggagtttgacattccgatggctcaagttgtctattcgtattcgcgttcgcttcatatcatttatttgtttattattttcggggaagtgtttacgtcggttatcggcaatttatacggattggaaaaacaattaaacagttttcttcatataaaaagtacatatatttacggcggcattttggcgtttgctttcattatcagccaaatcggttacggacagctgatttccaccgtttatccggtgtttgggtatgtgagcctcgcttttatgggcgcattgatttgcaaaaaaatcccgaaagaaaaataaggaaaatgtctgtatattttgggaattcccttcttttttcctgccatttctgtataatgaattgggaaatgatggggaggagtaagagatgaaggatcgacgtgtattattgggatttatttttatttgtatcggcattacgttttttttacagaaggcgggagttatacatatatccgcaggttcggcgtggccgtttcttttcattataatgtccgcagggtttcacgccggatttatttttgcgaaaaaaacgcctgaacaggcgggactgctcgttcccggcggtatgtttcttgtgctgggctgcctgttttgttttgagaccgcaacgggatggacgtattcaggcatgacgtggcctgtttatatatgggcgcctgctctcggtctgtttgagctgtggtatttcggcgggagaaagatcggcgtattgattcctgcttttatcctgacagccgcgggagcactatgctttgccggtatgctgatgacggggctgtggccgcttttgatcatcgcagccgcgcttttgtttcacgccgctgcctttatgcaaccgaaaaaaagatcgggccttcttattccgggcggcattttgcttgtgacgggcggcttgttatggtttgaaacgctgacggattggacatacgcaacgatgacatcgcctgtttacctctttgccgttgcattcgggctgtttgaagcctggctgttcggcagaaggcaaagagggcttttgactgctgcggcggttctgtgcgccgcgggcattttcggcatattcaccaatgcaaatgaagtcatcagcgaacgcggctggcccgctctcattctgttgctgggcgccgcttttcacattccgattttcggcccgaaacctgtcaaaaacgcggggcttctcgtaccgggcggcatcttattgatcacggggatcttgtttgtctttgaaacggcaaccaattggttctactccgatgtgacatggcctgtttacctgttggcaacggcattcggtttatttgagctgtggctgttcggcgggaaacagaaggcgctgctcattccggttgcagtgctgaccttgacagcactttgctttatgatgacgtatcagccgatcattccggtttctgttttctggcctgctttatttgttctgatcgggattgcgctgatggcatttccggggaagaaacgcggggcttaaacccgcttttgcagcctgacacagggttcaggctgtttttttattgtcacgggaaacaacattatggtatgatagcaaaagtgaaaaaagaagaaaatccgtattgatgcgggagaggttctagctacaccctctataaaaaactaaggacgagctgtatccttggatacggtttttttatgttttttagggcgccttctccgaaaaaggcgctttttttatggaatgatagataagggagagaaagacatgaaaaaagaaaaagcggttgtggtgttcagcggaggccaagacagcacgacttgtttattatgggctttgcaaaactttgaagaagtggaaaccgttacattccattataatcagcgtcaccaagaagaaatcgatgtggcaaaatcgattgccgaaaagctcggtgtcaaaaaccacttgcttgatatgtctcttttaaatcagcttgcgccgaatgcgctgacaagagatgatatcgaaattgaagcgaaggacggggaattgccgacaacctttgtaccgggacgcaaccttgtatttttatcctttgcatcgattcttgcatatcaaatcggcgcgcgccacattattaccggtgtttgcgagactgatttcagcggctacccggactgccgtgacgagtttgtcaaatcctgcaacgtcaccgtcaacttggcgatggaaaagccgttcgtcattcatacgccccttatgtggctgaacaaagcagaaacgtggaaacttgcggatgagctcggcgcgcttgattttgtaaagaataacacactgacttgctataacggcatcattgcggacggatgcggcgaatgcccggcatgcctgctccgcaataaaggatatgatgaatatatgaaaatgaaaggagagcggaactaattgctttctcaaatttacccgcaggttcagcatccttattcgtttgagttgaataaggacatgcacatttcagccgcgcactttattccccgcgaaagcgccggagcgtgcagcagagtccacgggcacacgtatacagtaaatattacagttgcgggggatgaactggacgattcaggctttctcgtgaatttcagcgtgctgaagaaattggtgcacggcgcttatgaccatacattgctgaatgaccatgaggaattttctgatgatgacagatattcactgccgacgaccgaggtcgtagccaaaacgatttatgataaggtgcagtcctacctcgaaacactggagaatcagccggtctgcgtgcaggtttttgtcagggaaaccccgacaagctattgcgtataccgcccgaaaaaaggtgataggaatggctaaaggaattccggtattagaaattttcggaccgacgatacaaggggagggcatggttatcggccagaaaaccatgttcgtccgcacggcgggctgtgactactcctgcagctggtgcgactccgcttttacatgggacggatcagccaaaaaagatatccgctggatgacggcggaagacatttaccgcgagctgagagaaatcggcggagacgccttttctcatgtcaccatctcaggaggaaacccggcgctgttaaagcagcttgacgcgctgattctgctgctgaaagagcacggggtgcgcgccgctttagaaacgcagggaacagtctatcaggattggttcacaatgattaacgacctgacgatttcaccgaagccgccaagttcggggatgacaaccgattttgcaaagctcgatcatattatgtcttcgcttgatgcggcagaaaggcttaacgcggtcagcttaaaggtcgtcatttttaatgatgaagatctgcaattcgcgaaaaccgtgcacaagcggtatccgaatatcccgttttatcttcaggtcggaaacgataacgtccatacgacggacgaccgggcattgatcgcacatctgctcggaaaatacgaaacactcgttgataaggtttcagccgattcggatctgaatctcgtcagagtcctgcctcagctgcatacgctgctttggggcaataaacggggagtttaatagaaagggagatttatatgacaagaaaagaatcagaattagaaggagttacgctcctggggaatcaagggacaaactatttatttgaatatgcgccggaggttttggaatcatttccgaataaacacgtgaaccgtgattatttcgttaaattcaactgcccggaatttacgtcgctttgcccgaaaacgggacagccggattttgcaaccatctacatcagctatattccggatgaaaaaatggtggaaagcaaatcgttaaagctgtatcttttcagcttccgcaaccacggagatttccacgaggactgcatgaacatcatcatgaatgacttgatcgaattaatggacccccgctacattgaagtatggggcaaattcacgccaagaggcggaatctccattgacccgtatacaaactacggcagaccgggaacaaaatacgaaaaaatggccgaacatcggatgatgaatcatgatatgtatccggagacgattgataatcgttaatttcagacggagtacggactcggactataacctaaatacccccgccttttaagcgggggtatttttcgtctctgccacgcagccaaaaaggtgcatgatatttgcacagaacttctataaggaaaagagagatcatttggagaaaagaaaaagacgagtaaacccggggggagtgtactcgccgcttcaatacgtgacgggtgctggatggcagctcgtctgtttcattataaaatagggaacgtatgtttgtaaaggactgcgctgttttttcttattcggagcggatcaattgtaaaggaatggccagcatggtagcatgtcctgtaaaaagaaggagtgttcgttatggagccgttagagttaaacggtgtaaggctgaaaatgtatgattgtaaagaaagtgcgggtaaaaacggccgtatgatttcattcgtattgaaggtgacctctgaaacgtatcatgatattgccgtccttttgtatgaaaaaacatttgacatcaaggcgcccgagcgtgggcttgaattccgcggtaaaataaccaactactatacatccgtcacaaatctttacaataaagatgagaccgatgatttttttgtggaaatgaccgagatctgaattcatttgaaaaagctgccgggcggcagcttttgtgcgggatatgtaaatggttcggattgttcgggggtttaataggagtctctgatgattttataattcttatggttgacgacagtgagggaatctaattcaaggtcacgataattatccatgatggttacatcaacgatgacggagttttcatttactttttcaacaataccggttaatccgtttttaaattcaatgacgtttccaaccttagcaattttcacgagcttcctctcctttatcataaatcctgtttgaaaatattttgcagtattttctttaagaagtaaagcgatatgggtatcagcccgctcaatcattgtcccggcgggggaaagatggtatattgtttttcgggaaaaagccgagaaaaggaggctgtattcgttgctgcctgaggaaatttcagaacgtatcaaccaaatgcgcatcggtgaaatcaaagaattcagggtgcagaaagaacattttcttgcatttcgagcggttttgtcgaagcaggaagattttaagcatttccgcggtattgcccagcagggcggagatgttatcttccagtatttagaacagccaagaagctgacggctcctcgcacttgaggagtctttttttgttttcgctgcttatttcatctggctgtaacagatgtaaacaaaatgtaaaatccctccgatggatacttttactgctatttggttaatgttgtgaaaatgacggctgttttcctgccaataacaaggctgttaacaaacttcttccatcataaaagctgattgggagcattggaaaatctttaaccgtgaatttgcgtacagctcttgttaaggtagtgaagtatttaaggaggaaatcgtatgacgacaaaatttgctgccttggctgtcttttttctatgttttatgcctgcatcaaaaattgaacatacagaagctctgtttacttttgcgaagaagccaaagcaagaacccagcacactggttgctgatttaaataaaaaaagcccggttccgaagctctcagaaacggatcataagcactctatccaaccgataaagctgtcatctcaccaagagaagaaagcaaaaccggacgagacggcttatcagccgccgaaaaaaacgtattcccgcgctgacagacagctcctgtcacgtctcgttcacgcagaagcgaaaggtgaatcttataaagggaaggttgcggtagccagcgtagtgctgaaccgtactgaaaaaaacggtttcccggataccattcggggcgtgatctatcaaaggaatgcatttgaaccggtagcaaacggaagcattaatcaaaagccggataaggattccatcgccgccgcaaatgaggcgctagaccatccgggcagagaaacgaacgcgttgtttttctacaatccgaaaacggcatctgaccactggatccgttcccgaaaaattatcgaacggatcggcagacacgtatttgcgatgtaagaagcatagcgggataaaaaatatccccgctatgcttttttcaattttgagaaatcgaaaatattttcagaacttgtctcatatgatgatggaagaacgtgagacaaggagagacaccatgaatcgatttgtgaaagggatcattcttttatccatcgccgcctttttcgcggaatgtctggaatttgtcgtgaatatgatactggcgcgggagcttggcgagcatgggatggggctttacatgagcattctgcccaccatttttttaattatcgtgatcgccagtctggagcttccgatctctatttcaaaattcatcgcggaatccaatcagaagctgcatgaaagcatgcttcggcatgccttcagaatgaccgccgtttttaccgcgttttcaaccgcggccgcaagcatcgcgctgccgttcattcctgtattcgatacgtatcacccgtttattaaagggattgtcatcgggctgattccagtcgtcgcttttacatccatcgccagaggttattttatgggtgtgcagcaaatgggaaaaatcgcggttgcgaatgtcttgaaaaaaatcattcaagtgctttgtctgtttatcttttttcaatggtactcttttgaaattgatatggccgtgcttatttcgttatttgtgctggtcgcaagcgatgttgtggtgttcgtttatctgtatacgcagtttattttggcgcggagggcgctttccggccatcagcacattcatcttcgcgggaaagacgtgcggaaacgcctcctggccgtatccatcccgacaacgggacttcgtatatttcatgcggtgacaaacgcaattgaacccttcttggttaaaggagcgctgctggcgtccggggcagccgggaccgccgcgattgatcaatacggaatgcttgccggtgtagcgatgacaatcggttcgtttcccgcatttatcgcccattcgctgatggtcgttatgattcccagcatttcagaagcgtatgcgctgtcccaatatgatattgtgctgaaacggctgagacaagcgatttttattacattcggctacggcattccggcggtctgggtcatgtttcagttcgcgggcccgctgacccatttgttttttcagtctccggaagcgcagtattatttgcagcttttgtggccgttttttctttttcatctgtttgtgatgccgcttcaagcctgtctgatcggcatcggccacgtgaaaacggcgttttatcataacgtatggagcagcattgtaggtctttcaatgatgtatgtgctcggttctatgccggaattgcaaatgctcggcattatactcggtatgaataccggcatgattcttctgacaagtttacattacgtgacgatctgcaaagacctcggtgtctccgtgtttttgacgggcggcggaagaacagctccccggatcgaaagctgaaaaggctgatacatttcaataaggaagggcaagctatccgaaacgcgtgaaaggaagatcatatgcataaaaaccgtctaattgtatgtgcagtccttttgatagctgccgccgtttggatgcctgaagcaaaagcctcatcagaaaaacaggcagttcccgccgtgtttctgatgaagacgattgaaggagacgaaatatcgattccgaataaagggcagaaaacgattttgcatttttggacatcgtggtgtccgccgtgcaaaaaagaactgccgcaattccaaacctattttgaacagcatcagtctgatgatgtaagccttgtaacggtaaatttgatgaatgccgagcgaaataaaaataccgttcaaaactttgtcactcagcaccatctcacattcccgattgttcttgacacgaaaggcgagcttatgaaggaatacgatgtcatgacgattcccacgtcatttctgctgaatgaaaaaggagaaatcgaaaaaaagatcgtcggtccgatgaccgcctcacaattaaaagaatggtcagagaaataaaaaggtgcgggaggaattcctcccgcaccttttttgcatataatgaacagctgaagaaacactaatgataattattatcataaagaaattaaaacaattataattgaaatcttccgccggcatgctataataaagaaaacactgcgataacactgtgaaaatgctgcctgtcaggcggctgttttacttttatcagggaattgaagatgatttgcgttctcaattagagaggagaattcataatgaatgaacaagtgatgacacaaacccattcacaacagcagaagatacaagaagagcgggccggaaaaaggtggctccagcatgcagaactcattgcggcgctcgtatccggcgtccttattcttgcggcctggttttttaccgaaacaaaaggcctgtccgtcactttgtatatccttgccttcctgatcgggggatttgcaaaagcaaaagagggaattgaggataccattgagacgaaggcgttaaatgtggaactgctgatgatatttgcggctgtcggctccgccctgatcggttattgggcggaaggcgcagttcttatctttattttttcgttaagcggcgcgctcgaaacatatacgatgaataaaagcagccgtgatttaacatccttgatgaaactggaaccggaggaagcgaccctgcttgcggacggacgggaaaagcgggtgccggctgctgaacttaagatcggtgacatgatcgtcattaagccgggcgaacgcgtagcggcagacgggattattgagtctggcgtgacgagcctcgatgaatcggcgctgacgggtgaagcgatgccggcggaaaaaacagcaggagattctgtgtttacaggaacggtaaacggaaacggctccttaacggtccgtgtgacgaaaacaaatgaacagtctttattcagaaaaatcatccggctggtggaatcagcccaaaacagcgtgtcaccggctcaggcatttattgagcgattcgaaagtgtctatgtcaaaggcgtgctgttagccgtggctgtgcttttattcgttcctcatttcgctttaggctggagctggagtgaaaccttttaccgggcgatggtgtttatggtggtcgcctccccgtgcgcgcttgttgcttctattatgcccgctgcgctttcccttatctcaaatggggcccgcaacggattattggttaaaggaagtgtgtttttagagcagctgggaagcgtacggatgatcgcatttgacaaaaccggcacggtcacaaagggacagccggcagtcgcggcatttcaagcagcggaaaatgtgagtgaagatgagatcatgcaggcggtatatgcgatagaaaagcaatcaagccacccgcttgcaaaagcgatagctgaatttgccgaaagccggggcgccgcgcccgcaggccatctatcgattgacgagacgtccggattcggtgttcaggctgaaatagaaggcgtcaaatggatggtcggaaaagcgggatttgcaggtgaacatgcggcagatgcttttttgcagacatcgggaaaagaattaaaggataaaggctttacactggtttttgttaagaaagaagaccggattgcgggctgcttcgccttaaaggatcaaatccggcctgaagccaaagccgtgatggctgagcttgaatcactgggcattcaaacagccatgctcaccggcgatcagtctgaaactgcggctgccatcgcgaaagaggcgggcatgacgacggttgttgccgattgtctgccggaccaaaaggcaaaagaagtgaagaagctgaaagaaacgtacggcacaatcgccatggtcggagacggcattaatgacgcgcccgctctgaaaaccgctgacgtcggtattgcgatgggcgggggcacggacgtggctctagaaacggctgacttagtccttatgaaaaatgatcttcacaagcttgtgaaaatgtgcagactttcaaggaaaatgaaccggattattaagcagaatattgttttctcgctctcggtcatctgccttttgatctgcgctaactttctgcaggtgatggaactgccgtttggcgtaatcggccatgaggggagcacgattctggttatactgaacggactgagattattaaaataaacatgacagccgcacatcgggcggctgtttttttaatgttcgttcacagcataaacgccggaaaactgatagaatgaataaagagtcactttggtaaggaggaaaatcaaaaaatgaacagattagaacgtgtttcatcttggctgaaaaaagaaggacatgatgcggcgtttatacatacaaaggaaaacgtattttatttaactgatttttacacggatccgcatgagcggttaatgggattgttcctgtttcaggaacaggagccgtttttcgtttgtccgggaatggaagacggacaagcccgaagcgccggttgggagcatggtattatcggctacggcgatcacgaagatccgtgggagctgatcaaagccgagctcacaaaacgaaatgtgccgcttgattccatcgcggttgaaaaggattcgatctctctttcccgctcagaacagctcaaacaagcttctgggggcgcggcatttgtttcggcagaagaaacgctcaaccaattccgtctcgtaaaagatgagaaggaaatcagcattctcagggaagcggcaaaactcgcggattacggagttgaagtcggtgtcgcggcgcttaaagagggtgtgagtgaaaccgaagtactcgcgcagattgagtttgagctgaagaaaaaaggtgtgcagggcatgtcattttcaacgatggtgctgttcggggaaaaatcaggccagccccatgggaatccgggtgcagaccggttgaaaaaaggggattttgttctgtttgatctgggcgttattcttgacggctactgttcagacattacgagaacattcgcataccaatcaatcagcccgaaacaggaagagatttacgaaacggtgcttaaagctgaacagacggcgcttcaattaagtaaacccggcgtcagaatcggcgatcttgatttaaaagcccgcggcattattgaaaaagccggatacggagactatttcccgcaccgcctcggccacggactcgggatttcggttcacgaatatccatcaatgagcagcgcgaacgacacactcctcaaagaaggcatggtgtacacgatagaaccgggaatttacgtgccggatgtcggcggcgtgcgcatagaagacgatgtgtttgtcacaaaagacggcgccgaagcattaacgcagtatccgaaagaattaacgattctgaaatagaaagctttgtgataaaaaaggacggttctggaacgcagcgtccttttttatcaccttttaaatgaaaaaatcatcaaaatgctgaaatggtttgatgtcatgcttttcattcaggggccgcagggcaaggtaactgccgccgagtatggccagacacaaaccgattaagcaaagaatccccatcgctgttcttctcctttcaaacggataggatgtatctgtttctagcttactgtatgaaacgcattccagatcaagggaaaaaaagaaaggggggacgccatggctacgatcagagacattgccggcgctgccggggtttccgttacaacggtatcaagagttttaaacgatcatccttatgtaagtaaggacaaaagagaaagagtgaaaaaagcgatgcaatcgctcggatacacgcgcaacattcatgctgttcatttatccaaaggtttttccgatatgatcggcgttgtgcttccgtcggtgaaccttccgtattttgcagaccttgttgcaggtattgccgaggctgccgaagcgtcaggcgtgcatctttgtttataccagacagattatgagcagcaaaaagaacgttttgccttatcacaattacaggagcgccaagtggacggcctgattatctgctccaaagcaattcctgatgagcatttgcttgccgtgaaagaaccgctcatcctctgccagtacactgatgcggcagggctttcctccatcagtaatccacatcgggaagcatttcggcacggtctggattatctgatagaaaagggacaccggaaaatagcgatctgcctggccagaaaaaagggaaaaaacagtcaagtccgaatcgccgcatacaaagaggcgctgaagaagatcgggcagccttacagggaagagctggttgtggaaaaggtgctgacgctgcttgacgggaaagccctttttcatagatggaagagctgggatgacaaaccgactgcgctgtttgcggcgaatgatcaagtatccgcaggtctttaccttgaagccaaggcaaacgggacgcgcatcccggaagagcttgcgattttgagcatcgacaatcatgatatcagcaagatgttaggtatttccacaatagatatacaaacgaaagaaatgggaaagcaggcttttcacatgcttgagaaccggatcagcggcgggcctccgggaaggaaagttcttgattaccgccttattgaacgatcaaccgtctaaaaaaagaattgacgcgctttccgttcgttttgtacgatatgaggtattgaatgacaaaggagctgaggatcatgaaggggtcctttacagttgaaaaggtattaaataacaatgtgctcatcgcaacacatgatagatacagtgaggtcgtcttaatcggaaaagggatcggctttggaaaaaaacaagcggatgtcattgaagataaagggtatgacaagatgttcatcttaaaggatgaaaaagaacaaaaacaatttaaaaagctcctcggttatgtggacgagacacttgtcgacatctccaatgacgtcatttatcatatcaagaagcggacaagccaaccgttaaatgagcatatccatattgcgctgactgaccatatcgcctttgcggtaaagcggctgcagcaggggtttgacattaaaaacccgtttctcatggaaaccgaaacgctttatccggaagaattccaaattgcccgtgaagtcgtcggcatgattaatgaaaagacgggaatctgccttcctgaaggagagatcggctttatcgctctgcatatccattccgccctgacgaatcggcccctttcagaggtcaatcagcattcgcagctgatgtcccgccttgttcaggtgattgaggactctttccagatgaaagtgaataaagaaagcgtccactatttgcggctgatccggcatatcagatttaccatagacaggattaatcgggaagagcagacaaaagaaccagaaaagttaatgttattattgaaaaatgaatacccgctatgctacaatactgcttggaaactgataaaaatcttgcagcaaatactgaaaaaaccagttcatgaggcggaagcggtttatctcacgcttcatttgtaccgattaaccaataaaatttcataatttcagttgaaaccttaaaaacgtgtcactgattcgatcaggcatgagtgattgagggtaaaaaacgggaagaacgatcccgttattttgcacaccctttttactcatgccttttttgttgtgtaaaagggcaaatgtaaacggttaaactgaagacttgcgccagtgaattcgttgtcatgaattttcgctgtaaggtcacactagctaacagaggaggtacatcttttatgtttaaagcattattcggcgttctccagaaaatcggccgtgctcttatgcttccggttgcgattttaccggctgcggggatcttgcttgcgttagggaatgccatgcagaacaaagatatgattcaagtcatgcatttcttaagcaatgataacgttcagcttgtggcgaacgtcatggaaagcgccggccaaatcgtatttgacaacctgccgcttctttttgcagtaggggttgcgatcggtcttgccaacggagacggtgttgccggaattgcggccattatcggatacctggtcatgaacgtatccatgagcgccgtgcttatggcgaacggcagtattccgtctgacaaaattgaacgggcaaagttttttgcggaaaaccatccggcctatattaacatgctggggatacccactttggcgactggcgtgttcggcggtattatcgtcggggtcctggccgcgttattgttcaacaagttttataaaattgaacttccgcagtacctcggattctttgcgggtaagcggttcgtcccgattatcacatcaatttccgcattaattctcggacttattatgttagtgatctggcctccgatccagcacggtctgaattccttctccacgggtcttgtggaagcgaatccaaccttggcggcctttattttcgggatgattgagcggtcattgattccgttcggtcttcatcacattttctactcgccgttctggtatgaatttttcagctataaagatgcggccggagacatcatccgcggagatcagcggattttcatggctcagatcaaagacggcgtacagctgacggcgggaacatttatgacggggaaatatccgtttatgatgttcggtcttccggcggcagcgcttgcaatctatcatgaagcgaagcctgaaaagaaaaaacttgtagccggaatcatgggttctgccgctctgacaagtttcttaacgggaattaccgagccgcttgaattctcattcttatttgtggctcctatcctgtttgcgattcactgcgtattcgcgggactttcctttatggttatgcagctgctgcatgtaaaaatcggtatgacgttctcaggcggtctgattgactacttcctgttcggaattctgcctaaccggaccgcttggtggcttgtcattccggtcggcctaggattagccgttatttactacttcggtttccggtttgcgatcagaaagttcaatctgaaaacgccgggccgtgaagaagaggctgcggatgaaggtgcgggcgcctcaggcgaagccggcgaccttccttatgaaatcctgcaggcaatgggtgaccaggaaaacattaagcaccttgacgcttgtatcacgagactccgcgttacggtcaacgaccagaagaaagtggataagactcgtttgaaacagcttggcgcctcaggcgttcttgaagtcggaaacaacattcaggccattttcggcccgcgttctgacggtttaaaaacacagatgcaggatattatcgccggacgcacgccgcgccctgaaccgaaagtatccgcacaagaagaagtcagccagcaggttgaggaggttatcgcagatccgctccgaaacgagcagggtgaagaagtgttcgcttctccgatcaccggcgaaatccatccgattaccgatgtgcctgaccaggtgttctcaggaaaaatgatgggtgacggttttgcgattcttcctgaagaaggaatcgtcgtatcgcctgtccgcggaaaagtgctgaatgttttcccgacaaaacatgcgatcggtcttcagtctgacggcggaagagagatcctgattcatttcggaatcgacacagtcagcctgaaaggcgaaggattcacttcttttgtttcagagggtgaccgggttgaaccggggcaaaagctgcttgaagttgatcttgaagcggttaaacctcatgttccttcattaatgacaccgattgtctttacaaatcttgccgagggtgaagcgatttccctttcggccgaaggtaccgtaaaacgggaacaaaaagatattgtgaaaatcggaaaataagcatataaatacgccgtgcttgtcagatgacaagtacggctgtatgatataatattgtgtagtaaaatagctttaatttaaaggagaatgataatcatggcacaaaaaacatttaaagtaacagcagattccggaatccacgctcgtcctgcgacagttcttgtacagactgcaagcaaatacgatgctgacgtaaacttagaatataacggcaaaacagtaaaccttaagtcaatcatgggcgttatgtctctaggtatcgctaaaggcgctgaaatcacaatttccgcttcaggcgctgacgaaaacgatgctcttaacgctttagaagaaacaatgaaaagcgaaggactcggcgagtaatgcaagaattaaaaggaataggcgcttcagccggaattgcgattgcgaaagcataccggcttgaagagccggacttaacggttgaaaagaaaaacattgctgatgctgcggctgaagtaagccgttttgatgaagcgattgtacgttctaaagaagagcttgaaaaaattaaagagcatgctttaaaagaactgggacaagacaaagctgacattttctccgcgcaccttttagttctgagtgatcctgagctgctgaacccggtaaaggagaaaatcagcacagattcagtcaatgctgaattcgctttgaaagaaacagcttccatgttcgttactatgtttgaatcaatggataacgaatacatgaaagagcgtgcggcggatatccgtgacgtaacaaaacgtgtgacggggcacctgctgggcgtggaaattccgaacccgagcatgatctcagaagaggttgttatcgtggctgaagatttgacaccgtctgatacggcgcaattaaaccgccagtttgtaaaaggttttacaactgatatcggcggacgcacttcacactccgcgatcatggcccgttcgcttgaaattccggctgttgtcggcacaaaagcggctacagggacaattgaaaacggtgttacggtaatcgtagacggcatcgatggtgatgtgatcatcgatccttccagtgaaacgttaaagaaatatgaagaaaagcacagtgcttacctggcgcaaaaagctgagtgggcgaagctcgtcaatgaaccgactgtttcaaaagacggccatcatgtagagcttgccgcaaacatcggcacacctgacgatgtaaaaggcgttcttgaaaacggaggagaagctgtagggctttaccgtacggaattcctttacatgggacgcgaccagcttccgacggaagacgagcagtttgacgcttataaaacggttcttgagcgtatggaaggaaaatcagttgtcgtgcggacattggatatcggcggcgacaaagagcttccttacctgcagctccctaaagaaatgaacccgttcttaggctacagagccatccgcctttgccttgaagagcaagaaatcttcagaactcagcttcgtgcgctgcttcgtgcaagtacatacggaaacttaaaaatcatgttcccgatgattgcgacagtaaacgagtttaaacaggcgaaagcgattcttctcgaagaaaaagaaaaactcgtcgaagccggcgtagcggtttctgacgatattgaagtcggtatgatggtagagattccgtctacagccgttatcgcagatcagtttgctacagaagttgacttcttcagtatcggaacaaatgacttgatccaatacacgatggctgctgaccgcatgaacgagcgcgtagcttatctgtatcagccatacaacccggcgattctccgtctgatcacccttgttattgaagccgctcacaaagagggcaaatgggtcggaatgtgcggagaaatggcgggagacgaaattgcgattccgattcttctcggcttaggcttagatgagttctcaatgagcgctacatccatccttccggcaagaacgcagatcagcaagctttctaaaaaagaagctgaatcattcaaagaaacaatcttgtctatgagcacgacagaagaggttgtcgcattcgttaaagaaacattcaataagtaatacaacagccagacggtataagccgtctggtttttttcatattcggaaaaaagggggaacaataacgttcaacaggagggattattatgacaaaatcatttgcagcgggggatacggtctatgtgatttaccgcaatccgcatgccgccaatgttgcccatattaaagaggcggagatcgtccatcacccatatcatgagggagaactgtctctgtttttatacgaaacctatcatccgctggccgaagatgacgcggtcttttcaacatatgaggaagcggaagcgctttacagcgagctttttgaagaagaccgatatcattgatcaaaggaaatgtttacaacgcatattcactctcttttaaacggaaagtaacaacatgagaatatgaaaaaagggagtgtcagttcatgctgaagccgtttgtgccccagcttgtttatatagaaccgagagcgctcgaatacccgttaggacaagagctgaagaataagtttgaaaatatggggcttgagatcagagaaacaacatcgcataatcaagtccggaatattccggggaaaaatcacttgcagcaataccggaacgcgaaatcaacattggtaatcggcgtccggaaaacactgaaattcgattcttcaaagccgtccgccgaatatgccattccatttgcgacaggctgtatggggcattgccactattgctacctgcagacgacgatggggtcaaagccttacatccggacatatgtcaatgtagaagagattctggatcaggctgatgagtatatgaaagaacgagcgccggaatttacaagatttgaagcctcttgtacgtctgatatcgtcggaatcgatcatctgacacatacattaaaaagagccattgaacatttcggacaaagcgaattggggcagctcagattcgtgactaaatttcaccacgtcgatcatttgcttgatgcaaaacataacggaaagactaggttcagattcagcatcaatgcggattatgtcataaaaaactttgaaccgggaacttctccgctcgacaaacggatcgaagccgccgtcaaagtcgctaaagcgggctatccgctcggtttcatcgtggcgcctatttatattcatgatggctgggaggaaggctataaggagctgtttgagaaactggatgcggcgcttgatgaagacgttcggcatgacatcacatttgaactgatccagcatcgttttacaaaaccggccaaacgggtgattgagaagaactatccgaaaacaaagcttgagcttgatgaagaaaagcgcaggtacaaatggggacgctacggaatcggcaaatatatataccaaaaagacgaagaacatgccttaagggaaacactcgaatcttatatcgaaacctattttccgaaagcgaaaatcgaatattttacgtaaggcggagctgtcggcatgacggctcttttttttgctgcgacaaatgacggaaatgtttgatatttatttcaagatttattcattttcttggccgaaagaccgatataactctcaggaggggatggttatgtttaaaaaaatgcatatcaaaattgctgtgtttgtatcggcaatgcttattgtaacggttgtttttttaacggtttcttcatatttgacattaaagccgatgatgacggaggaagcaaaacgtacgacagagaatgtcaccaattcactcggtcagaacattgagcttcagctgaaaaatgatgagaccgtattaatgagattagcagacggtgaattgtcccggtcttttctatcagatgggaagaaagaaaccgcgcggctttttaacgatgagttaaaacagatcggacagaatgacaaatatgtcgcgcttgcgtacgtcggaaccgcaaacaaacaaatgtttacatatccaaaggccgattttgccaaagactatgatctgacaaatcgaacgtggtataagatggcggctgaaaaacccgataaggttgtctggactgacccttataaagatgcagtgacgggagacatgatcgtgacggcgtcaaaagccattcaaaacagcggaaccgtcgtcggagtggcgagcttagatttgaagctgtcctccattcagagcatggtcaacgagcaaaaggttccgtataaaggatttgcgtttttggcggatgaaaacggctctcttctggcccatccggcaaaacagggaaaaaatatttcggaagatcagacgttaaaagacatcactgcggacaaagaaggcatcaaagagctgcaggggaacatggtcgtctaccaaacggtaaaagaaacagggtggaaagtcggaacgcagtttgaaaaagatcagctgatgggagtagccgacaaaatgaacacggtgagcatttttatgtcactgatcgcccttgtgattacgatcggactcagctatttcctcgcaaaaacgataaccgggccgattcagcagctgatcgcaaaaacaaattcagtctcagcgggagatttaaccgtccgcgcccagacgaaatcaaaagatgaagtaggcgagttaacaaaagactttaaccaaatggttgaaaatatgaaagagatggtcgaacaggtcaaggcctcctcagaaaatgtgtctgatacatctgaccagctaaccgtcatttcacaagaaacaaatgaaacgagcggacaaatcgcaaaagcgatagaggaagtcgccgccggagcgacagagcaagcgtcagaggttgagacgatcaacgaaaaatcagaaaatctctcagtcaaaataaaaggaatcgcagatcgcgcaggcagcataaaacaactctcaaaatcttcagaggatgccagctacaaaggattggacgcgctcgggcagctgctgatgaagtcaaacgaagccaattcagaaacgaaaaaagtagaggcaatgctgaatgacctggaagaacaaacgaaaaacatagaagaagtcgtgacggcaatatccgctatttcagaccagacgaatctcttggcgctgaatgcgagcatagaagccgcaagagcgggagaaagcggacggggctttgccgtcgtcgcggaagaagtccgcaagcttgctgaacaatcagctctttcttccggccatatcagtgagacggtccgtctgattcaatctgagacaaaagaagcgtcacacgcgatgattgaggcaagcagaatgaatgatgaacaaaacagcgccattcatgaaacgggtgaggttctcaatctgattacaacggaaatgcagtctctcgttcaaggtatagatcatatttacaatgacattcaaaaaatgagtgaagaacaagcctcgattcaagaagcgattcaaagcatctccgccatttctcaagaatctgcggcagcggcggaagaagtgaatgcttctactgatgaacagctcgttacgcttgaaaaagtgaagcaatcgactgatatgttaaagagcgcaagcgaagatctgatcagcgccatttctaaattcaccttgtgacgcggtctctatcagcctataatatggtaatatagacatgaaagagtgatatatgaatcgcatcaggggaggaaagcgcagtgaacaaaacggtaggatttatcggtttgggcgtcatgggaaacagtatggcatcgcacattttagaagcgggctatcctgttttagtctacacgcgtacgaaacacaaagcggaagaggttctgaataagggagcggtctggcaggagacggtcaaagacctttcggaaaaagcagacatcattattaccatggtcggctatccgagtgatgtcgaggaaatctatctcggtgaaagcggcattctccgtcatgcaaaagaaggggcgtttgtcattgatatgacgacatcaaaaccatctctggcgaagaaaatagcggagaaagccaaagaaaagtccattcacgccctggatgcacccgtttccggcggagacatcggcgcgaggaacggaacgcttgccattatggccggaggagaaaaagaagcgtttgaagcatgcctgccgcttttctccgttatgggggaaaatattcagtatcaagggccggctggcagcggccagcatacgaaaatgtgcaatcagatcgcgattgcagcggggatggtcggagtggctgaagcgatggcttacgcggaaaaatccggtctgaacccggaacaagtgctgaaaagcattacaaccggagcggctggcagctggtcattgtcaaacctcgctccccgtatgctgaaaggcgattttgcgcccggattttacgtgaaacactttattaaagacatgggcattgcccttgaagaagcggagctcatgggagaagaaatgcccggattggcgctggccaaatcattgtacgacaagctttccgcgcaaggtgaagaaaacagcggaactcaaagcatttataagctttgggtgaaataaaaaaaagattgcccgccgggcaatctttttttatttattttccgatgaattgctgtgtccagatgtttcctgattctacataacccacaccgatttgagtgaactcaggattcatgatgttctttctgtggccttcactgttcatccaagctttaacgacggcttcaggagtcgtctgccctttggcgatattttcaccggcagttttataagtgattccgaaagacttcatcatatcgaaaggtgagccgtaagtcggactttggtgatcgaaatagtttttgtctttcatatcttgtgattttgcgtgagctgatttgcttaatttttcatcaatctgcagaggttttaagccttgcttttgtctctctgcatttgtcaattcaacgactttcttttcatacgcactgactgatgaaggagttttctcgctgctgttgtttgtattatctgtctgctttgcattgtcagccgtctggttttgatcggctttcggtttttcggcagctgtcggggccgttttttccggtgtttctttttgaacgtctttaactgtcatatcagaatgctttgcgtgtttttgcagcagctgagtcagttctttctcatttttaacgttcagctttttcacgctcgttttcatatgtagtttttcaacagcctcttgaagagtcagatgctgtacggtgtttccttttttcacagtaacgacgtgctggcatgacagctcttttgcagatgcctgctgaatgcctccgaatgtaatcaaactgactgccgcggcggcagataagagaaatgcttttttcataagtttatagcctcccagagaagttgtttttttctacatgaaaaatcttatcacagcttttttgtcataatgcaggcagccatttcctttgacaacaaacgtttgtcataattgtaattgagcacagaaaaatggctttatatcagtaaaaacgatctgtatttattttttaaaatccgttacatctcttcaaattatttgaagtgttagatatattttaagataatttgatcttgacagttttttttacccgttttcgctgtaacaacttttacaaaaatgttacaattaaaatctgtttatgtaaatatattcaatgatttgagaggtgtaacagaaagtggctgaagtcgcgcgcgaaccaaagaaaaaaacgaaacgttacagagcgctgagaatgaatctctattttttgattgtgtttcttctctttacggcactgatttttaaactcggcatcgtccagattgtcgaaggggataaacaccgccaggatgcggagaaggcaaatgcaaaaaccgcctattatccgacaccgcggggaaaaatgtatgacaagcggaacagggtggcggttgataaccaggctgtgcctgaaattgtatacgtttctacctcaaaaacctcggcaaaggacaaattgaaaacggcaaaaaatctcgccgcactgattcatattgatactgaatttatgaaggatcgaaatatcattgattactggcttgcggcacatccgaagaaggcggaaaagcttatgaaggattcagaaaacagcctgaaatcccaagaagtgtacaaacgccagattgaacgcgttccgaagcaggagattgatgcgatcaaacaagataaaaaagagctgcaaattgcggcgatttatacgcgtttttcaagcggcaacgcctatcagccgcaagtcgtcaaatcaatggacccgaataagctgaacggaaacggaaacagcggttcattgcttgacgagcatgaaaacaacaagcaaaaaccaaaaagcgatctgacatatgaagaagtttccgtcgtatccgagcacctgaaagagctccccggcattgacgtgatcaatgactggacgcgaaaatatccatacgacaaaacgctgtactctctgttcggcggtgtgacgacaccggaacagggattgttgggcgaacggaaagattactatgtcacaagaggctactcactgaatgaccgggtgggaaaaagctacatcgaatatcagtatgaggactatttaaacgcgcataaagaaaaagtagagtatgtggaaaacagcaaaggtgaggtcgtcagccaaaagcccgtcgatgaaggcagcagaggctacgatctgcaactctcgctcgatatggaattacagtcgaaagtcgaaaaagtcattgaaaaagagctgagaagaagccgcgccgcaggcaactatatggttgacagaggatttgccgtcatgatggacccgaacaacggggatattctctcaatggcggggaaacgcatcgatctcgaaacaaataaaacacaggattttgcgatcggagcatttacgacccaatatgagatgggctcttctgttaaaggagcgactgttctcgcgggttaccaaagcggcctcccgcattataaaacgtttgtcgatgcaccgcttgtatttaaaggcaaaacgagaaaacaatcgtggacacaaatgggagccattactgagctgaccgcgctgcaaagaagttcaaacgtgtatatgtttcatgtggccatgcatatcgccggcattacctacaggccgtacggcacgctgcctgccggattagacgatattaaaaaaatgcgcaactactacgcccaattcggtttgggtgtgaagaccgggattgatcttccgcaggaatcagcgggcatgcagtcaaatccgcaaatggtcgggggattgctgcttgactttgcgatcggacagtttgatacgtatacgccgcttcaaatggctcaatatatttcagccatcgcaaacggcgggtatcgcgtccagccgcggatcgtcacaagcattcatgaaccggacagcaaaaataagattggaaaagcgattgaacagcgggatattaaaattttgaacaaagtaaataacagtccgagcgattttgaccaagttcataaaggaatgaaattggtcacaagctcacctcaaggaacggcttattcaacattccaaggttccggcgctgatgtttccggaaaaacgggaaccgcggagacgcactattacggcacgaacaaaaactggtgggggaagtacacgtataacctgacctttgtcggctattatccgtcagagcatccaagagtggcattcagcgtcgtcgttccgtctgttggaaatgataaagatcatgtaagcaaaaacattgctaagggagcaattgacgcttacaaagaacttgaaaagaaatacaataaaaaataacaaatgaaagggcggccgaacatctcgtgcgccctttctttcattcaggaaaattgacgttcacaataagaatagaaggagaatgctcattttttagcgaatcaatctagtggaatttctttttatatcagtccgtgtccagcctgcagtgcgagtataatgcaaaggagggattctgtggaacaggatactcagcatgtcaaacagtttcaatcgaaaaccgatcttcatgccgttttgacgtctaacgggcgtattatgtatatttccgcaaactgtaaatcgtacttcagttattctcaggaagagatgatcgggtcatttctcaaaacgttcctgcatgaagaagatcaatttttggttgaaagttacttctataatgagcatcatttgatgccttgcacctttcgtcttattaaaaaagatcataccatcgtatggcttgaagcgggtgtggaaattgtcacaccgcaaatggaggggacggatcgggaaatcatcctcaaaatcaaggtgcttgaggagaagacgccccgccggccttatatgtatgaacaaaagaagcaaaaggcagaacaacagtcggaagatgcggctggaaacggcgaattcgagcgtcttgttgaaatgctgccgaatcctttatatgtcagcatcaacggcacaatcgcctacgccaacaacgcgatgcttgccatgctgggagccgaaagcaaagacgaggtaatcggcaggcgctcctatgagtttattgaagaagagtatcacgacattgtgaaaaaccgaattgtgcggatgcaaaaaggaatggaagtcggaatgatcgaacagacgtggagaaggctcgacggcacgcccgttcatttagaagtgaaggcggcaccgacgacatataaaaatcagcgggcggaattgctgcttctgattgatatttcttcacggaaaaaattccaaacgattctgcaaaaaagcagagagcgttatcagctcctcattcagaattcaattgacacgatcgccgtgattcacaatgataagtgggtattcatgaatgaatcgggcatttcgctgtttgaggctgaaacatatgaagatttaatcgggaaaaacgtctatgatcagcttcatccctgtgatcatgacggcgtgaaacagcggatccaaaatattatcaaccgaaagaccgagtcagaaatcattaagcaatcgtggtttacctttaaaaaccggctgatctacacggaaatggtctgcattccgacgacgtttttcggagaaacggccgtgcaggtcattctgcgtgacatttctgagcggaagcagacggaggaattaatgctgaagtcggaaaagctgtctatcgcagggcagctggcggcggggatcgctcacgaaatccgcaatccgctgacggcgatcaaaggatttttacagctcatgaagccgacgatggaggaaaacgaacattactttgaaattgtgttttccgaactgagcagaatcgaattaattttaagtgagcttttaatgcttgccaaacctcagcaaaacgccgtgaaagagcgtgtaaacttaaagaaaattataagtgaagtgaccgctcttttagagacgcaggcgaatcttaaagggatttttatcaaaacggattacgaacatgacagcatgtatattaacggtgatcaaaatcagctgaaacaggtgtttatcaatctgattaaaaatgccgttgagtcgatgccggatgggggaacggttcacatcatcatgacagaagatgagtattccgttaatgtgacggtgaaagacgagggcgacgggataccggaaaacgtgctgaaacgaataggcgaaccgtttttgacaacgaaagaaaaaggaaccggcctggggctgatggtcacattcaaccttattaaaaaccaccagggagccatccaagtagacagcaaaccggacagaggcacggcctttcacattacattcccgaaacaataaaaaaaacaacggcgttatgccgttgtttaaatagtctgcatggattctctcgtttttaaaataaatgcttccagccggtccaagccttctctcaatgtatccagtgaatatgcgaatgacagcctcacatacccttcacccaactttgaaaacgagctgccgggcacaagagccacacctgcatcctctaaaagagccatactaaaatcaaacgatgacattccgaatgacttaatggaagggaagatataaaatgcgcctgacggctttacgacgtcaagccccattgaaacaagacggtcatatacatagtcaagccgctttttatactgttctctcataataagcgcatcatcaacaccgtttgtcaccgcttcaagagccgctttctgagagattgaagacgcgcatgtcacactgtattggtgaacttttaagatgtgcttggcaatttctttcggtgcgaaaatgaaaccgattctccagcccgtcatgctgtgtgattttgacaggccgttgatgacgatcgtctggtctctcaaataagacgcgatcgaataatgcggtctgtcataggttaattcgctgtaaatctcatcagacaggacaaaaacatttctgcccttcaggacggctgcgatgttttgcagctcttcctcagacaatgtcacaccggtcggatttgacggataaggaagaatgacgcattttgtttttggtgtcagcgattcttcaataagccgcgccgtcagcttaaatccgtgtgtcgtcgtatccacatgaaccggaacggcgcccgacatgcggatgatcggttcgtagcccggatatatcggtccggggagaataacttcatcgcctggagataaaatcgtccgcaaagacgcgtcaatcgcttggctcgctccggttgtgacaatgatttcagtttcagcctcataattcaaatcagcttttttcttcatataaagctgtacggcctgtctcagctcaaggccgcccgcgttcggagtatatgccgttgcgttctcgtcgattgcctttttggcagccgctttgacatggtgcggcgtgaagaaatccggctggccgatcgtaagcgaaatgacattatcgtgctgagctacaagatttgagaatttgcgaattcctgaaatttcaatttcttttacattcggattaagcaaatgttccataattcatcaccttatactatatattgagtttatcctattttaccactagctgagcatttgtcatctttttattgaactatcccgagtatatgtccgatatgtgaaaacataccttttttcagaaaaaaataagacaaccagctgaaatgattgtcttcattgtatcatgatctatctattgtgatatgtggcgaatgtcattaatacccgtattcaaagctgacgtcttcccgccataagatgtatggagcgggcttgtcgggacgctctttcgcctcttttttcatttgcaggtaagccgttttgctgatatcttctaacaccgtcatttgatcttggtcgaatatgactactgtacccatttattacacccttcttcctgaaaaatccttgactattttaccactcgatgtcaaaaagtcaatgggatatcagaaaaaagcatctttttataaagagttcatggccagttggcccgaatacattcactttttccgtttacagccgatatatacagtacaatactgaatgcggatagcgagggattgaattgtctttacaacaatacgatattttattggattcaggcacaaacgaattagaaatcgtcaaatttgaagtaggcgtcaatacatttggcataaatgtgatgaaagtccgggaaatcattcagccggtagatgtcacatctgtgcctcagtctcataaagacgtagaagggatgattaagctgagaggcgaaattcttcccgtcatcagtctgtattcctttttcggcgttgatgccgaaggagcaaaagacgataaatatatcgtaacggaattcaacaagcggaaaatcgtctttcacgtcggttccgtttcacaaatccacagggtgtcctgggaggcgattgaaaagccgacttccctgaaccagggcatggagcggcatttaacgggaatcatcaaactggaagacacgatgatctttctgcctgattatgaaaagatcatttacgatattgaatcggcatccggagttgagacttatcatgtccatcaggaaggatttgatgaaagacgggcgggtaaaaaactgatcatcgttgaagattcgccgcttctgatgcgtcttttgacggatgagctgactgaggcggggtacagtgaaatcgttacatttgaaaacggaaaagaagcgtatgattacgtcgtggaactgacggataacggagcaaacctgtcagatcatattgacatgattatcagtgacattgagatgccgaaaatggacgggcatcgtttgacgaagctccttaaggataacccgcaaagctctgatgtgccgattatgattttctcgtccctcattacggacgacctgcgccaccggggcgaagtagtcggagcggatgaacagatcagcaagcctgaaatcagcgagctcattaaaaaagtggatacgtacgtgattgaatagaaaaaagccgatgcatgacgcatcggcttttttgcggcggaattaaaaataactctcaccaagttttttaaatacgggtttatgataagcgggctgctgcctgttggcggcaagcggtttttcctttaagcccacatatttttgcaatacgtttttcgcttttgtcaaagacatttgtgctttaggattgcggtacgattgatttaacgtacctaaatgcggaagatgctggaagtcttcttttgttggaggcatgtgaaaatagtagtctccgatagagataagtacgtctgactgctgttggctaaacctgggattatttgaaaagtgaagccctatttttttccctttgccttctttcacaagcttttgtaatgcccgttttttcagcagataaaggtatttagggttgggggcggtttttgcatggcggttcacagtataaacagcttttgaaagattctcgatggttggctgcagctctttcgaataagcgtggtcgtccattatttctctcctttgcattgatcaagttcatatatagattatacttttttagcgttgaaatgcaaatattgattataaaaatacgcctttttctgatgaaaagggcgcatttttttcctttattagacaggtttcgcatgtttttcggaatcagcctttaatgattgctgcacatcgacctctgctgcctcggcgctgtatttcggaagagcgataaaatagaacacaaataccgctaaaatcacgattcccatgccgtaataaaggtaatcaatattggaaacgaatttcggaaataacagggcaaccagtccgagtgtaatcgattgggcaaacatcataaaaggatcctgccagccgctgacccggcccattattttcggatgaacgattttcggcatccagccgccgatggcgatattgacagggccgatgcacatgccgaggatgaaagccgccgcataataaatccacagcttatccgtatagccgaggacaaaaatgagcagtccggctgccaaaataggaatcgacatcaaatgatgcggtttgactttttttgcgatcattgttccgatcacacttcctgcaagcaggccgaagccgagtgcgacggtgaagatggaagtatgtgattcgtaatgatcaggcgcaagtccgtatttcatcgtaaacatcggcagtacggcaaagccgccgttgacaaaaccaaagataaaaaagccgaaaataagggaagcaagcaatttgtttttaacaatatatacgatcccttccttaaaatcagcgaccgagtctttcagaaacgaatctccccatttaaaagggccgttcggctgacgggcttctttcggaatgcggcaggcgcggatcagaaagcctgatacaataaagctgacaaaatcaaggataatggctccgtgaataccgatcgttttatacataaacgcgcccataccgacgccgaataccataaagatgctgaacaggatctggttaagtcccgccgctttcgcataatgctccttaggcagaatagcttgtacaaggctggcttccgccgggaaaaagaacttggtcacggcgcttctgatgaacaaaatacagaacacgagagggatgctcccggtgtataatgcggcaaataatacgatcgtcagtccggctctgatccaatcacaattctctgcgacctttttcctgtcaagccggtcagctgcgacaccgacaatcagaaatacgaaaactgtcggcagtgaatacatcagctcagccaaagttgtgtatgccggctggtttgaaaaatggtccagcaagtaaaaagcgaaagccatattacctacagtcgttcccatttgagaagcgagtgctgcgaaaaagagacggacaaaattgcgatttttaaatatatccataaacacgctccttaccctaaaggtcccactgtaatatattatcatcagctcgttccattaacaaataagatctttctatcttataatggtcacccttgttccattaggaacggtagcggcaagttcagtgacgtcctgattatacatccggatgcatccttttgataccgctttgccgatggaggaagggttatttgttccgtgaatgccgtaatgaattttagagaggctgagccaataagcgccgaacgggccgccgggcttgggctggcggttcacaatgtaaaattctccggtcggcgtggtcgtcaatatttttccgactgcgatggggtacgtacggatgagcctgccgaggcggtataactccagtttcttcgctccgatatacacgacaatggaatagggaatggtggatgggtcgggaagattcggtatgataatgtgctgtcccgcgtatatgaccgattggattgagggatttgcctgaaggagagcagcagtgcttattctgaagtcttgcgcaatgcttgagatggtttctccttgtttcacttgatatgtcagcagtttcgtcaccctcctttttgctcttttccatatacatattacggaggggatgtctgtgcatcgggataaaagtcttatttttgtacggttttcaatgtgaacagcgtgatttccggtctggctaaaaatcgatacggcagtcttgtcgtaccgagcccgcgattgacgtaaacggctgtgtcatgcagcgtatacatgccgtcggtatacgtttttccgtatggaggcgtaatgagagggccgaaaaacgggagctggacctggccgccgtgagtgtgtcccgacagctggaggtttacgggatatccgccgatcttgagagcggcatcaggctcgtggacgattaaaatggaaaacgcatcttcggaaaggcgggaaagggtgccttcataatcgggttttccgagcattacatcatccaaaaacgcgagttcaatccggcttccgtctgtcagctgcacctgacggcagccatttcgaagcacttgaaaatcagccgcttccatcagagccttgtacgtgttcgtaccgtagcctccgtggtcatggtttccgtaaacacaaagtttgccgaagggagcttccagattttgcagcacggccagtgcttgctggtgatcattaaataaatgcggcttatcaattaaatctcccgtaaagatgagcagatcgggtttcagctgattgatcttttccgctgctttattcaagtcaccggatgtaaacacatcactgagatgcgtatcgctgaattgaacgattttaaaattgtcaaagccgcgggggatcaggcggctggtgattgtatgacgggtgatctcaatcatgcgcggttcaatataccgggcatagccgtaacctccgcaagccgttgcgagagttgcacccaaaatgccgaatcctctttttaaaaatgttcttctcgtcattttctccatatgtaaaaccaacctttgtcagagttgttctattatatcatcagcctggctgaaaaatcccttctcagcatgtaatgacgcggaaagacatctatgataaaattatgaatgattattcattcaataaaaggggtgggtttgttatggataagaaagcggtaatcattacaggcggttcaagcggcatgggaaaagcaatggcgaaaaaacaggctgaattaggatggcacgtcatggtgacagggaggaaccatgaagcacttgaggaaacaaaaaaagaaattgagacctttgaggggcaggtcgcctgttttcaaatggatgtccgttctgattccgccgcttcagacatgattacagaagcgaaaaaagtctttggccggctcgatgcgctgattaacaatgcggccggcaattttatttgcccggcagagaagctgacgcccaatggatggaaagctgttattgagattgttttaaacggcacatttttctgcagccaagccgcggcaaggcattggatcgagcaggagcagaagggcgtcatcttaaatatggccgctacatacgcatggggagcgggagcgggtgtcgttcattccgctgcagccaaagcgggggtattgtcactgacaagaacgctggccgttgaatgggggagcaaatacggcatccgcacaaacgcgatagcccccggcccgattgaacggacaggcggtgcggagaagctgtttgaatcggaaaaagcggtgtcccgcactatgaacagtgtgccgctcggccgtctggggacaccggaggaaatcgccgctttggcagcgtttttgctatccgatgaagcatcctatataaacggggattgtatcacaatggacgggggcaatggctgaatccttacccgttttaatttacatgacatattttgcaaaacaagcgaacgttaaaggtgaccgttcgcttgttttatttttctattcaaaattatgatataatttttaaagattaagaggtgaataagtgaagaaattattaaaatggttcgttgtactatttgtaagcagtttcgttatcatctttaatatttggtactttatcatttgcgcttttactccggagtattatcaaaataccaatcttacatctgatgaaataatcagatttgaaaagctatatcatatagattttcctgatgaaacgaaatttattaaagccagggagtatttgagtgggctcggaggcgatacatcggctgtatgatatgtgtctctgccaaccaagctggcggaaacaattttatctgattatacgtatatgccaataaatcatactgatcatgccggttcaatgtatgaagttgacgtttccaagagtgctggcgggttaacaactcttacatttggcactttagataaaaaaggaactttctttcagttgaaacatgatgatgattggatatttaacagtactgattggagccattatttttggacagccgccggttatcatgctcttatatttatccttttatttgtgatggtgaaacaaatgaataacgtccttaattaaccggtctgaagagtgatcttaaaaagttttccccttttattttaaactgctgccatactgcctcctttttcccctaatctaaacatttgtggtgctgatataattgtgtataatcagacaaagatagagaagcaggtgataacatgttggacccacttgatatactgacgaatattgatgatgttattccgtattaccaagcgatttttaacgctgaggaacaaagagtcgtaggctacgaagtgcttggccgtattttggcagatgcggagattgagagcctcgggccgtttttcttagattccggcatcccggaagaatataagcttgaggtcgatgacagagtcatcaggcaggcgctggagcggtttaaagaagctgatcgcgatctgttgatttttatcaatcaggatgcgaatgtattgatgcttgaccacggcgagagctttcttgagcttttgaaagaatacgaagagcagggcattgaattgaaccgtattgtgcttgagatcaccgagcacaatttcgaaggcgacattgaacagctgtaccatatgcttgcctactatcgtacatacggcattaaaatcgcggtggacaatataggtaaggagagcagcaacctggacagaatcgcgctcctttcaccggaccttctgaaaatagatttgcaggcgctgaaagtatctcagccgtcaccttcgtatgagcatgtgctgtacagcatttcattgctggcgagaaaaatcggcgccgcgctgctgtatgaagatatagaagctgattttcagctccagtacgcatggagaaacggaggccgattttttcaaggttattatctgcaggcgccgagcggcgattttatagaccggagcctgttaaaagcacgcttgaaaacggagtttcagcaatttatcacgagagaaaaaaagaagctggagacagtatacgaacactctgagaatttttataagcgggtcaatcaggcagtttccgaactgaagaaaacccatcaggcggacgatgagtttattaaaaaactggcggaaaacctgaccgactgctgtttcagaatttatatgtgtgatgaagaaggctatcagctgacgggaaatgtgttcaagcagtccggcgaatggctttatcagcctgaatacgtggagaaaaactggagctggcgtccgtactttttagaaaacattatgaagatgcggaattcaagaaaaggctttttcagtgacctgtacagtgatattgagacgggtgagatgatcagaaccttttcatacccgatggatgacaatatgtatttatttatcgatctgccttactcttatttatatgaacaggacgggttactttaaagcggctgcagtatgccgcttttttttataaatgtgaaaaagttttaaaaaacgattgacaatgatagtgataatcattatcatttagttatagagagaagttactctctgttccccaacccctctatcagatcaagatccgaaaaagcttggcgctacccccgccaagtttttttatgctgtctgcgcataaaagggcttctccttacatacatctgacaatggcggctcaaaaagcgaaaaattatttttgaaaggtgtatgacattccgaaaaaagcttcaaactattcgaaaacacggttttcccgtttatttctttttgaaaatccagcgggaaaatgccatcccggtctactttatggtatgatgctctgtaggacttgtattataataaatacttgttgatttgaagttgttttttgaaaggagtctttttttagaatgtcacaattaatgggtatcatcacgcggctgcaaagtctgcaagaaacagcggaagcggctaacgagccgatgcagcgttattttgaagttaacggcgaaaaaatttgcagtgttaaatatttcgaaaaaaatcaaacgtttgaactgacggttttccaaaaaggtgaaaaacctaacacatatccgtttgataacattgacatgatttctattgaaatttttgagctccttcagtaatgtgatttgatttttcaggctgaccaagcttccggtcttccgcaagcggagctttattaaattatgcaaaggaacgtgcttgttcgtttggttgtagactctggaaagaggagtgtccgtacatggctgattcttttctgttttataatctttctgaggcacagatgacctttcaagacgtgacggagcggctgaaacgctttgtcaataaagacccccgttcagcatacgtgctgtctgtagggactgattcacaagtttaccgcgacttcacaaagtttattacggctatacacttgcaccgtacaggcaagggagcttggggctgtttgaaaaatcacgaccttgcaagaccgatacatagccttcgcgaaaaaatctcgctggaaaccgcgttcagccaggagatggctgcgcatatcctcgacggctgtcttatggaactgacagatttgctcttgccttttgcggatgaaggggcggatctttcatttgaagtgcatctggatatcggtcaaaaagggctgacaaaagaattgatacaagaaatgaccggccgcattacctcgatgggtattgaagcgaaaatcaagcccgattcctgcacagcattcagttatgccaatcgttacacaaaataatatttcatacagaatccgcaaaatgtcgaattatgcggttgacgatttttttctgtttacttattctagcggtagagctgaaagcaaatttcacattgctttcagaggtattcagttaaaaatagggggcctgattacgtatgagtcttatcagtgaacgatttacggaagaagaacagaaacttctgctgaatatcctgatcaatcaagaatatgccattgagcttttgaccagcgaaatcaacgatatagaagcagggtcaaaaagcgttgatgggaccacttataaaaaactcgtaacgctctatgaccgttttcggaacgaaaattaatcagcggcctataaattgatactcgattgcaaagagtatcttttttattgacggaaacttttcgacaaaaaatgataatgtttatattattgcaatatagggaatacatgctttgatgaaaaatgtaaaggggtcgaagtgacatgattagcttacaatcagatcagcttcttgatgcaacagtcggacaatttatgatcgaggcggataaagtggcgcacgttcaagtcggaaacaaccttgagcatgctctattagtgctgacgaaaaccggctataccgccattcccgtccttgacgcttcgtaccgtctgcacggtttgatcgggacaaatatgattatgaacagcattttcggacttgaacggatcgagtttgagaagctggatcaaattacggttgaggaagtcatgctgaaagacattccccgtctccacatcaatgatccgattatcaaagggttcagcatggtcattaacaacggctttgtctgcgttgaaaatgatgaaggcgtctttgaaggcattttcacgagaagagtcgtattaaagcagttgagcagtcatatcagatcattgaataagtaggctcgcacgatcagcctatttgttctttcgcatgccagaaaaagaaaacgcatacatacgagtggcgcttgcctcggcagcctttatttgattagaatggtagataaggaatacgaaaaggcattgaaaaggaggacgacatgcagcttcaagagcttcatatgctcgtagttttagctgaggaattaaacatgaggaaggctgccgaacggttattcgtgtcacagccggctctgtcccagcgattgcagaccattgaaaaaacctggggaacaaagatctttcttaggtctcaaaaaggacttacggtaacgccggcaggagaaaaaatcatacaatttgcaaatgacgtcacggatcggcaagaaagaatcagagaaaacattgatgaacttgagggtgagattcacggcacattaaagcttgccgtcgcctccattatcgggcagcactggcttccgaaagtgttaaaaacatatgtggaacgatatccgaatgcaaaggtctctctcattacaggctggagcagcgaaatgctgaaaagtctgtatgaagatcaggtacatatcggcattatccggggaaatccggaatggaaaggccggaaagattatttaatgaccgatcatttatatttggtcgatacggaaatttcctgtattgatgatattgcccataccgaccggccgtttattcaattcaaaagtgacagtacatattttcaggaaattcagcattggtggcatcaaaaattcaaaacctcgccgaaacagaccatccttgtcgatcagattgaaacgtgcaagcaaatggcgctgcacgggatcggttatgccattctgccgtcagtcaccttagaagaggaagataaagtaaataaaatgcccctgcttgatacaaaggaccatccgatcggccgtgacacatggctgctcggttatgagccggcatttgaattaaaacaggtgcaggcttttgtttctgtcattaaagatatgctgaaacaggaacgcccattttagaaagacagcaatcatgctgtcttttttttattttttattgacaatgaaaatcattatcatttaaagtgttatgtatgttaatgaaaatcattatcaattacgaggtgatcatatgcagaaagcattaatgatatacgcaagcatgtcggggaatacagaggatattgccggcattataaaagaaacactgagcgggcatcagatagcggttgactgtcttgatatggacgaagcagatgcggattctctcaaagcatatgattatgtttttgtcggcacatacacatgggggatggtgatcttccttacgaagcggaagatttttacgaagatattctgcacagccagctcaacggactgaaaacggcctgtttcggttcaggcgatcacgcctacccgaagttttgcgaagcggtcacgctgttttgcgatgcgtttgaacaggccggagccaatttatatccggaaacgctgaaaattgagctggcgcccgagacggctgaagatcaagaatgctgcaaagaatttgtccgcggttttcttgcatgggccgctcaccacggagaccggtgccatgtttcataaaggcgcgacggctgtcatggcatcagtatcttcaggattttttgtcgctgtgaaaggcgaaggtatttttcatttttcggcggaagaaggctggaaaagactattccgagtgaagagcaggattcatgtgctgacttatatagggccctacatattcgcggctggagaaaaaggcgccgtcctcagatcggccgatcaaggaaagacttggacggcctcccgatttccgaccagcgcctccgtatgggccgttgccgggcggaatgacggatttgtctgtgcgcacggcacatactgcatctacttatctgatgatttcggcgtcacttggcatgtggctaagcctttttcacaattaaaggagccgcctgtcatccgttcgctttgtttacacggtcagacggtttatatcggcacccggattcatatgaatcatggcggcatttgggcgtatgatctgacgacggaaggccgcatccggcgtataagccgcgaaaggcagcgcatgacggcttcaatgatgatgtatcagaatgactggctcattgcagcaaagggcgcggcaaagggagaacggggggagcttgctgtccgaaacgtgcggacgcatgaggagtttgccattacagccggggacaatgtacgggaaaaatcatttcttgacgtgtctgaggataacgggattatttatgtcacttcgtcacaggacgaaagcggattttcgcgtatttatcaagctgatctcgctgccggtgaattaaagtggtttgatacgatccgcggtcacggatggcgggtggccaaccgggaagaagattttttttgcgcgggcctttacgaaagtaagtttgtcagaccgtatgaggcggttcggctcgcacattagtttttatgcataaaggagagacgaagatggggaatgtattgcttgtttacgctacaatgtcaggaaacaccgaggcgatggcggatttaattgaaaaagggctgatcgaagcacaagcatccgtagacagatatgaagcgatggatattcatgccggactttttaatgattacgagtatattttattaggcacatatacgtggggagacggggatcttcctgatgaaatgctcgatattgctgaagatatggaaaaactggagtttacgggaaaaacatttgctttgttcggttccggagatacgtcctatgagtttttttgcggagcggttgacgaattggaaaaagtaatcacggcccgcggcggacgggtggtgctgccgccggtcaaaattgaaaacaaccctgagggcagtgaggaagaagagctccgggaattcggaagacagtttgccgcgctgtgcagccagccggcagaataaaggcttgttcctttttttcttgtctttgtatccttcctttgttacagtaatgaggtagaaaatcagaggaggacaatacatatgaaaatgatggatgcaaatgaaattatttcatttattcaaaatagtacaaaatcaacgcctgtaaaagtgtatgtaaaaggcgatctcgaaggaatcagctttggcgattccgctaaaacattcctgaatggccaatccggcgtcgtttttggcgagtgggctgaaattaaaagcgcaatcgaagaaaacaaagacaaaattgaggattacgtcattgagaatgaccgccgcaactctgcgatcccgatgcttgatttaaaagatgtgaaagcgagaatcgagccaggcgctattatccgcgaccaagtcgagatcggcgacaatgccgttatcatgatgggtgcatctattaatatcggttcagtcatcggcgaaggtacgatgattgatatgaacgttgttctcggaggacgcgccactgtcggcaaaaactgccacatcggagcgggttctgtattagcgggcgttattgagccgcctagcgctaagcctgttgtcgtagaagacgacgttgtgatcggcgcaaatgcggttgtgcttgaaggcgtaacaatcggtaaaggcgcggttgtcgccgccggagccattgttgtaaatgacgtcgagccatataccgttgtagcgggaacaccagcgaaaaaaatcaaagatatcgatgaaaaaacaaaaggcaaaacagaaatcaaacaggaattacgccagctgtaaggaatggtttgatagaatgggcgtggatgataaaatccacgccttattcttatctcaaggaggaatacatatggaaaaagagcggctcattgccatccgaagagatctgcaccgcattccggagatcggctttcaggaatataaaacccagcagtacctgctgaatcttttaaaccaatatccggaagaaagaattgaaatcgaaacttggagaaccggcatctttgtcaaaatcaagggcacggctccggaaaaaatgctcgcctacagagcggatatagacgctctgtcgattgaagagcagacggggcttccgtttgcatctgagcaccccggttttatgcacgcatgcggacacgatatgcacatgaccatcgcgctcggcattattgatcattttgtccatcaccccgtcaaacatgatctgctctttttattccagccggctgaagaaggaccgggcggagcggcaccgatgcttgaaagcgatgtgctgaaaaaatggacgccggatttaatcaccgccctacatatagcaccagagctgccggtcggcaccatttccaccaaaagcggattgctgtttgccaatacgagcgagctcgtcatcgatcttgaggggaaaggcggacatgcggcatatccgcatacagcagatgacatggtcgttgccgcgagcacgcttgtcacgcagctgcaaacggtcatatccagaaatacggatccgcttgacagcgctgtgataactgtcggaacgattaccgggggcacggcgcaaaatatcatcgcagagcatgctcatctggagggaaccatccggacgctttccgaggaatcaatgcgtatggtgaaaaagcggattgaagagcttgtcaaaggaattgaaatcggcttccgatgcaaaggaaaagtcacgtatccgtccgtttatcatcaagtttataatacaagcggcctgaccgaagaatttatgcaatttgtcagcgatcatcagcttgctgacgtgaaaacggcgaaagaagcgatgaccggagaagatttcggatatatgctgaaaaaatatcccggctttatgttctggctgggggccgattcatcccacgggcttcatcacgccaagctgaacccggatgaagatgcgatggaaaccgcggtaaatgtcatggtcggatatttttcgaagtatgccaattaaatccgaaaagaagaataatctaacaaaaattgagcattctacataacggaggtgttcaatatgacgaaaaaaattggaattgaacaatctttatcggatgtagaacaggcgttaaaacaaaaaggatatgacgtagtgatgatgaagactcctgaggatgcgaagaattgtgactgctgtgtcgtaaccggacttgacagcaatgtccaaggcattgccgatacgtcaactcaggctcccgtcattacggcttccggaatgaccgccgacgaaatctgcagcgaagtggaaaaaaaatttcattaaaaagaaaaaaccgaagcttacgcttcggtttttctattcggcggaagcggcgtttttaaaacggtcgagcgcgattttcatttctctccgcagtacgcgttcaacccgccattgctccatattttctgttttggcaatgattctgatcaccatttctgacgtgcttaaatcctgaaccccgatgacgtccggcccttccttaatctgcgggagctcagcggctgctttgtcacacgcggtttgcaggatttgaatggtttcatcaagatttttttcaagcggcactttaatatcgacaagcgcctgcatcgttccgcgggaatggttgctcacattcgtaatgccccggttggggagatagtgaagcgtgccgtcaaagctacggatttgcgtcgtacggagaccgacctgctcgacaatgccgctgtagccggcaaccgtaatataatcaccgacgtcgatctgtttttccaaaaggataaaaaatccggtgacgatgtcactgacaagcccctgagccccgaagccgacggcgagaccgaccacgccggcgccggcaatgagagcgctcggattgtagtgaaataaatccaaaatcattacgataaaaacgaaaatcaggatgtatccatacacattaagcgcgaggcttcgcaaagtataagcgcggcctgtggagaggttgttttgttgctcgaatttctgaaacagatgcttgatcagcttttttcctgccgtccggaaaataaaatacgctaaaataatgagagccagctttatgatgaaaatcccggcagatgtgagaagcccggcccaatcaaagtgttttaaatcaatcatagtgatgtcttcctttcaagtctattgaggaaaaagctaaaagtgatatacccgttttttaaataagataaaccttttcatagaaaccagttattacatttatgatttgttcatattgcccggtttcaatatcttcatttttgtgaagatatgaactaaggaatcgccacactcattttaacatggtgattcagccaaatcatttcctttggagggaaaacaggagaacgttgccaggcggactgaaagccccggcaaaaaacttttttcataaggagggaaataagatgaaattacatcagcaaatgcctgaattaacaggcgctaaagcatggattaacagagaagttacgaaggaacagctggtcggcggaaagccggcactgattcacttctggtccgccagctgccgcatgtgtaaagaagcgatgcctgaggtgaacgggtttcgtgataaatataaagatcagctgaatgtggtggccgtccacatgccccgttccgaagacgatcttgatcttgagaaaatcaagaaaacagcggctgaacacgatatctctcagccgatttacgttgacagcgatcatacgctggctgacgcatttgaaaatgaatatgtgccggcttattacgtttttgataaaagcggacagctccgccattttcaagcgggagagagcgggatgaaaatgcttgaaaaacgcatcagccgggtactttcagaaacggagcaggcttctgagtaatcgggacaatctccgccggactattgtctcggttctgcaaaccctttgccgttaggtaacagggtttttttgtggctattggataaaaaattccaatatggcatgtatggcttaaaaaataagagaaacagccgtaaacacgctgtaccgcttgttttatccatatcattaacttttacatattatagtcgaaaattgtagatatcacgctaattttcattaaacaagtaatttcaagttatattttgaaatggttcaataaattggaactttgtccagaatcccctatatgataagggatttttgtatataaagtaccattttcagaaaataagcaatttttcatagagtaaataaaatagtaaaatgataaaataatagttgataaaattacttttgtaatctaatatcttaataaaagcgtttaaatttttgacagggggttttacacatgtttaatgaaagagaagcgctgcgcttacgtttagaacaattgaacgaagcagaggtaaaagtcattcgtgaatatcaaatagaacgtgataaaatatatgcaaaactgagagaattagacaatacgggcagcctgtccgatacaaaaaaagagtttcgtccggagaaaaaaagtgactctctcccggtgcttgcagagcttgcagcacaggaaatgagaagctatcaaaagccgcagacacagccgcaatcctcccagccgcagatgcagtctattacgtctcttcccgccggcattccagacggttctacaagaagaagaagagggacggcgagaccgggatcaaaagcggcaaaactgcgcgaagcagcgattaaaacattgaaacgccacaatgcagcgatcaaaagttccgaactgcaaaaggaaattgaaaaggaaagcggccttgaaattcctaatatgacaacatttatgcaaagcttaattaaaatgtatccggaagtgaaaaaaccatatcgcggccaatatattcttgagggagaaatttctcaggaaacagcagaaacggcaaatgatacggctgctgaataaaacagtaaaaactgcttgcgttactcaagcagtttttttgcgttttcccgtttattctgcggaagtgacgcatcttttccaggctttttttcaagcttgacaacatatttttggaaaggcttttcgccgtcagctcgttctttcaacgcatccagtttttcatcaaacgactgatcgcgggactctgattctacaaattgtttttgaagggagatgacttgttcggtaacggctgtaagcaagtcttctgcctgaacagtctctttggaaacggaagggatttccagagtttgttccgccggttccgccgtgcggctgtcaatatcagcaaaatggccggcaatccaagcatcgctttcgtcaagctgccgtttatatgaaagaatggtttcttgaaataacttttctttcgttttttctatttctacaagccgttcttttgtttctagtattcgatctctcatatgattaatttctattttaatatgtttgagctggtattctttttctatcatttgtgtttggagccgggtattttcgtctgcagcggcatgataacgctgtttcatatcttcgtgagaagtccgttcggtttgaacggcggtctcaagtgagcggatgcgggtatgtaagtttttattttcttcttcaaattttacatttgtaagatgcagccgatgtttttcttccatctcatttttccgccgaaacgtttcctgctgaagcagttcttgcagaatgacgattttatcgagcagcccggccctgatttcatgcaaagaacgttccgtgtcactagtctgtttgtgtttttgcgccatggcttccaattcgtcagaaagcttgtgaagccgctctttaatattggcgttttcctcctgaagcttattgtttttttgatggaagtagcttgcttcaaattccgaaattatttttctgcatctggaaagttcggatttcaagtaaaggttctcttgagaagtgtcgtggaaaaacggacctgatattttcataagaaccatctccctcttgatgttaacactacaatatgggaaaggaacaacggctattcctcttaattaaacagacaagcaccgtaatattgtatttcggctgaggcgtttgctatgcttttatatagaatgggagagcgatgacatgaaacgggtgaatgtaatattagcgggggagcttcccgaagattcggagaaccgaaagcttttgcaaagtggaagggcggcatgttttatgaacaggcgaaaaaagccttcggcggcggagaaacggtaattatcagccgccctgagcatataaaaaagttcttatcaaacagggagcggcatgtttttgccgatgagccgcggtttcggggaatgggcccgcttgccggcatatatacggcaatgaaacaaacggaaggcgaaacatatacggtcatatcctgtgacacgccgctcgtgacaagaaaaacgatggctgcgcttgaaatgaagctgacgggaaatctggacgctgtcataccggtttgtgaaaacagagagcagcccctcttggcggtttaccataaacgggtgcaggatgtgctttttgatcagctgacacaaaacaaactgaaaatgacagacacgctgaaacggctgtctgtctgttatgtgcaggctgaagacatcggcgccgggccggaggagttcgctaatatcaacacacgggacgattacaccagacttttggcgcatgtcgagtcttcaaatcaggactgatcggtaagaaacatggtatgatggaaataaaaatgcaaggggacaacacagatggaagagcgctattcacggcagacaagatttaagccgataggggaaaaagggcagcaggcgctggctgacagcagtgtcctgattgtcggagccggagccctcggaacagccgcggcagagggccttgcaagagccggagcgggccgtatggcgattattgaccgggattatgtggaatggagcaatttacaaagacagcagctgtatacagaagaagacgcgagacagcgcctgccgaaagcaatggcggccaaggcgcgtcttttagcggtaaacagtaatatacatatcgatgcttacgcggcggaaggtacggcggaaacgctcgaaccgctgatcgaacaagcggattgcattgtggatgcgacagataattttgaaacgagaatggtcatcaatgatctggcgctgaaaacgaaaacaccttggatttacggtgcctgtgtcagcagtcagggaatgtgcatgacgattattccgggggttacgccgtgtttatcctgcctgtttgagcaaatgcccgtgggcggagcgacatgtgatacagcaggcatcatacctccggcggttcatatcgtctccgcctatcagcaggctgaggcgctgaaattgctgacaggaaatcatgcggcggtaaatcggcgctttttcacgtttgacgtgtggaataacaccaatatgagcataaatgtggatcagatcaaacgggatcattgcccttcctgcggcgcggagcccgtatatccgtatctgcagcctgaaaacaggccgaaagcaagcgtgctgtgcggaagagacaccgttcaaatcagatcggaagccttaaagaggctggataaagaagagcttgtcaaacgtctgaagcagatcggtaaagtggaagcaaatgaatttttgctgcacatggcgtacgagcgcttcagaatcgttatttttcaggacggacgggctctgattcacggtacaaacgatataaaagaagcgaattcagttctggccagagtgatcggactgtaggaaggggatgtattgctatgcttgaaaaaagaacgccgattcaggtggacgaagcagtccgccgggtgagccggtataaaaaaaagggggataccgaatgggtggcgcttgaggacagtctccaccgctatttggcggaggatgttaaggcggatcatgatgtgccggcttttaaccgttctccgtatgacgggtttgccatcagggcgagcgattcaaaaacggcttcccgtgacaatgccgtcacctttgaagtcattgaccatatcggagccggcgccgtgtcagaaaaagaactcgggccttatgaagcggtccgcattatgacgggggcgcagattcccaaaggcgcggatgctgtagtgatgcttgagctgacaaaaacgttttctgaaaacggcacgaattacatgtcagtgaaacgcccttttcatgcgggcgataatatttcatatcaaggagaagatgcgaaaaaaggcagctcgctattaaaaaagggacgaaaatcacgccgggcgtaaccgctcttttagcaaccttcggctatgcttccgttcccgtggtcagaaagccggttgtcggcattatcgcaacgggaaccgagcttcttcatgtcagcgatccgcttgagccggggaaaatccgcaacagcaacgctgccatggtgtatgcccaggtcattgaagcgggtgcagtaccgctgaacttagggaaaatttccgatgattttgatgacagctatgctgcggtgaaggaagctatgaaaaaagttgattttctgatcacgaccggcggcgtgtcagtcggcgattttgattttcttccggacatttataataagctcggagcggaagttctttttaacaaagtggcaatgcgcccggggagcgtgacaactgtcgcccgggccgatgacatgctgctgttcggcctttcaggcaatccgtccgcatgttatgtcggattcaccctgtttgtcaaaccgatgattcagacatggcttctgaatgaaaaacctcattccggatgggcggaagccgtgttaacaaacgactttccgaagccgaatccgtttacgagatttgtgagggcatttgtttatcataaggacggaaaaatgatggcgtcaccggtcggtctcgacaaatcaagctcagtcacatctcttgccgaagcaaacgcgtttatccttctgccgggaggaacgagggggtatgaagcgggccggacggttcacgcgctcctcatccgtgatgagaatggaagtgaatggccgtggtcaattctttcccgatcgtccagatcgtaggttttcaaaacagcggtaaaacaacgtttattgaacgtgtgctgaaagctgcgccgaaagagtgcgatattggatgtttaaaacatcacggacatggcggagaaccggaacctttttctgacggaaaagactcggagcgtttttcaaaagccggagccgcggttacggcagtagaaggggacggcgtcctgcagcttacggcgcgaaaaaaatgggatctggcgggtttgatcagtctgtatgaatgtctgggaattgacggtcttctcatagagggatttaaacatgcgccgcatccgaaaatcattatgatcaaaaacagcgaagattggcaaaagctgaagcatttggagcgcgtgatcgcggttgtcagcagaaatacggagcatatgccggcagatgcgggcaagcccgtattccatgcggacgatcctgctgccattatgtttgtgctttcgcagctgaaaggggaaactgcttaaatggaacgttttcaaattacaagggaacctatcattgcggaaaatatcgtaaaaaaagttgaaaagcgtgaagccggggccatcacaacgtttatcggcacggtcagagagtggactgcaggacggcggacggtgcgtctcgaatatgaagcgtatgaaccgatggctgttcaaatgctttctcaaatcggcagtgaaatcagcgcgaaatgggaaggagccgaagctgcaatcactcaccgtgtcggcgtccttgatatcggtgaagcagcggtcgtaatcgctgtgtcttctccgcacagaaaggcggcatatgaggcgaatgaatatgcaattgaacggataaaacagattgtgccgatatggaaaaaagaaatctgggaagacggggaagaatggataggcgatcagctggaaacaacgccctatccgaacggaaaaccggatttggataaaggggaatcgcgatgattaaagtattattatttgccgggcttgcggagcaggcgggaacaccggtcattgaacttgacgaaaaagagacggcagcgtctgctgtaaaaacgctgttaaaggaacggtacggccttcagacgattgacaatgccatgatcgcaatcaatgaaacatatgtaaaagacaacagcaccgtaacagaaggtgataccattgcctttatccctcctgtaagcggagggtgaaaaaagagccggatgtgcatcattgccatccggcttttttgtttataggcgctgaatttcagagaatatctaaatgggatttaaagggttttgcaattgaggcggttttcactgcatgaataggctgataacagtgcctttacaaggttttgagttacccgtcataccggtctgacgatgcttttttttacataattatggaacgtaaagctgagaatttgtgttacaatttagcataaatacgcaaacggcaaaaaaattgaaacttctctcagcctaaagcgtacgtataaacagaataatacataggaggcatcagctatatggaaccaaacctggaaaaaagcaatgcggcagtcacggaaaagccgtcaattttcggcgtcattacaagtcctgttgtgcagtttaaaagattaaaagaaaagccggtcatcggcatacctctcctgattgtcatcattctcatcgcggccggcagtattttgcgcggactggggatgaattatgaagaagtgctgaacagctcatctcttgacggtttgacggatgatcagattgaaatgaccaaaaccttcgctaaattcggcacgatgttcggaggaatcttcgggggcattatcgctctgtttatcgttccgctcatttactggctgtgcgtcaaaatgtcaggcggcgtgacaacttacaaaaaaatgctctcactcagcctgtttacggcgtttattaccaatatcggcttagttattaacggtcttgtcacttattttaccggtgcgggctcattgtacgccgttacatctttggcgagtgtcataccggccggagacggcgtcgcggtctttttaagcgcgttcgacattttcagcatctggagctatattctgctggctttgggacttcgctatacaggcggcatttcgaaaaaagcggcctggacttccgcgattgtcctgtttgttattatgcttttggtttcggcagtcggaggactgttaagttcagtgacagcaggtgtataacatgaaaaaaatttggatcggaatcggcatcgccgtaattgttgcagtatttatcggtatcaatatttataagtctgccgctcccgcgggcggcagcgccggaaaaaaaatcgaaaccggaaccatggaaaacagagaaatctcatctacggttatggttccgggaacacttaaattttctaaagaacagtatgttttttatgaagcagataaaggaactcttgataaagtgaaagtaaaagaaggcgacaaagtaaaaaaagggtcgtcgttagtcacgtatacaaatgagcagctcaaccttgataaagaacaaaatgagttgacagaacaatcaaaacggatgcaaatcgaacaagttgaagaaaaactcagagcattaaacagcaaggaacaagatctggcaaaacaagtgggagaagcggaagccaaaaaacaaattgaatccgaacggactgatctgcagcttcagcaaaaaacggcggaaatcgaattaaagcaatctgatttgcaaaagcagtctcttgaaaatcaagtgtcgaatctcaatgttaagagtgagatggacgggacggttatctcggtaaatcaagaagcggcttctaaaaaatcggatattcaagaaccggttatacatataggagacccggaacacctggtcgttgccggcaatttgtccgaatacgacacgctgaaagtgaaaaagggccaaagcgttacaatcacctcagacgccatccccggtaaaacgtggaaagggagagtggcggctgtcggcctcgttccggatcaaaagtcaagcgctgcttcgggggaaagcacggaacaagccgtccagtatccgtttcaggttaagctgatcggaaaccttccggaaggcaagccgggatttaaattaattatgaacattgaaaccgacaaacggaaagccgacacgctgccgtcctccgcagtcaaaaaagacggagatgagcactgggtctttacggtaaaagacgggaaggccaaacgcgtgaaagttaaagtcggcgataccgcaaatcagcttacggagataaaagaggggctttcaaaggatgataaagtcattctgaatccggctgacggtttgactgacggaacggatgtgaaagcatagatgattcagctttcaaaggtgaaaaaaagctatcagatcggcaaggagacgtttgatgttctccgttcaatcgacctgacgattgaagaaggagaatatgtgtcaattatgggaccctcgggatcgggaaaatctacgatcatgaatatcatcggctgtctggacagaccgacgtccggcaattacagtcttgcgggcgaagatgtttcttcatgcaccgaaaaagagcttgcggcggtccggaacaaatcaatcggttttgtctttcagcagtttcagctgctgccgcgattgaatgcaagaaaaaatgtcgaacttcccatgatctacgccggtatcggcaaaaaagagcgtgaggaacgggctgagcacgcgctggaaaaagtcggtttggcggatcggatgcgtcacatgccgaatgagctgtccggcggccagaagcagcgtgtcgcgattgcaagagccatcgtgaacgaaccgaagctcattttagctgatgaaccgaccggcgcgctggatacgaaaacaagcatttccattatggagcagttcacagagcttaatgcagagggcgtgaccgtggttcttgtcactcatgagcctgaagtggcggactgtacaaacagagtgattttcgtccgtgacggcatgatcgtttcccgcgattctgagcagaggagagtgggggaatgagcctgtcagaaaatctccggatggccctcagttccgtaagagctcacaagctgagatcgattctgacaatgctcggaatcattatcggcgtcggttcagtaatcgttgttgtggctgtcggccagggcggagagcaaatgctgaagcaatccatcagcgggccgggcaatacgattgaattgttttacatgcccagtgatgaagaattaacagccaatccgaacgccttacagcaagcgagttttacagaagaagatattaatggattaaaaggagtggacggcgtaaagcaggttgtcgcttccgcggtaaaatccatgacggcccgttaccatgaagaagacacggatattacgctgaacggcattaacagcggctacttggacgtaaaaaagctggacgttcaagatggacggacgtttacggacaatgattttctttccgggaaaagagcgggaatcatctcgaaaaaaatggctgaaaagctgttcgggaaaacgtctccgctcgggaaaatcgtctgggccggcggacagcccgtagaagtaatcggcgtactgaaagaagagagcggctttttatcgttaggactcagtgaaatgtatgtgccgttcaacatgctgaaaacgtctttcggtactaacgactacagcaacgtttccgttcagacggagtccgctgatcaaatcaaaacaacaggaaaagaagcggcccgtctcttaaatgacaatcacggtacaaaagaggcctatcaagtcatgaatatggaagaaatcgcggcgggaatcggtcaggtcacgaccgttatgacgacgatcatcggttcgatcgccggtatttctctcgttgtcggcgggatcggggtcatgaatattatgctcgtatcagtgacggaacggacaagagaaatcggcatccgcaaatcgctcggtgccacgagaggacagattctgacacaattcttaattgaatctgttgtgcttactttaatcggcggcttaatcggaatcggtctcggctacgggggagcaacactcgtttcccttatcgcaggctggccgtcgctcgtttcctggcaggtggtttgtatcggcgtgctgttcagtatgctgattggcgtcatcttcggcatgctgcccgccaacaaagcatcacgcttagatccgattgaagcgttacggtatgaataaccggcgccccatgcagtctgcatggggttttttgtgttttaatgattgaatgaatataatagacttttttcatttatgataaaaagaaaatgtcatacaattgtcccctttttgtcgaatttacagtttacaaaccctatgtacatacgttaatatgaacaaatgtgaaagattttgatagttattgaatgaatttgagtgattttagttgcttgaagtaaaaaaagcgtttacaattatcttgcagccgaaatgaatacgttttcaaaggaggcggaatatgctcactcctgaaaggtatcagctgattatggatcagattgaaaagcgagatgtggtgaagattcaagagctgataagcatgacaaacgcttctgaatcaacgatcagaagagatttatcaacacttgaagagcgcggatttttaaagcgcgttcacggcggggcgtctaaactttccaacagcaggcaagaacccgatatgcttgaaaaatcctccaaaaaccttcaggataaactgaagatcgctgaagaagcggcatctttattagaagaaggtgactgtatttaccttgatgcgggaacaactacattgcacatgattgattttatagatcatacaaaggacattgtggttgtcacaaacggggttatgcatatcgatgctttaataaggaaggggattcctttttatcttctcggaggatatgtgaagcatagaacaggtgcgatgatcggcggcgcctcattaacggcggtcagccagtaccgttttgacaaaagctttctcggggtgaacggcgtgcacattgaagccggctttacaacacccgatccggatgaggctcttctgaagacaaaggctgtgagacaggcgaaaaatgcgtatgttttagccgatccttctaaattcggcgagatttctttcgcagcgttcgccgccttgggcgatgcagctatcattaccactgaagctgaagaacttgcattcgatgattaccaagaaaaaactgtcgtaaaggtagtgaaaccatgatttacactgtaactctcaatccgtctgttgactatatcgttcacgttgaagattttgccgtaggcggtttaaaccgttccagctatgacacgaagtatcccggcggaaaaggcatcaacgtttcgagattactgaaaagacaccatgtgccgtcaaaagcattggggtttgtcggcggatttaccggaaattatatcacgtcatttttgcagcaggaaggtctggaaacggctttttctgaggtggatgaagacacgcgtataaatgtaaaactgaaaacgggcgatgaaacggaaattaacggacagggcccgacgatttcagacgaagtgttcaatgcctttttagaacagttctccgctctggaagagggagacatcgtcgttttagcgggaagcatcccttcttccctgccgcataacacgtatgaaaaaattgctgaggcatgcagaaagcagaatgcccgggtagtggtggacatctccggtgaagcgctgatgaaagcgacagaaatgaaaccgtttttgatgaagccgaatcatcatgagcttggggaaatgttcaatacggtcattgattcagccgaagctgccgttccttacggtaaaaaattaattgaacaaggcgctgaacacgcgattgtttcgatggctggcgacggtgcgcttttatttacgaaagaggcggttttcctcgccaatgttcctaaaggaaagcttgtcaattcggtaggcgcaggtgattccgtcgtcgcgggattccttgcgggaatttcaaaacagctgcctttggaagatgcgttccgtttaggagttgcttccggaagcgcgacggcattttctgaagaactcggaactgaagagtttgtacagcagcttcttcctgaagttaaagtcacacgtctatagaggaggaaagaaaagtgaagataactgagctgttaacaagagatacaattcatctcaatatagaaagcaaagagaaagaaaacgttatcgatgaaatggtgacagtgcttgacaaagccggcagattaaatgacagagaggcttacaaagcagccattttaaatcgtgaaagccaaagctcgacgggaatcggcgaaggtattgccattcctcacgcgaagacggcgagcgtcattaacccggccattgcattcggccgttcaaaagatggtgtggattatgaatcattagacggtcagccggcacacttggtctttatgattgcggcaaccgaaggagcgaacaatacgcaccttgaggcattatcaagactttcaacgcttcttatgcgtgaggaaatccgcaaacagcttcttgaagctgaatcagaagatgcgatcattgacatcatcaatcagcatgacaaagatgacgatgaggaagaagaagagcaggaagaacaggcagcgccgtcaggaaaagggaaaatccttgcggttacggcatgcccgacaggtatcgctcatacgttcatggcagctgacgcactgaaagaaaaagcgaaagagctcggcgttgacattaaagtcgagacaaacggctcaagcggtattaaacataagctgacggctcaagaaattgaagacgcgcctgcgattatcgtggcggctgataaacaggttgaaatggagcgctttaaaggcaaacatgttcttcaagtgcctgtgacggccggtatcagacgtccacaggaactgattgaaaaagccgttaaccaagatgcgccgatttacgagggcagcggcggaggatcttccgcttcaaatgaagacggtccgaaacagaaatcaggcacaagcatcggaagtactttctataaacacttaatgagcggtgtcagcaacatgctgccatttgtcgtcggcggcggaattctcgttgcgatttcattcttctggggaattcattcagctgatccgaaagacccgacatacaacacgtttgctgcagcgctgaactttatcggtgacggtaatgcgttaaagctgattgttgcagtacttgccggattcatcgcaatgagtattgcggaccgtccgggatttgcgccgggtatggtcggcggatttatggctacgcaggcgaatgccggattcttgggcggactgattgcgggattcttagccggttatgtcgtagtccttttgaaaaagctgtttgtctttattcctcagactcttgacggattaaaacctgtattgatttatccgctgctcggtatttttatcaccggtgtcctgatgcagtttgtcattaacacacctgtagcagcgtttatgaatttcttaacaaattggcttgaaagccttggaactggaaaccttgtcttaatgggtattattttaggcggtatgatggctatcgacatgggcggcccgctcaataaagcggcgttcactttcggtatcgcgatgatcgatgccggaaactatgcgccgcatgcggccatcatggcgggcggaatggctccgccgcttggaatcgcactggcgacaacattctttaaacacaaattctctaaacgtgaccgtgaagccggtattacgtgctacttcatgggagcagctttcgttacagaaggcgccatcccgtttgcagcggctgatccgcttcgcgtcatccctgcagccgttgtcggttctgcggtagcgggcggactgacagagtttttccgggtaacgcttcctgcaccgcacggagggatattcgttgcattcattacgaaccatccgctgctttacttaatgagcatcgtgatcggagcgattgtaacggcggttatcttgggaatcatcaaaaaaccggtagtagagaaataagcgaaaagcgtcctttacgggcgcttttttcaatcatatacgcatagaagcgttatgtattttgtgatgagttgtgataaagtaaagatggtacatgaaccgaaacagtgatcgtctaggaggaaccacgttgactgaagaacaaaaacctacttctgaaaaatcggtaaaaagaaaatccaacacgtattgggaatggggaaaggccatcattatagcggttgcacttgcgctgttaatccgccatttcctgtttgaaccgtacttagtggaaggatcatcaatgtacccgacattacatgacggtgaaagactgtttgtcaacaaaagcgtcaattatatcggagaaatcgagcggggggacatcgtcattattaacggcgatacatcgaaagtccattatgtaaagcggctcatcggaaaaccgggagaaacggtggaaatgaaaaatgacacgctttacataaacggcaaaaaaatcgcagaaccgtacctcgcgagcaataaaaaagaagcgaaaaaactgggagtcaacctgacgggagatttcggccccgtaaaggttccgaaaggcaaatactttgtcatgggcgacaatcggctgaactcaatggacagccggaacggcctcggcttaattgccgaaaaccggatcgtcggcacctcgaagtttgtgttcttcccgtttcatgatatgcgtcagacaaaataaaaacgccgcgctgcccgattcggacagcaggcgtttttatttggcaaacgaggccgcgacggcgatgaacaataccgtggccagcactgatccgacaatggccagaacgctgaaaaaaagattcacctgcttcttctctttgccgcgtctttcaagcatccgtttggaaaagagatgcgaaaacgtataaatgagggcgattccgacgtacaagccgatgtcacgtgccgtaaagcctgtgacggccagaaaaaccccggtgaagaaaatcataagacagtattctgtgagtgttaaaagcttcaacttgttcctccgtgatgaatatgtatatatatctattgtatcacagcgctccgggtttgacgcctgcatcttttcaaacccgtatattcgcagggaaacatttctcttcccctttattcatggtatacttttaatgatgatagacacgatggaggattctaaatgattgctgtaaataatgtgagcttgcgttttgcggatcgcaagttatttgaagatgtcaatattaaatttacgccgggcaactgctacggattaataggcgcaaacggtgccggaaaatcaacatttttgaaaattttatccggtgagctggagcctcagaccggcgatgtccatatgagtccgggcgaacgtcttgccattctgaagcagaaccactttgaatatgaagactgcgaagtgctgaaagtcgtcattatgggacataaacgtttatacgaagtcatgcaggaaaaagacgcgatttatatgaagcctgatttttcagatgaagacggcatccgcgccgctgagcttgaaggagagtttgcggaattaaacggatgggaagctgaaagtgaagccgctattttgttaaaggggctgggcatctctgaagacctgcatacgaagaaaatggccgacttaggcggttcagaaaaggtgaaagtgcttttggcacaggcgctgttcggcaagccggacgttctgctgcttgatgaaccgaccaaccacttggatctgaaagcgattcagtggctggaagagtttttaatcaactttgagaacacagttatcgtcgtatcccatgaccgtcactttttaaataaagtgtgcacgcacatcgccgatcttgattttaataaaattcaagtgtacgtcggcaactatgatttctggtatgaatcaagccagcttgctttaaagctttctcaggaagccaacaagaaaaaagaagagcagattaaacagcttcaggagttcgtggccagattcagcgccaacgcctctaaatcaaagcaggcgacatcaagaaagaaactccttgataaaatcacgcttgatgatatcaaaccgtcatcacgccgttatccttatgtcaatttcacgccggaacgcgagatcggaaatgacgtgctgcgggttgaaggcttaacaaaaacgattgacggggttaaggtgcttgataacgtcagctttattatgaacagagaagacaaaatcgcatttacgggccgcaacgaacttgccgttacgacattgtttaaaatcatttccggggaaatggaagcagacagcggcacatttaaatggggcgtgaccacttctcaggcgtacttccctaaagacaacagcgaatattttgacggcagcgatgcgaaccttgtcgactggctccgccaatactcgccgcatgaccaaagcgaaagctttctgcgcggtttcttaggacgcatgctgttctcaggagaagaagtcaacaaaaaatcaaacgtcctttccggaggagaaaaagtacgctgcatgctttcaaaagcgatgctttccggcgcgaatatcttaattctggatgaaccgacaaaccacttagatttggaatccattacagcgcttaacaacggcttaatcagctttaaaggcgctatgctgttttcatctcatgaccatcagtttgtacagacaattgccaatcgcatcattgaattaacgcctaaaggcattgttgacaaacaaatgtcttatgacgaatttcttgaaaacgcggatgtgcagaaaaagcttgaagagctatacgcgtaataaagaagcaggggagactctgcttttttatttatgaaaaaagttttcaatcttctgacttcccattacaataaaggaatacataaattgaaaagagacggaggaatgcatcatgaagtttttagttgtcggagctgggggagtgggcggatatatcggcgcgcgtcttgcagaaaagggaaatgacgttacatttctcgtccgcaagaaacgggcggaacaattacaagaaacgggtttgaccgtcaaaagtgcaaaaggtgatgtttcaatcaagccgaaattaatgttggcgggcgaagaaggagcatttgacgccgttatcatcgcttcaaaagcgtattctttgcaggacgtcattcgggatgtcaaaccgtttgtcaagccttcgtcggtcattattccttttttaaacggatacaggcactataaccagctgtttgaagctttttcaaaacggcaggtgctgggcggcctctgctttattgagagcgcccttaacgacaaaggggaaattcttcatacgagcgctgcccaccgttttgttttcggtgaatggaacggggagcgcacagaacgtatgaatgagctggaaaacgcatttgcaggcgtgaaagcggatgtcatcatcagcggggatattgaaaaggacatttggaaaaaatatatgtttattgccgcgcaggcgggagtgaccactctgtttcaacagccggtcggaccgattttagaaacagaaggcggccgcagcacggcaaagcgcctctttgctgaaatcggagccattttcaaggctgccggcatcccgaaagatcctggtctggaagaagagagttatcgcacattgacaagcatgtcttaccatatgaaatcgtcgatgctgagagatatggaaaagggcagggtgacggaaggtgatcatttacacggctttttgcttgagaaagcgaaaggcttgtcaattgatacacctgttttggaaaccgtcttcgccaacttgcaaatgtatgaagcgaaataaaaaggaggcctgatcgcctccttttttttattaaaatgcccagtttccgtttctgaagatcggttctcttttgccgtccgcggtaatgccgtcgatattcatttctttggaaccgaccataaaatctacgtgtgtaatgctttcatttaagccctctttgacaagctcttcccgtgtcatttgtttgccgccctcaatattaaaggcatacgcactgccgatcgccaagtggttagaggcgttttcatcgtacagtgtgttgtaaaataaaatatttgattgtgaaatcggtgaatcgtacggcactaaggccacttcaccgagatagtgtgagccttcatcggtttcgacgatgccttttaaaatctcctcgcctttttcagctttcacatcgacaatgcgcccgttttcaaaggtaagagtgaagttatcaataatgttgccgccgtagctaagcggtttcgtgctggaaaccgtgccgttcaccccgtcacgctgcggaagggtgaaaacctcttctgtcggcatgttggccatgaattcgtgcccgctttcattcacgcttcccgcgcctgcccatacatgttttttcggcagttcaatggttaagtctgttccttcagcctgataatgcagggcgctgtaatgttttttgttcaggtgttccactttttcatgaagattttgatcgtgttttttccatgctgccacagggttttcttcatttacgcgggttgttttgaaaatttcttcccataaaagctgaacggctgtttcttccggctgatccgggaacacttttttcgcccagcctgttgaagccgctccgatcaccgtccagctgaccttatctgattgaatatattgtctgtatgtatgcaatgcttttccggcggctttttggaacgctgcaatccgtttgccgtcagcgccttttaacaggtcggggtcggatgagacgacagaaataaacgcagccccttttttcgcgagctcttcttttccttttgcttcccattcaggatactcttcaaacgcttcaaaaggtgccatctcgtattttaatctggacagttcatcgtcctgccaatttacggtgacgttttttgcgcctttttcataagaatgtttggcaagcagtctgacaagttcccggacatcagttgaggcattgattacgacatgctgtcctttttggacattgacgccgacttctaccgccagctgagcatatgtatttaacttttcagtaaacgaactcatcgttcattcctcctcatcggtttttctcatcatatcaaatatcgcctcataaaggaaaggaaggagcacaaacgaaaaagacacagcttttgctgcgtctttacggatgattcagttttacggcgccgccggccggagaatggggcatattggccagtgaaatgctcataccccccaaaataattccgcttaaaatgacggctactgctacgcgtcttcccacatctctaagcatatgcttcctccttaatgtttctccagttctcacaatatgagccggccggagaaaaaagaagcacaatcttattatttaatcgctttttgcagcttgtcgatgacgtctaatgaacgtccagtgccgatagccactgattcaagcggatttgccgccaaatgaacgggaacgacgatttcatctgtcagccattctttcatcccgtttaaaagggagcctccgccggttaacacgacgccgcggtcaacgatatcaccgctgagctccggcggacaatcttcaagcgtcgctctgatcgcttcaagaatatgcaggagcgactcacgcatcgcgtgctgaatttcattagactgcagtctgattgtcttcggcagaccggttacgaggtcacgcccgcggatttccatcgtttccggcacatgttcgatcaatgcaaatccgatttccattttcacttgttctgccgtgcgttccccgatcagcaggttgtatttttttctgacgaacgaggcgatatcttcatcaagctggtcgccgccgattctgatcgagtggcaggatacgacgcccccgaatgagatgatggcgacttcagtcgtaccgccgccgatatctacgacgacgtttgcgaccggctcgtcaacagggaggtcggccccgattgcagcggctacgggttcttcaatcaagtgaacgtttttcgctccgcagtttttgacagcgtcactgatggcgcggcgttcaacggccgttgagcctgaaggcgtgcagacgacgacattcggtttgcggaaggtcattccgattttttttccggcttttttcataatgtgttttaataagtcagttgtcatatcataatcagcaatgacaccgtctttcatcggccgtacggcgacgattttccccggcgtctttccgatcatgcttttggcatccgttccgatggcaagcaccgctttcgttgttgtatctacagcgacaacggaaggctcatttaaaataattcctttatttttactgtaaacaagtatattagcggttcctaagtcgattccgatctcagttgattgaaacatgttttcacccaatccctatcctgatttaattgattctacatttaaagtttctgagaaaaaccacgatttttgggggtttccgccgggaatgaaatgtttttgtaaaaaaggagggaaagtctgtatcccgtatttcaaaaggctttcttttgtaaaaaacattcatttccggatgctgagaaacttttgctccgttcctttcgtctacgtttatgaaggattttccttggacataaagaagagacattaaaggaagtaggggatttctatgaaatcaattggtgtagtaagaaaagtagacgaactcgggcgtattgtcatgccgattgaattgcgaagagcattggatatcgctattaaagatagtattgaatttttcgttgacggagacaaaattgtcttaaaaaaatacaagccgcacggcatttgcttgatgaccggggaaattacctccgaaaatcaggagtacggcaacggcaaaattattttaagtcctgaaggagcgaaaatgctgcttgaggaaatcgaagaagcgttaaaagatagatcataatcagcaaaaagggcggggcatcattccgtccttttattatgaacttgtgcaaaaactcacgggaaaagtaagcgaacctgctcaattaattgggaatagttatcattttttagtcaataatgcagtcaacaatgttacaatatatgtagaaatgttagcggcaggtgggactatgggaaaatatcaagcgcgtatcatttccttaatcttggcaatgatttttattatgttttgggattatttattttatatgattgaacggaatccgattaactggcccgttgacatcacctttaccgccgtcacattaatcagcgtctggctgctggcttattatgtggacaataaaaagcagctgctggcggagctgaaggacagcgagcagaaagcaaaggcgctttcagatgagaaaaaccggatcatggacaatctgcaggaaatcgtttttcagacggattcacaagggaatattacatatttgaatcaggcctggacgacgattacgggccactccatcagcgaatgtatgggcacgatgtataatgattattttataaaagaaaaacatatcattgattatattatctcccaaatcaagcagcagtccccgtcaggaatgtttacggccaaatatattaaaagagacggcacgatcttttggggagaagtccattataagctgtattatgaccgcagacagaaatttgtcgggagcctggggacgatgtctgatatcagtgaacggaaaaaagcggtcgacgagcttctggaaacgaacgaacgccttgccatgcaatctcaaaagctggccattgccggggagcttgcggcaggaatcgcccatgaagtaagaaatcctttaacgtcagtcagcggctttctccagctgatgaaagcccagtatccggaaagaacggattatttcgatattattttttcggagattaaaaggattgatctcgtgctgggggagctgcttctgctcgccaagccgcagaccgtgacgtttaccgctcatcatctcaaccatattttaaggcaggtggcgacgcttcttgacacgaacgcggtgctgtcgaacactgtgattgagaaggatttcaggcagactgagtcctgtatggtcaacggtgacgaaaaccagctgaaacaggtatttatcaatattattaaaaatgcgattgaagcgatgcctgacggcgggaatattcatatttatacagaacgggatgaagaatacgcggtgatcagcatacaggatgaaggaaacggcatgtcgaaagaaaagcttgaaaatatcgggaaaccgtttttctccacaaaagatcagggaacgggtctcgggcttccgatttgtttacgaattctgaaggagcataatggtaaacttaacattaagagcaaaaatggagaaggcagtacgtttcaggtgattctgccgttagaagcggctgctgtccaaaaggaggaaaaataacttgcttctttttgtatacggtttgttacggaagcgtgaagaaaaccatgaactgctgaaaggcgctctatgtgtgtgcgagcaggccgcgataaacggtgtgctgtacgaaacggataaaggtcagcctgcggcgtctttagcagaaacagcttttgtgtacggggaattgtatgaaacagatcatcagatgatccgtaagctggatatgtattatgctgattttgaccggaaagaggttgccgtgacgacggatgccgggaataaaaccgccttcgcatatgtcgtaaagcccggccagtgtgcctcattcagccgtatcaaaagcggagactggaaagaataccgttttatgaaacgggaggatgacagtccggtttattatttcgcttacggctcctgtatggacaatgcccggtttaaacaggcgggggtcgaccacttctttgccgagccggtcggaggggcggttgttgaagggtattcgacgagattcacgttaaggcgtcctgacggttccagagccgatcttgttgaagacgggggacgaactgaaggcgtgctgtacaagctcccgtttgaagcggcaacctatctgtacaaaagagaaggtgttgataatcacacataccgtcccgcgttcatagaagtgtgtgccggcggccgtgtatacagaggcgtcctgacgtttctggttcttgataaagcggaggaaattgcgcctccgggtcactatcaggaagaaatcgaacgcggagcggacctgtatttatcacccgccttttcagaaaagcttaaacgctatatgaactcattgccgaaaatgtgatactattcctattagagatattgtttaaaggagtactgttatgagaaaagagtttgccgttatcggtctcggacgcttcggcggaagtatttgcaaagcattaagtgaagaaggccttgaggtcatggcgatggatattgatgaagataaagtaaatgaatacgccaaaatcgcatcacacgcggtcatcggcgattcaaccgatgaatcggtgctgaaaaacttggggctgcgcaactttgaccacgtcattgtggcaatcggcgaaaatatacaggcgagcattttaacgacgctgatcttaaaggaactcggcgtgaacacgatcacggttaaagcgcagaacgattatcatgagaaagtacttgcgaaaatcggggccgatcacatcgtccaccctgaacgtgacatggcaaaacgcatcgcccacaacatcgtatcaaataatgtgcttgattatttggagctgtccgacgaacacagcattgtggagatcgtggccaacagcaggcttgcgggcaacacactgcttgatctggacatccgggcgaagtacggcattaatatcgtggccatcaagagagaaaaagaagtgatcgtatctccgctggcgactgaaatgatccaaaaagaagatattctcatcgttatcggctctcttacggacatttcccgatttgaaaaaagagtgcttcatacaaagtgaaaagccgtccgtaaaaggacggtcttttattatgtcagaatagaaagacatttatcatgtaagcggtatattctgcaatttttattgactatgatcaggcgatccgatagcatattgtaccatataaagaaaaagaggaggccgcattttgaacaaagaaacactggctgaacggctgaatgcatcagccggcagacaaaaagccgataccgtcattaaaaacggaaaaatcatggatgtatttaaccaggaatggatttctgcagatatcgccattacgggcggagtgatcgtcgggctgggcgaatatgaaggggaagaagtcattgatgcagaaggccaaatgatcgttccgggctttattgacggacatgttcatatcgagtcctctatggttactccgattgaatttgctaaagccgtcctccctcacggagtgactactgtcattactgatcctcacgaaattgcgaacgtttccggagcaaaaggcatttcatttatgatagagcaggcgaaaaaggcgccgctgaacatccgtttcatgcttccttcctgtgttcccgccgctagctttgaacgctcaggagctgtattaaaagccgaggatttaaagcctttttatcaggagaaagaggtgctcgggcttgcggaagtaatggattatgtgtctgttgcggaaggtgaagaggatatgcttcagaaactgcttgatgccaagcgtcacggaaagcggatcgacgggcatttagccggactgtcttcagatatcatcaatatatacagaaccgcaatggtgtcaaatgatcatgaagtgacgacaaaagaagaagcgctggacagaatcagacggggaatgtacgtcatgctgcgcgaaggatcggtggcaaaaaatacgctcaacgtgctgccggcggtgaatgaaaaaaacgcgcgccgctttttcttttgtacggatgataagcatgtagatgatctgcttacagaaggaagtgtgaaccaccaagtcaaaatggcgataaaggcgggacttgatccattccttgcgtatcagctcgccagcttaaatgcggctgagtgctacggccttgaaacaaaaggggcggtagcgccgggttttgacgcagatctgctgttcatttcagatgtacgggaggctgccgtcacgaagaccatggtcgccggccggaccgttgccgagaacggacggacggtttatgaacagtctgccggttcctattcgccggaccaggcactgttggatacagtgcggctgaaagcgccgctgactgaatcggattttcatataccgattcaagagggcaggaaaatgaatgtaatcgaaatgataccgaatcatttggagacgagaaaaaaagaagtgcctgcaccgtctgctgacgcgtttcgacctgatacagataatgatttattaaaaatcgccgtcgcagagcggcacagcggcgaaaaaatgataggactcgggattgtacaagggttcgggttaaaagaaggcgccatcgccacaaccatttctcacgattcccataatatcatcgccgtcggtacaaacgatgccgatttggcaaaagcaatcaacaagctccgtgacaccgggggcggattaacagccgtgaaaaacggagaattgcttcactccgttccgcttccgatcgccgggcttttgtctgataagtcggcggaatgggttaatgacagcttgggcgtgcttcatgaaaagcttcctctgcttggattcaccggtgatttcaatccgtttctcaccttatcgtttttagcccttccggtgattccggatattaaaatgacggcggccggtctgtttgatgtcaaagcctttcagcatattccgctgcaataaaaaaactgcactcgtaatgagtgcagtttttttagacctccataatgatcggaaggatcatcgggcggcgttttgttttttcgtataggaacggagcaagcgtatcggtaatttcgtttttaatttcggaccactgcgttgttttccgatccattactttctccagatggtttgaaatgagctgctgcgcgtcattgatcaaatcaccggattctctcatatatacaaaacctcttgagattaaatcaggtcccgccgaaaccttaaagtcgtccatattgatgctgacaacaacgataacaaggccttcttctgaaagaatgcgacggtcgcggagcacgatattgccgatatcaccgattccgcttccgtcaatgtaaacggagcctgacggaattttgcctgccacagcggcttcttcgcctttgagggccagcacttcgccattatccatgataaaacagttttcttcaggtatgccgcaatcagtcgcgagtttgacgtgcattttctgcattctgtactcaccgtgaatcggcataaagaacttcggtttgatcaggcggagcattaatttctgctcttcctgtccgccgtgtccggatgtatgaatgtcattcaatgaaccgtgaatgacttctgcgcccgcacggtacagctggttgatggtgcggcttacgctgattgtgtttccgggtatcggagaggaagaaaagacgaccgtatctccgggattaatggaaatctgccggtgcgtcccgttagcgatgcgtgataacgccgccatcggttcaccttggctccccgtacataaaatcgttaccttattggcaggcatacgattgatttcgttatgctcaataaacgtatttttaggacaggtaatgtaaccgagattttgtccgatttcaatagccgattccatactgcgtccgaatacggcaacttttctgccgtttaaaacggctgcttcaatcacctgctgaagacggtgtatattcgaagcgaatgtcgcaaatataattctgccgtccacttttcggaaaatatcgtgaatgctttcgcctacgcggcgttctgacatggtgaaatcaggcacctcactgtttgtactgtcagaaagcaggcacaaaacgccttctttcccgatttcagccatctttgtcaagttggccggttcgcctaccggtgtgaaatcgaacttaaagtccccggtatgtacgatattgcccggcggtgttttgacgacgattccgtatgaatccggaatgctgtgtgtcgttctgaagaaggatacagacgtcttgcggaacttcacgatgtcgtcttcaccgatgatgtttaatttggtctgtcttaacagcccgtgctcttcaagtttattccgaagtaagccgatcgcgagtttaccgccgtaaacgggaatatttacttgtctgagcaggtacggaataccgccgatatggtcttcatgaccgtgggtgataaacagacctttaattttatcttcattttttactaaatacgtgtaatcggggattacgtaatcaatgccgagaagttcatcttccgggaacttgattcccgcatcaatcagtacaatttcatcctgaaactgcaccccgtacgtatttttcccgatctcgcccaatccgccgagggcgaaaacggcagtctggtcattttttacaaatttcattccgctcataactccaatactttaaaattttcgctctgcttctcatattctaaaaaagcaccgtccacaggctgaacaaattcaatgttgtatttctgatctttcagtttcgttctgacgtcccgttctgaaacgccctcaatgtaaagtgaatctgttttttcccgaacaggtacttcgtcagccttctcttgataaaataccttataaatcatccaaatctctccttaaatgccgtatgttagactcgctgattctattatattcgaaaacggattataaggaaagtctcgagcaaaaaagggactttcaaaaaccgaaagatcccttctatgcgatgacttttttccggagcattccgccccactgtcttctgagtttcttccgtaatcggcgcagcatcgtatacctcctttaaagccctttatagcagtagtatgcggaaaaaatgaatttgttttcgtgggtaaaactggaatttcatcaaggcggttttccggaagaaaaactttctgtatgatgatattgaaaaagacacgactgataaacgggaaaaaggagaaattgacatgaaaccaaaactgatcttttttgatattgacggcacgatctatgaccatgataaacatattcccgatagcgcaagaaacgccgtgacggcgcttaaagaggctggacatcacgtttttatcgccagcggaaggtccccgtttatggtaaaaccgattctggaagagcttgagattgaatcatttatttcatacaacggccagtatgtcgtatttgaaggtgaggtcatttataaaaatccgcttcctgaagatgcggttgcgcgtttattaaagcaggcggcagaaggggagcaccccgtcgtatttatggcggaagacacgatgaaaacgaccgtccccggacatccgcacgtctcggaaggtatcggcagtctgaaagcgccttatcccgaagttgatgaaacattttataaaggaaaagaaatttatcagctgcttttattctgccgcggacatgaagaaaaagcatatgccgcttttccggagtttgattacgtccgctggcatgaattgtcaacggatgtgcttccgaaaggcggttcaaaagcggaaggcattaaaagagtgcttgagcggcttccgtacggcgtaagtgacacttatgcattcggcgacggactaaatgaccttgagatgatccgttttgccggcaccggggtggcgatgggaaatgcggttccggaattaaaagctgccgccgatttcgtcacaaagccggtggatgaagagggaatcagctgggccgtcaaagaactgggccttttgaaataaagaaaaccggcactttgggaagtgccggtttttttaacggtcaatggcaatggcgttttcaggttctttgaacggattttctttatcgatatgatcgtaaaacatcacgccgttcagatgatcgatttcgtgctgaaacacgatggccggaaaacctttgaggcggatgtcaatctgttctccttcaagcgtcaccgcctttacgcggatgcgggcgtagcgcggcacatagccgggaatgggttcgtctaccgacaggcagccttctccgctcgtcaagtagcttttttccactgagtggctgacgattttagggttaaaaagagcatagctgtataaagtgcctttcgcatcttctgcatggacggcgatcatccgtttttttacgtctgtttgcggagcggcaagaccgacgcccggacgaagcttgtatttctcggctaattcaggattttggctgtttttcacaaactcaatcatatcagcaagatgctgtttttcttcgtcggaagcgggaagctgaacctcttcagcgatctctctgagcgcgggatgtccgtcgcgtacaatattttccatagtaatcaagaaacttcactcctaaagcttaatatgtaaattatagcgaatttctttatcgcggcgcaacgaaacaattggccggccatagcaggccggccgattttcatggtgtataaggtcagcagccgcagcctaaataagcggcaccgacgatgattaataagataaacaatacgacgattaatgcgaatgtgcggccatatccgccgccgcagccataaccgtaaccgccataaccgtatccgccgcagcaaccgccgccaaatccgccgccaaatccgccgccaaatccatatccgtacataaaaaaacctcctcttttaattacgctgaccctttgtcagcagggccggcgtctactataaactatgtaaaagccaaaaagatgtatggtcatccgccctgttttctcaattttttacgcaagtattctttgacagcaccgtaagcatctttttacccggtcatgccaattacagctcagctattgtcaaaaagcgttcgggcttctatagtggaaattgtcaagattgggggattttaagtgaatatgattcaaaaaaaggtattagcaggaatcggagcgctcggcgccgcaagtatgctgcttgcgggctgcgggggaaaagatccggttgaatcgcttcatgactcgatggaaaaagccgttcaagcggaaaaaccgtttcaaaaagagcagaaaacattggaaaaattggagaaaaaagagcacaagctttacgacagcgcggttaaactgaatatggatgattacaagaaaatcgtcacactgtctgatcaggctctgagcaatgcaaatcagcgaaaaaaacatctgaaagcagaaaaagacagtattgatgattcaaaaaaagcatttgaatccgcaaaaaaaacttctcaagaaataaaggataagaaagtaaaagaaaaagccgggcatgctgtcgctttaatggaaaaaaggtatgcatcttatgatcttttgtacaaaaagtacgaaaaagccatttcacttgatcaggacctttataaactgattaaagataaaaagctcacattatcgcagctggaagagcaaatcggcaaagtaaactcagtttacgaaaaagtgcataaacaagcagatgagttcaatcaatttactaaagactacaacaaagagaaagaactattattccgcgaatagtatagtgaaggcatatcggcatgggctgatgaactgataacaaccgagttcagccgcctgtaaatggcggctgaagaattggtatatacgtgtgtttcccattgacaacatgtaaatcatggtatagtatttatttagggaaatattcacataaaaccaatcgttgtttcggcacgttgggatgtttttattatattgatatataaaaaacagaatgaaaatgcggttttaattatcagaaaattctatctattatttgcggcaatatgatctttgtacatgctttttgcttttaaacctttatccggcataaaggtttttttattttgcttcgtaatgcttattaagtaatggtgccgggtgcttagagtaaatgacaattttaaaaattgaagtgaaaaatgttaaacaaatcacaatcggaacgaaaagaaacggcagaaatacggaacaaggaggaaaacaaatgcttgcttacgtctttcccggacagggagcgcagtttaaaggaatgggcagagacttattcgatgaattcagtgagctcattaaaaaggcagatcatattttaggatactccataaaggatttatgcctttcagatgaaaaagagaggctcactgatacgaagtatacacaacctgcaatttatacagtgagcgcactgcaatatttaaagggtttaaaagaaggtcatactcgccctgatgctgttgcaggacatagtctgggtgaatatactgcgctttttgcggccggtgtttttaattttgaaacaggtctccggctggttgctaaaagaggcgagttaatgagtgaggcttccgagggcggaatggctgccgtgatcggactggatgagcatcacataaaaaaaatacttcaaaagtatgaattcggccaaatagatatcgccaattacaatacatcttcacaaattgtgatagcaggggctgcagaagagataaagcgtgcagcctctttttttgaaaaagaaggggcgaaagcttatatcgtattgcaagtcggcggagcttttcattctcgtttcatggaaagtgcacagcgtgaatttgcggaatttatcggggagtttcatttttctgaattgaatttcccggtcatctctaactatacggcaagaccttataaacaagaagatatcaaacggaatttaattgaacaaataacaaactcggtgaaatggactgaaagcatcaggtacttaatgggacaaggcgtcactgtgtttgaagagatcggtcccggaaacattctgactaaattaattcaaaccatacaaagagatgaggaaccgcttaatattagtgcgccaaaagacagtctcttgttttctgaagggaacaaggacaattccgaaagcgggaaagagaagggcctcatggccgaaaatatagaaagcgttgcggcttcaccggtgtcccgattgggtgatcaatctttcaaagaagattacggtttgacatacgcgtatttggcaggtgcgatgcatagagggatctcttccgctgaaatgctgatccgcctcgggaagaaaggaatgctggggttctttggcacagcgggtttaactataagggaaattgaacaggcccttatttctattaaggagacactcaaaaatggccagccctacggaatgaatctgcgatttgagccggatcatcaagatagagaaaaggaattgatagatttatatatcaagcatgacgtacgggtaatagaagcgtcttcgtatctttccgtcagcgcgccattaatttattacaaagcgcatcagttgaagatggacaaaagcggcagggtcatacctcataatcggatcattgccaaagtttcacggccggaagttgcggccgcatttctgagtccgcctccccaaagtatcgtaaagagaatgtgtcagcacggtatgctgacggaagagcaggcggagtggctcagccgtgttccgtcagcagacgatatcattattgaagcagattgcggcagtaataccgaacagggctcattgacggcgatgctgccgttttttgttaacctgcgggatgaaatgatggaaacacataaatacgcaaggaagatcagagtcggggccgcgggaggaatcggaactcccgagtctgcggcgtctgcttttttaatgggcgctgattttattatgacgggatccattaatcaatgtacagttgaagccgcaacaagcggttttgttaaagaaatgctgagtgagacagaaatatgcgatactgcttatgcgccttcggagactctgtttgagttcggaacaaaggttcaggtgctgaaaaagggcacgctgtttccggtcagggcaaataaattatttcaaatctaccaacaatatgagtctttgagtgagatagatgaagagacaaagattcagctcgaaaatgtttattttaataagacttttgatgaaatctacgaaagcataatagaaaaacagccgaacctggcccaaaaagcggagcgcaatcaaaaatataagatgctgttactatttaagtggtatttgcagagaggatgtctgcttgctttggaaggggaggaagaacaaaaggtgaatttccaagttcattgcggcccgtctttaggcgcttttaaccattgggtaaagggcacggagttggaatcatggagaaacagacatgtcgatgacattggtgaaaaaatgatgaatgagaccgaaagtctgctaagacgcagattggatacgttatttctacactaaaaaggggcgggtggaggccaatggttcatttgaataaacagagtgcggatatcgcgataatcggggttgcttgcagattccccgatgcagatcattatcatgaattctgggaaaacataaatagcggcaaagattccatccgggaagtgccgattgaacggtgggatcccgatctttattactcagctgatatcagtataccgaacaaaacaatcagcaagtggggaggttttattcataaagctgaccatttcgaccataagttttttaatatctctccccgggaagcgaaaaacatggatcctgagcaaagaatccttttagaagaaacttggcggtgcatcgaagattccggggtctctttgcgggatctccagcgtaaaaccacttctgtttttgcgggtattatgaattctgactaccggcagacaggtcatgaatcggaaatcgacagttacgcctgtttaggaagtttcgaagctatgctctccaaccggctttcatacacattcggtttgaccggaaaaagcatgtctgtaaatgccgcttgtgcatcgtcgcttgttgctttacatgaagcggttaagtcattgcggacaaaagaaagcgattatgcaattgcatcgggagtaaacttgaatttccaacccggaaaatatatttctttttctaaagccagaatgctgagtcctgacggcaaatgtaaaacctttgacgcagcggcgaacgggtacgttcccggagaaggggcaggcgttgtattgctgcagcgccttggtgatgcagtaaaagccggtcaccatatatacgggatcataaaagggacggctgttaatcatggcggtaaatcccgttccataaccgctcccagagcagaagcgcagtgccgggtcatctcagaagctttacacaacgctgctgttgatgctgcgacggtttcttatgtagaagcacatggtacaggtacatctctgggcgatccgatagaaatagaagcattgacaaaagcatatcggcaatatactgaggatactcaatattgcagaatcggaagtgtgaaaacaaatatcggtcatacagaagcagcggcgggaatggccggattgataaaagttctaatgatgatgaaacatcggagggtgccgaaaagcctgaatgtacatacggtaaatccaattatacagtttgaaaaaacaccgtttaggccggcgcttgattcaagtgattggaaggcggcagacggggctccgctcagggcgggaatcagctccttcggttttgggggtgttaactctcacgtcatcatcgaagaatttatacatacaaatgacgaaactgacagaaaggtaagggctcccttccttttttccgctaaaagtgaagaaagcatgaaacaaatgatacataattggagaaccttttctgacgattctgaggaattttgcaaaatatcaaatgaagcgatcagcagcacccttttaacaaggacatcgtttgattacagggcgggtttattggcaggcagcaaggaggaatttaaaaatcagcttaaagagggattaagttttcggaggaaacatgattctgaatgggcgcttgccatcggtgacttcaaatgggaaagttataaacaatttgccgttttgaaacgcgtgttccctgatctagaaaagaacgtaaggtcggtgctgaagggtataccagcattgcacagttcatttaaaagaaaatggacgcctgagaaaatccgcttgtattctttagttatcaatacggaaatcataaaaagtatcctggcatccggttttaagccaagtctcattacaggcgccggagacggatattacgtcgctcttgcagcagcggatatcatcaaaattgaaaaggccatttctgtcatcacaggcgctgaaaaaccttcgcacttatcctgcgagccgccgtccattccatttgtcaatccgtacacttcaaaaacgtacccgccggttcgattaaatgaagaatatgtaaggatgctgctgaacggtctgagcttcccggctgattttacagaccgcctgtacgggaaaacacggctgcttcttgagcaccaatatacgtttaaagggtttttagaagagtgggataaagcgggaaagactcaggaaatcgagattttatcttatattgtgaatcgcacggcggataaaagaaacgcattgccggctgaagaggaagcggcgatcatggctatccttgcctctatgagaagactgtataagagatgggatttaacagattatgatggattctttgataatgattatgttctggaaatattaaatttactggatgaaggaatcttgtctaaagaactttttctgagcatgttattgaaaaagcaagacggaattaaacaggctgttgcttgtatgaatgagcagccggcaggtttttatgataaggcccgttttccgctgatgacagaatacaatcagatggatgccgtgtttcaggagatagctgaccatatgccgcttcacacggaagaaaagggaacggagccggatgtgaatatctctgatttttcagtttttcaattcggatcgctccctccatcagcaaaactaaacaaagcggctgcttttgaagcggacaaaccagctgatgaggctctttatcattcatttatgcaaatgtggctttcaggagaagagattgaatgggcgaaactaggtgattatcataaaagaaaagccccgcttccgccttatccgtttgagcgctctcaattttctttaaaccctcagccggtaaaatcagacgcggctttttcagaaaagaagaatcaggcactttatacgccggtatggaaagaaaccgcacttgagaatgaagcgggcagcggacaagcctgtactattttgttgttctccgggaataaagactattttgaagagctgaaaaaaagagagaatacgtccgcatatcttattatgcccggtgaccgtttagagcagataagcgacagtgttttcaccatcaacaggcagtgtcccgaagattatcaaggtgtcattcgtctgttaaaggaaaaaggcgcagcgcccgatgcaattttgcatacttggtctgaaaaacagcctgaactggaagaaacactcgcatcaggaatttattctgtgttttatctgactaaggctttaatcagcgagaaccttataaacaaagtaacgttcatttatacattcagcgcagatcaaaaagaaaaattgccgtattttgaaggtgtgaacggttttttaaaatcggtaaaacaagagtacccgcagctgcattgtaagacggtttgctttgaacatgattctgcatccgtttcatgttcagagaaggctgacattctttataaagaaataaacacagcgcctgatcggcatattcatatcacttacagaggctgcgtaagatatgcacggatgttagagaagcagagagaaacaaacagaaagaccattcaataccctgaaaaagataaagtatatttaattacaggggatttggggggattggcagtaaaatcgctgaatattgcgcgaaaactgaaagatccaccattatcctatcggggcgatctgttttaaacggagataagcagaaacatttagaatacctgaacagctttaaagccaaggtttattatatacaggcgaatatatccgataaagaagcggtaaaaaaaatgattgacggtattaccgatcagcatgcaggtcttcatggcgtcattcattgtgcaggagttatcagagactcgctgctttttcgaaaaacaaagcatgaactttcagaggtgattgctccgaaagttcatggcgcattgaatcttgatcatgcaacgaagtcgctcgaattagattttttcgccgttttttcttcagtcgtctctattgcaggcaacgaaggtcagtgtgattatgcatatgcaaacggctttttagatcattttgccgaatatcgggaacagaaacggcaaaattctctgcgcagcggccgcaccctgacaatcaattggcctttatggcaagacatcggaatgggggcgaacctgtcaggtcaagggcggacgtctctttttcatggttcagggctcgaagaacttcctgctgaagacggaacgcaatggttttcgcggattgtaacttcgggtcagctgcataatattgcagtctgcggtgatcatgaacgctttgaacaatttatgcagcagagatttttgacggacgaaacagagacaggcagtgccgttcctttggctcaaggcgatattttggatcagacagttttgtttttaaccaatatcatctcctgtgaggtcggtgcagaacgggaagagatcgatcaagatgtgcatctggctgaatatggaatggattccgttatgattcatcaatgcaacacaaagctggagcagtcactgggagcaatttcgaaaacgcttttatttgaatttcatacaatcagagatttagcagatcatcttgtaaaagaatacccggatcggctgggacgtttattttcacgggaggaaaaaggaaaacagattcagagcattacccccgccaggccggaacaaaacaccactgcatctgcggcggaggaaaaagaacatcttgacgggatagcggtaatcggtatcagcggccgttatcccggggctgaaaatatcgaagaattgtgggatcttctatcaaaagagagaacctcaatcacagaaattccgaaagaacgatggaattatgagacctactatgatccagatcccgctaaagcgcatgaggggaaaatttattgcaaatggggcggatttttaaagaatgctgaatcatttgattctttgtttttccaaatatcgccgagagaagcagaagcgatggatcctcaggaacgaatatttctcgaaaccgtatggaaagcatttgaagattcgggatataccattgaagggttgagaaagcagaccgaaaaacatgtcggtgtatttgcgggagttacaaccaattcttacaagctgctcggcgaaagaataccgacggacaaaaacgatgtacttccaaattcgttcccgtggtctctcgcgaacagagtgtcttacacatttgattttacgggtcccagtatccctgtagatacggcttgctcttcatccttaacggcaattcacatggcttgccaaagtttaaaaaaaggtgagtgctcggttgcggttgcgggaggagtaaatttgtatcttcatccttctgactatttataccggtgtcagatgggaatgctttcaaaatcgggaaaatgcagaagttttggagaaggcggcgacggtttcgtgcccggagaaggtgtcggggccgttattcttaaaccgcttaaagatgccatacgtgataatgatactgtgtacgccgtcataaaaggaacggcaattaaccatggcggaaagacgaatggctatacggtgcctaatcctgccgcacaggcggatttaattcaaggagctcttaaagcggccggttggagcgccagaagtgtcagctttattgaagcacacggcacgggaacgccgctgggtgacccgattgaagtccgaggtctgaccaaggcgttcagagcttataccgaagatgtttcatattgctctctcggatcgattaaatctaacatcggtcatctcgaagcggccgcgggtattgccggcctgacaaagattattttacaaatgaagtataaaaaaatagccgcaacactgcatgctgaacgggtgcatccggatctttatctggaagagacacctttttgtctccagcaggaaactgccgactggataaaacccgcgaatgaaaaacattctgacagcaaatatccgcggcgtgcgggattaagttctttcggagcgggcggggcaaatgctcatattcttgtggaagagtatgagtctgctgctgactgtcaaacggggcgtgaggaaagtgaagaacttatcgtactctcagccaagcattcactgagtttacgggaatcagcaaaaaagctggaggaatatcttcaaaaggctcgtcataagcagggcgagtgtttacagccggcgggaacaaataagccgcttcacctttctgatattgcatatacccttcttgaagggcgggaagccatgccggaaaggcttgctgtcatttcgaaaaatatcgatgacctgatgttgaaattaaatcacttttataatggaattgacgatcacgaaatattcagagggaaaaaaccgaatcataaacgcggacagcggcaatcggatcttccgctcaattccggcagaaccacattagccgacatggctgaattctgggtatcgggagggagtttaagctgggaagatttccgcaccggcagaaaaccggcaaaaattgcgctgccgacttaccctttcttaaaaaacagactgtgggtgtcaaataaggcgcaaacaacatcagcagccggtacagctcctttatttgatttttctgccggtgagtgccgattttataaaacgctttcagattctgaatattatttaaaagaccatgttgtgcatgggaatatggttctgcccggagcggcaatcatcgaagcggccagagaagcgggagagaggctgtacggaaaatcagtcataaaactgagtcaggttgtatgggcggttccgataaccgttgaaaaagaaaagacgataatgatagatctgctgccgaatcaaaaagacggcagatttgtggtgaaaaccgatatgcaatctgaagcggcagttcattgccaaggaaacattatgacatgcggagataaagacgcctctcatacagagcattttaaattggacagctggttaaccggacagaaaagattaatcagcggcgctgagtgttatagaaacttccggcagagcggtttggactatggagccggctttcaggtaataaaacagctgcttatccatgaaaatgctgttcttgcacgaatatcacttcctgagagcattgataaaaaatccggcgggctgctggaaccgtgtttattggatggcatttttcaatccacaatcgggtttacgtccggtcaggaagacgatcataccgcatatttgccttttgaattaggtgagctggaaattcttcaaccaccttcggcaagcggctatgcttacattacagctgccgatgaaagacaacatgatgatgtcaaaaggtttcatatactatttatggatgaacacggatctgtaagtcttaaaataaaaaacttagcgttgaaggcattaagggctgcaccgcagactcaaaatgagcggcattcagctaagtattactctgatatgtggaagcgggcccctatgcttcatcagcctgaaggcagcggtttaaacagctgccttgtaatttcactccgtcaggatatatcagaaccgctgatccgccaggcatataaagatatcggcctgaacatgatctttgtccgccatggcggaagttttcaagaaaaagaagctgattcctttgaattgaacagcgtcaaacttgaaggctataagaaattgctggcgattcttaaagaaagacaagtgacaattgaccgcgtcattttaatcgggatgagccctgaaacgggaattgagcataacattcatgaaaagctggaagaggctgttttgccggttttcaatgtaacgaaagctctgttagcaacaatcccaagacataaaattctgatatcacatgtatttttcacaaggaacaatcaaatcttaccttatcaaatggcaatcagcggcttttttaggtcgcttcatttagaacatccaatgttgtccggtaaaaatattgaaatacacagcgatgaaattcagttacagctgaacaccggtctgcctgaattaaaaaaccttgtgaaagaaacagtcatcagcgatgatgcttcagagatcagatacagagatggaatcaggcaggtgaaacactctgcagaaattgaaagggcagagcccccaaaaagatggaagtaaaagaagggggagtttaccttattacaggaggaacaggcggcctgggcctgatttttgccagacatcttgtgcgaaaagggagaataaagcttgtgcttatcggcaggtcagagctttctgaggaagccgtaagcaatgtaaaagagctcgaaaaaaacggatcagaagttttttatgtaaaaaccgatatttctgataaggaaaatgtcaacaacctgataaaactcgtcaaaaacaaattaggtcctgttaaaggagttattcacagcgccggtgtgataaaagattcattactcatcaataagcgtgaagaggatctcgattcagtcctggccagcaaggtttacggaacgatatggcttgaccggtatacagacagagaacctctggacttttttgttatgttttcatctatcagcgcaataatcgggaatgccggacaaactgattatgcttatgcaaaccggtttatggattactttgcggaaatgagagcggcggaaaataaacctggaaaaacagtctcgattaattggcctttatggaaagaaggcggtatgcaaattgacattcattcagagaagttcctttatgaccgtttcggaatgctgcctctgggaaaacgggaaggccttgcagcatttgatcaagcaatgacagggtgtgaacatcaaataatggtatttagcggtaatgaattaaagctggaacgaatgataacgattgacagcggaaaaagtgacccggcaatcgccgacgaaaatcacgaaccgaaagagctgtcaataactgaatctttaaaaagcactttgacgcgcatcatcaccggcgtattaaaaattgaagaacgggaatttgattttgaactgccgataagtgaatacggatttgattcaattatgtttacaatgctgggcaacgaattaaacgaaacattaggaatatcaatgatgccgtcagattttttcggtcttactgattttaatgaacttcttgagtttttaaagagtgagtattccgaagagcttcatctctgcggatctttttcttcagatgaatctgcggcgaaagacaggagagaaaatctgattgagggcatcgcaaagatgatgtccagtattttaaagattgacagaaaggaaatggaagaagagacttcattcggcgagtacggatttgattctattacgtttaccagactcggaaatgaaatcaatcaacaatatggtacggaattattgccgtccattttctttgaatgcaattcactggctgaactgactgattatgtaatcgagcaatacggagaaatcctttttgctgagacagaacctttttctgcagcagacgaaaaaacattgtacagcacgcctccgccggaatcctatgaacattcccctgagcctgaaaacaaaaccaggcaagaggaaagacatatgaatgagccggttgcaatagtgggaataagcggccgtttcccccaaacagatacgctggaagacttttgggaaggaattgaaaaagggcgggatatgattacagacattcctgaagaccgttgggactggaaagagtttgacggcgatccgatcagggacgtcaatagaacaaaaataaaaaaaggcggatttatcaaaggcgcggacagttttgatccgttgtttttcgggatttctcccgccgaagcagaattaatggatccccagcaaagaatttttatggagactgtatggaaaacaatagaagatgcgggctataagccgtcagatctggcagggacgaaaaccgcggtgtttgcaggggtcgccacaacggactatgcggaacgtctcaatgaaaatggcgtctctgttcaggcgcagaccgcaaccggtttaaatcattgtatattggctaatcgtatttcttaccagctgaacctgacgggtccgagcgaaccgattgacactgcctgttcaagttcattagttgcactccatcgtgcggctgaggggattcaaagaggcgattttgaaatggcgattgcaggcggagtgcatattatgacaagccctactctgtttatagcttttgataaagcaggtatgctttccaaagacggaaagtgcaaaacgtttgataaaagcgctgacggctatgtaaggagtgaaggggcggctgcagtactgcttaagccgctcagcaaagcacaggcagacggtgatcatatttatggtttgattaaagggtcagctgtaaatcacggcggccgcgccaattctttgacagctccgaatccgaacgcacaggcggacttattaaccgaagcttggcggaaggcgggggtcagtcccgccactgcgggatatatagaagcgcatggcacagggacaagtcttggcgatccgattgaagtaaacagcatcataaaggcatttaaaacgttatatcaagaatgggacattccttttgagaaacagaaaagctgcggaatcgggtctgtgaaaacaaacatcggccatctcgaaaccgctgccggaatagccggagtgctgaaagtgttactggcttttaaatatcgcaaacttccgggactcgcccatttttcagaactcaatccatacatcaaaatggaaaatacgccattttatatcacagaaaccgctcaaaagtggaatccgataaaagatgaagagaacaacgatctgccgaggagagcaggtgtcagctcattcggattcggcggtgtgaacgcacatattgttttagaggaatatagggaacctcaaaaagaagtaccggaaaacaacggtaaaacacacatttttgttttatctgcgaaaaccaaagatcaattacttgagtatatccggcttatggttcagtacttggatcgcgtgattgccggtgacatgaccgttaatgccagtgacatggaatttacattgcaaaacggccgggaagcaatgaacgagagaattgccgtatgtgcagtgagtctgactgagctgagagataaatacgtcagctttcttgataaaagcaaggtgcaaaatggcgtatttataagcgaaaacactgaagagcgtgcagctgtttctgaatatatgattcaggaggctcttcaaagcggaaaggaggagctgctcgcacaatggtgggccaatggagccgagtttgaatggaagaccatcggcaatgagaaattgaatagagtgccgctgccgtcttatccgtttgcaaaagagagttattggtttactccgaaaaagaacaaaggcgaggttaatagcaaaagtcttcacccattaatcagcgagaatgtctcaacattaaagaaacaagcatttaaaactgttatttccggaactgaatttttcgtcactgatcaccttgtttcaggagactgtgtgttgccgggagccgcttcgcttgaaatggctctagtttgtgcggaaataagcggagaaagtaaagtatataaaataaaagacgtgatgtggaacagacctatattatataaaggaaaaacgctgcacatttataccggcttggaaatgaaacaagataagttgaacgcaacgatatgtaaagagggcccggatggcgtgcagcaaatctgcacacaatgtgaaacagtattcggagacataaacagcaatcctgagtatgtcgatattgatcagttcatacgcagcagtaaaacggtcataagccggaaagagtgttatcaccgcttcagtcgtatgggcctgacatatcagagcggttttcaaacgttgaaagccgtatatcgcggtgatgtggagttaatggcagaattggagcttccggatcatttagcgaacgggttttcacattttacactccatccttcattaattgacggcggttttcaagcggctgcatttttgttaagagaaaatgagaaagacggcttatttgttccttattcacttagagagcttcacattaagagggcgcttactgcccgatgccatgtttcggtgagagaaaccggtttttatacgtataacattgattttattaacgagagcggcgaagtagccgtgagcatgaaagacttctctgtcagaaaagtgaccgggggagaattaaccgcaggtcataaaaatgaagatcaggaaattctcttcttattggaacaattgaaaaacggtgaactttctgctgaccaagtttatcagctgctggagggaaaatagtgcagatcaaacaaatactttccttaattgaagaacagcaaatgtctcctgatgcaggactggagctaattcgtacttacagaaaacaacaaatggaaaaaaaggcggagccggaatcacaagctccgtccccaaccattttttttaagaccgattgggtcaggacaaatcacattgatatgccgaatcagcaggcaccggggaatatgctgatttttgatcaggataaccgtctttttcagcatgccgagatgatgaatggagaacataaccgtgtcattcttgtaacgcccgattctgattacagaattgaacggaatagatgcacaatcaatccttctgatgaacatcatgtcgaaatgctgctgtctgatttggctgaaaacggatttacacctgatgtcgtgctttatttatggaatagagaaatcagagaattcactgaagaatctgttaatgaatctcttcgcagagggataaactcgctctttttattatcaaaagctttaatgcgaagaaacgaacctgttacgttattgcatatttattggacaagcggtctgaatcagccgtttcatgaagctgtcggagggttcgtgaaaacggtaaacatggaaagctccaagcttaaagcgaaaaccatacagatacgccacgaggattctgacataaatcctccggtttccgagatgtgggatgctgcaatcagtgaaatgcagcgcattcaaacggatgaatgtgagattttaatagactcatatacccgttatgtgaaagggctgcagcctattgatattccggaacacgataacggatctgtaacgtatcaaaaaggcggcatatatatcattaccggaggagccggaaaactcgggctgctgtttgcggaacacatcgctaatgaaaatcaagccgtgattatacttacaggccgttcttttttaacagctgatcaaaaagaacggatcagtatgcttaatgagagcggctctattgttgaatatcagcggacggacataacagatcgaacagaggcagagcgattcattttcggcattaaacagcggtacggcagcataaacgggatcatccatgctgccggcatccttcgtgattcatttcttgtaaataaaagtcccggtgattttacggacgtactgaaaccgaaagtttacgggacaatctggctggatgagctgacaaaagacgaagatcttgatttttttgttctcttttcttctttttccgcttacggaaatgccggccaaagtgactatgcgtacgcaaatcattttatggacagttttgcaatgcttcgatcccagctctctcgaaacggaaaaacactatcaatcaattggccgttattgaaagatggcggaatgagtctcgacagcagtggaatcgttcaaataaaagaaaaatacggaatgactccgatgcgaacttcctctgttctggaagcgtttctgaaaatgctgcggtcttcatttaccagcttaatgcctgcagaaggtgagcgggataaaatgataaaggcgctttcgattcaaagaaatacagctgcagcagatcaagatacactcacggcggaacacgatgaagaagcggaatatgctgcgaaagaaaaagtcaatgactatttaatcaagatcatcagcggtgtcttgaaaatccaagctcataaaataaatgcgaaagactcttttgagaagttcggaatcaactcacttatgatcatgtcacttattgcaaagcttgaagatactttcggggatcttccgaaaacaatcttttttgaatatcagaacattgaagagctttcaaacttcttcctaacatcttttaaagaaaaagtgcttaaggccgcaggggcagctccggtaacaagagtacagaagaaaagagaaaatccgagtaaaaaacagcaccggcagcagaaggatacacctgcaccgagcatggatcagccgggggaggatattgccattatcggtgtgagcggaagatatccgaattccgatactcttgaggagttctgggaaaacattgccggagggaaaaactgtattattgaaatccccgaggaacgttgggatttcagatcgaattacagtcccgacagaatggagaaggggaaaatcaacagtaagtggggcggttttatcagcggtgttgatcaattcgatccgctgtttttccacatttctcataaagaagctgagctgatggaccctcaggagcgaatttttctcgaaacctcctggcatacgtttgaagattcaggatatacaaaagagaagcttaacggtatgaaagccggtgtatttgtcggagccatgtacggacaatatcaattattcggcgcagaagaaactgcgcggggcaatccgattgcgctcagttccttcttttcatctattgccaacagggtttcgtacttttttaatctctccggcccgagcattgcactggatacgatgtgttcatcatcgctgacggccattcacttggcatgtgagagcattaaaagaggggaaagtgaaattgcgcttgcaggcggcgttaatgtatccatacaccccagcaaatacctttggctgagtcaaggtaattttgtttccaccgaaggattgtgcagaagtttcggagagggcggagacggctatgtcccgggagaaggttcgggagccgttctgttgaaacctctggaaaaagcaattgctgatcaggatcatatatacggagtgattaaaggaacatctgtaaatcatggcggaaaaaccaatggatttacggttccgaatccgaatgcacaagctgagctgattgctgaaaatttcaagaaatcgggcatcagtccgcgatccgtcagctacttggaagcacacggaacgggtacctcgctcggagatccgattgagatcgcaggattgacaaaagcttttgagaaatttacggatgataaacaattttgtgccataggttcagtgaagtctaatatcggacatttggagtctgccgcaggtatagcagcccttacaaaagttcttttacaatttaagcatcagaagttggcgccatccattcactcggaacagctgaaccaaaatatccgatttgaaaagacgcctttttacgttcagcagaaagaagaagagtggcggaaagaatcaggcgcctctaacaggagagcagcaatcagttcgttcggagcgggaggagcaaatgcccatgtcattgtggaggaatatcaaaaccatgcggacacacaaacaataagcggtccgtttgccgcagttctttctgccaaaaatgaagacagactgaaagaatacgcccggcgccttctgcaattcacagagcgggagacaacagcctcggcagctgatatcgcttttacattgcagacatgcagggagcctatggaagacagacttgctgttgtagcttccgatttgccggaacttaaggagaagctgagaactttctgtactgaaggaacaattggagagggcgtatacaaaggcaatgttacaaaagattttgataaagtctttatctttcatgatcaaaagatgaaagataaattcctcgaagtgatgatggagacaaaggacttgaatcttctagcaaaattatggtctttcggggctgatattcaatggagagagttatatgaagagtataccccgcaaaaggtcaagcttcctttatatccatttgctgaggagtcttactgggtgcctcgaaatcaaagcgcaatatttccggaaatattgccgcagcagtcttcactgcacccgcttctggattcgaatgaatctactctggaacagcagttttttaaaacgacattaagagaaaaagagatttggttaaaagaccacatcgtaaaaaacaagagcattctcccggcagctgcttttcttgaaatggcatgcgcagcgggaacgcggtcatatcgaaagaaagaggtcactcgtttaaaaaacgtgatctttgcaagaccggccatgcttttgcaagagagtctgaccatttacactcacatttccgtaaaagacggcaaaatattatttaatatgtcatctgacgaggatgctgctgtaaggactggatttgtgacgggggaattagattatgatcatcattacggtgatgatgatatagagaatatcgacagacaagagatgataaacagaagtgcttttgtccgtgaacaagatgaatgttacaagtattttcgggaaaacgggttcctgtatgggcgcgcttttcagccgattcaacgtttatggggcggaaaaacagaagcggttgcacacttattgctgccaaaagaagccgcatatgctcttgaaaattatacattgcatccgtctttaattgatggggctctgcaatctttgttcgggattacggacggaagagaagaggcatctgtttatgttcctttttcaataggagagattacgattcggaaaaaagtttcagcagaatgctgggcatatgcgcgtaaaacaggccaaaaaggtcaatccgagcttatttacgatattcagctgcttaatgaacaaggagaaagacttgcaggtttgaaggatgtaaccattcgtaaaaaagaaacgttttccgcggaggcacagactcgtgcaacagcggattccaatggaaagaacgagagagtaaaagagcttctcagacaattaaaagcgggcgaactgactgccgaagaagcagattatgcgctggagcatatgcaggattagtttatcattttgcggcagtgccatttgtaaaggggatgaagatttttatgaaagaagcccgtcatattagaaaaaaagtactttctgacatagaaagcggcatcatttctttggaagaaggagtaaagcggatacagcagcttggttctcattccgcagggggtaacggacaggcgatatattatcagacggtctggcagcggacagatctcagcatacatgtaaaaggcggccggcgtgagggcagccttttattatttgataaaaatgaagatgtgagtaaagaacttgctgcattgcatgatacaagggttattttggttaagccggggaaagagtttcgaaaaaccggggacggtgtatttgaaatcgacccccgctctgaaaaagattacataaacctgttaggatggcttatagaagaagagaagtcagatatacgggaagcggtgcatttatggtcagacatgccgtttgaaaaaacagagagagcaattcgtgaacaatgcgacagcggagtctattctttgtttttattacaacaggcgctcttcaaaaataactgccgcaaaccgatcaagctgttatatggatatttttcgcatctttccggagaacagcctctttacgcggcggcaagcggatttttgcggacattacagctggaaaatccgttaatctcagcaaaaagcattgaaatggagcagtcaatagcagccgttcacgcagctgatatcatacgcaatgagctgagtgatttccagccttcagatgtagagatccgttataaagacatgcagcgttatgtcaaacagctcaaaacgtatgaacccgaaaaaaattccggaagcggagctgtgccgctgagagaaaatggagtatatattatcgcgggcggcgcgggcggattaggatttacctttgcagaatatttggcttttcaaacaaaatgctgccttgttttaacaggtagatctccgctttcagatcatataagaaaacagctgaggcgattggaggatgccggttcttcagctgtttatgttcaggctgatattaccaataaggaagaagccgaatatgtagtcaaaaaagccaaaacttcttatggaaaagtaaacggggtcattcagggcgcgggaatcatccgggattctttccttcttaacaagtcacgagaggaattcgatcaggtaatcagaccgaaagtattgggtacgatgtggctgaatgatgctgttgagaaagaaaatcctgactttttcatttgcttctcctctacttccgcagtgttgggaaatgtcgggcaatctgattacgcgttcggaaacagttatatggatcattttatgaatatgcgttctgcccagcattctgatacgatttctctctctctgaactggccgctgtggaaagaagtcggcatgcaagtggatgagcgaacggtagagacaatgaaaaaggcgggtttttatcctttagaaaaagaagaaggtaaaaaagcgtttgccgtcgcattgtcctccggtttttcgcaattcactgtattttacggagatgagcaaattgacaatcatgttcatcaattatatgaacgaaaagacaatattcaggcagatgaaggaacagggagaaatatcgaatcatttgattcagagaaactgacagctgaaacatctgattttatcataaaaataattgctgcagaattcaggatgcctgcggacaaaatagatgcagaagaggcattggaaaaatacggacttgattccgttatgattatcaatatgacgaatgagcttgaaaaacatttcggcgcgctctcaaaaacgctgttattcgaatatcagactgcggcagaattgtcacagtatttcgttgaggagcacagggatactcttcttcataaactccggttaggagaaaacgggagcggcactccatctcagaagaaaaaagataataaacagacagccgatgttaacgggaaacagaaaatccagatgaaaaatcaggtgcagcaggagaagtatcatgacaatgatatcgctattatcggtatcagcggacgttacccgatggcaaatgatcttgatactctgtgggaaaacttattgaacggtaaagactgtataactgagatacctgaggatcggtgggattcgaggctgcactatcagcctgcggcgggcgacgaagtaaaaaaccaaagcaaatggggggatttattgacgatgtgtatcattttgatccgttgttctttaatatttctcctgccgaagctgaattaattgatccgcaggagagactgtttttagagacggtttggcacaccatagaagatgccgggtacgcaaagaaaacgcttgaaagaaaaaacgtcggtgtttttgcaggggttatgtacggccaatatcagctgtacagcgttggtcacgaagcggccgtttcttcctcatttgcatcaatcgcaaaccgggtatcctacttctttaatttcagcgggccaagtattgctttggacacgatgtgttcctcatcattaacggctgttcattttgcctgtgaaagtttaatcaggaatgaatgtgaaattgcaattgcaggaggcgtcaatttatccattcatcctcataaatatgaactcctgactcaaggaggatttttatccagtgatggccggtgcagaagcttcggttcaggaggagacggctatgtgccgggagaagggacaggtgccgtgctgctgaaacccgtaaaaaaggctattgccgacggtgatcagatttattcagttattaaggcaacagcgatcaaccacggtgctaagacgaatggatataccgtgccgaatccaaaagctcaaagtgaggtcattacgagagccttaaaaaaaggatgtattgatcccaaaagcatcagctatatagaagctcacggaacaggcaccgcgttaggagatccgattgaaatcaccggcctgaccaaagcattttcaggtgccgaacgcgataagaagacatgcgcgatcgggtcggttaaatcaaatatcggacatcttgaggctgctgcaggcatagcgggcattacgaaagttattcttcaaatgaaacataaaacgattgttccgtcactgactcattctgctgaattgaatgagaatataccgtttcaaaaaacacctttttatgtaccggacagagccgaaaaatgggagtcatccgttcccaggcgtgccggaatcagttctttcggggcaggaggagctaatgcccatgttattttagaagaatttgcggatgaagctatctctcctctcgcggctgaagaacctgaacagcttttatttgttttttctgcaaaaaatgccgacaggctggcagaatatgcaaaacgcgcaaaagaacaaatagcagccagagattattcattagaaacacttagaaatacagcatttactttacaaaccgggagagaagaaatgccgcacagattggctgttatcgcctccacaagagatgaattgcttaaagggctgacagactatactctcggaaatgcgagggatcatatttttacaagcggcaaagacacaacagaagctcaaaggacgaacaaagctgaaattgaagaatcagccgcaaacagggatcttgtgaagattgctgaatactgggttggcggtaatggagtagattggctgtcactttataaagatgtcactttgagacgggtatcagcaccgggatatccatttgccaaagagctatgcagaatagatgcgcaaaatacgggaagccgccggatgaacgtaaataacgatctgcatccttacatttcatgcaatatatctgattttaaagcccagaagtttcttatcaatgtaagcgataccggtttgtatataaaaacaaagtatcaagacaaggaaatgtttccgtttctcagccagattgaaatggcgagagctgccggagcgatggcttcagggaatccgattattaaattaactgagctctcctttagagaaccgatgttacaaagcggaagcaatgagcagatccggattgtattaaccccggataatcagggtgcatcgtattctatagaaaaacagagcgacttatccatttattcctcagggcggctcgaattagaaggcggggcgtacgagaacggaaatattcatcttgagccgttcctgtctcagggcgcagaccgtataccgtacgaagcgttttatcagcggcttgccgaattcggatacagctgcagtgacagtctgaaagccgcagagcactgcgtcagcaggaacggacaggtgcttttaaagataaaagcaaaggccgggccgaaagggtgcataatcaaaccggaagtgattgagagcgcatatcaagccgtcgtataccttgcgggggaaaatgccggagagaccccggaaaatattaaagaatgtacgatttttgatcatgagactgaacccgtttatgtatatgcagaacaaactgaagaaagcgattcggcttatgatgtgtatgtattagacaatgccggcgggattttgatggaactgagcgggctggtttttggcgaaaagcctaataaaaatgtacgtttttatgagcatgagtgggatcaaaaaaaccctctgattgaaatgaaagatagggagccaaaaacaattctggtctttgcaaaagatgaagcgttggctgaagctctgaaaaatcaatcagacagccgtgtcattctcgtcacgccggatcagcggcagaccgatcaaaatctgctgacattctgtataaacccggaagtgacgtcagattatattcgtttattcgaagaattggagaaaaaagggttttctcctgatgtcatcttgcacacgggagaaacattttacgcgggtgaccgccttctcagcggcctggaatcaattttttatttattaaaagccctgagcgcccgcagtgacgcctctctttatcttcattctctgcttcttgttcactcttttaaaaaaggcatgaatgatccgtatacgggcgctcttgcaggctgtttaaaaacggcaaatatgttggtgccatccgcagagaatgtgaagtcaatcggtttttcagaacgtatatcaattgaaaaaatggctgaattttgtcttaacgaaatggtttcaggcgtggaacggcaggcggaagaagttaaatatataaatgacaagaggtatgttaagacattaaaggagtatgtattcaatcatacagagcactctcatcagctgaaacagaaagggatttacctcataacgggcggtttgggcggtctgggcctgatttttgcaaaatatttagcctctcagtatcaagcaaaattagtattgacgggaagatcaccgttaacagctgataaacgacataacattgaccggctgcaggcgcttggaggagacgcggtatattatcaagctgatgccgcagatcaaaagacgatgggatgggtcatagaagaaacgaaacggacttggggatccattcaaggcgttattcattcagctggtcatgccgatgatcggttatttacagagatgaatctgactgattttacggaaggcatgactgctaaaattgaaggaacggtatgcttagatgaattaacgaaagatgagccgcttgatttctttatcgtattttcttctatttcttcggtcttcggagattttggacaggttaactatgcgttgggcaattattttcaagatcaatatataaattggagatccgaacagagccgcaggcaagagagacaaggcaagagcatttcgattaactggccgttgtggcgtaaaggcggaatgcatttaaacaaagaagctgaagacgcatatctttccgcatccgggtttgattatttggaaacggaagaagggatagcggcttttgagacaattttggcaagtgactgtccgcaaatttcggttgttaccggggatgccggaacaacaccagcaaaaaaagatctgccgcatcaaaaagtaaatacgcttccggttcgtcaagaggaaagttcttatagaggaccgggttctgcagacaatgtccttgaagaactgaaacaaatggtgtcggaattattgaaaattaacattgaacagctggatacggcagagaatttcggcaatctcggctttgattctatcagtttgaaaacattagctgtcagactgaataaaaaatacaagcttaagctgacacctgccgttttctttacttacagccatataaagtctctttcagaattcctaaacagtgaactgcgtactgttgcaaaagggaatacaggtgcagaaaaaaatatttctgaaaaaaggaaagtgcacgccgggaaaaccgcagggaaaaccgtgaagccgccgcgaagttttccgtttgaaaaaaagacagcaagacaggctgaccatcatccggagaagcagccggttgccattatcgggatgagttgtgtttttccgggagcaaaaaatgcagatgagttttggatcaatttaatcaatgaaaaagattcgattcaggaaattcccccggatcgatgggattggaaaaaatacgccgaaggcaaaggaagcagcgaagtacattcgaaatggggcggatttatcacagatgccgataaatttgatgaggcgtttttcaatattaatccgcgggaagcagaactcatggatcctcagcacagaatttatttgcaggaaacctggaaagcgatagaagatgcgggttacaaagcttcaaagctgtccggcaaacatatcggggtgtttacgggcattcaatttaatgattaccgccagctgctgatgaggcattcggacggggcgcatgcgtttgcgggaaccggaaacagccaggcgctcatcagcaatcgtgtatcccactattttaatttcagaggtccgagtgagtccattgatacagcctgctcaagcagtcttgtagcaatccacagagctgtgcgctcgattcaaaatggcgaaagtgagctggcggtagcaggcggggtttcgctgctcttagatccagtcacgcatatgtataccgataaactcggtattttgtctagggacggccggtgtaagacgtttgataaacttgccgacggttatgtccgcggtgaaggtgcagctgttctgttattgaaaccattgcaagcggcaatgaatgacagagacaatatttacggagtcctgagaggaaccggagaaaatcacggaggaagatctgcttcattgaccgctccgaacccggaagctcaggcagaactaataacgtctgtttacaaaaatgccgatattcctgttgatacgatatcttatattgaagcacacggaaccggaacagaactgggagatccgattgagattgaaggcttgaaaaaagcgtttggatcttttgagccgcatccaggaaagaatcatgaccaatattgcggcatcggttcagtaaaaacgaatatcggtcatttagagcccgcctctggaatgccggggctgattaaagtattactatccatgaagtataaaacattgcctgccacacttcatgttaaggagctgaacccttacattcaattaagcggaacaccgtttcatattgtcaataaaactatgaagtgggccagattaaaagatcgaaaaggaaatgaaattccgcgccgcgccggagtcagttcctttggattcggcggggcaaatgctcatgtcatcgtggaagaatttgaatacggacaagataaagcagtaactgccgagcgggatcaaatcattgttctatcggccaaaacaaaggaaaggctgatggttaaagccaaagagttaacagcgtttttacatgaagaactatcagttcaattcagtcagcaagaggtgcaggaacgtgatgtgcaagaggcggttcgggaagcggcagcgggtatcctgcgtttagataccgcaaatatagatgcaaagacacctctttcggaattcggatttgatccgttggcttattccgaattaatctcttatataaaccaaatgtacggcacagaaatatcactagatatatttcaggaattaatgaccctgagtgagctgtgccgctatatcagcagcgtctggaatcgatcagctgataaaccgtataacggcaattttagagaaaagtccggaatcggtcttgaagaaatagcatatacgctgcaaaccggaagggaaccatttgaatgccgccttgcgatcacttgctcgaataccggagatcttcttgaaaaattaaacggttacattcaggggagcagactgcaaggtgtttatgaaggaaatgtaacggattttgatagtctgtacgctcctttattcggcggccccgaaggtcatgcatatgttcaatcactgattcagcaaaacaagccggccaaactggctcagttgtggacgatcggttgtgaaatcagctgggaagacttgtatgaggaggaactcaaaccggttaaacggcctcttcctctttatcctttcagtaagaacagacattggattcatttaaataaagatgaagcgcagaagattgaggctttctcgaacactgagcttcacaattcaaataaagatacagcagatggagaaatcatgtcgcttcttgaaaaagcacaaacaggtgagatgaatacgaaagagacgtcagagctgatagaggagttgcttttccatgaatgaaaaaacgatgcaaattgagcaaatcgtgaaaaaggtgaaagaaggcagcctgacgcgtgaagaagggctggaattaattaagagtttggggaaaacccatctatatgaaatggtatgggatagacatgaatttaaaggcagtgaaaaattcccgaatacgaaagagccaattttatttttttgcaaagacgacagcatgtataccgtaatgaagagacagcttgaaggctatgaggcgcctttcatttacgtgacttccggcgagcgtttcgaagattgccggaacggtcgttttaaaatgaactttgcaaatgatgaggattatgatgcgctatgcggggttctgcgttctcaaaatataagaccccgccatattattcattttttagctgccgggctcttcaaaaatacagaagatgcaataagaaagcagctcaataaaagtctgttttccttgtttcaaatgtttcaggccttcatggcgaacaaactttgtccgaaagcagaagttttgtttctgtatgaaaatgccgagggcgaggttcagcccatttataacgcggttgaaagttttcttaagaccgtacaggccgaaaatccgaatttcacatgtaaggctgcagagctgaaatcaatgtttgacgagccgtttacaaagcagcatattgcagatgtcatctcttttgaatggaacaatcaatgcaagacggaccactttacctgttatgagccgaggcattattataaaaggcagcttaaaagagtaaaaaaagaagatggggagaaacatagtttcagtgtaaaaaagaacggtgtgtatttaattacgggaggagccggaggcctcgggtatctgtttgcggaatatctggcgaaacaggcggaagtcaagctggtattaaccgggcgttctccggcatcccgtgaaacggcgcaaaaattgagcgcgcttgaaaatctcggtgctgaagccttatatgtcccggcagatatttcaaaggaaaaagaggcggacgcgttaattaagcacattaagcagacattcggagaattaaacggaattttgcacagtgccggacttgttaaggatgcatttatcataaaaaaagcgaaagaaagcatagaagaagttatagcgcctaaagtattcggaaccgtttggctggataaagcagctgaagaagagcctcttgatttcttcgttatgttttcatccctttcggccgttctgcctaatgcgggtcagagcgactacgccttcgctaacggatgtatggacggattcacccagtatcgaagcattaagggacgtcccgggaaaacactttctattaattggcctttatgggatgcggggaatatgacagttggtccggcagagctgcaggctttaagacacacggggctggaacttttatctgcccaagcagggcttgccgcttttcaggacagtatgagccgttctgcttctcagctggctgttatcagcggagacaaagatagaataagtgaattactctcaactgaccataaaaagatagagactgtgcctgaaaacaacagtctgccgcaattaaatgaaaaagatctgaaaaagcaaacgatccgtctattgacagagatcgtcggtgcggaaacgggaagaccggcggacagcattttacccgaggatacatttgaccgttacggaattgattctctaacaattttaggtcttaactcccgtctcgaaaagtattttggaagagtgtctaagactcttttctttgaatacagcagtgttgaagagctgtcagagtattttcttgaacactatcaacatgagttgaagaaggcgtttttaccggcagccgaacagcgaattgatcattcggcgccggcgaaacgggagaagctttccgtttcccgcataccatccgcaccttccgaggaagatattgcaattatcggtatagccggccgctacccgatggcgaaggatgtggaacagttttgggaaaatatttcttccggaaaagattgtataacggaaataccgaaagagcgctgggattttcggaaatattatcacacaggtgacaatgcccgtcatgatagcaaatggggaggttttataaaagacgctgataaattcgatccgctgttcttctcaatttcgcctcgtgatgccgagttaattgatcctcaggaacggttatttttagagacagcatggcacacgtttgaagatgcgggttacacaaagaaaaagttgaaacggcataagacaggggtatttgtcggcgtcacctacagccactatcagttatttgcagccggtgcttcagatgatgagggacgtcaggcgctcttgtcttcttattcgtctatcgcaaaccgggtgtcatatttctttgacctgcacggacccagccttgcaattgatacaatgtgttcttcttcactttctgctgttcattttgcatgtgaaagtttaaaaaggggagaatccaccctcgccatagccggaggagtgaatttatccttacacccggataaatatactttactttcacaaaatcattttgtttcaagcgatgggcgctgcagaagctttggagcgggaggagacggatatgtgccgggagaaggagtcggggccgttcttttgaaatcgctttctgccgcaaaggctgacggggacaggatttacggtgtgattaagggaacatctgtaaatcacggcggaaaaacaaatggatacactgtgccaaatccgggcgagcaggcaaacgtcatcagtgaaactcttgataaggcggggattgatgcagacagcataagttatattgaagcgcatggcacagggacatctttgggagacccgattgaaatttcaggtttaaccaaagctttgcacagctcgaaaagcgattatcgttgtgcaattggttcggttaagtcaaatatcggacacctagaggccgcggcgggaattgcttctatcacaaaagtgctgatgcaaatgaagtataaacagcttgctccttcccttcattccgataacttaaatcctaatattgattttgaggaaacaccgttttacgtgcagtctgaattgaccgattgggagacgccgcaaaatcaagccagaaggtcgggtatcagttctttcggcgctggaggatctaatgcccacattatcatcgaagagtacaagaatgaagaaaagatggaaacggtacagagcaacaagacgcaaattattctgctttctgccaaaaatgaagaacggctcagactcttgattgatgcatatataaaagaactggagccaaaaacgtcactagctgatgccgcgtacacttcgcagaccgggagaaacgctatggaagagcggctcgctgttgaggttagcagccttgacgatcttcgcgataagctgacgatgtatttgcggtcagatcataagttaaacggtttatataggggaaacgcccgccgaggcgccggtcaaaagaatgccctgtcagccgctcactttgaaaatgcaagagatatggccattcactgggtgaacggaggagacgttgaatgggaagagatgtacactgcggaattaccgaagcttatttctcttcctgcatacccttttgaacggaacagatattgggtgcctgccgcaaaagcagcacagaaacagaaaacaggtgtaccgcagagtctgccccatgcaccgactgacttatcatttgatgtattaaaaaaatcgtggaaaaaacaaaaggctgcgccttccgcttttacgaaaggacaggtgatgatcctggctaatagtgaaagtgagcggcttgcattcgaattgtttgattcagatcctctgattgaacccgctgtcatttgcgcagataactgggatcattcggatggggaagccaaaaaaacggctctagcagtcatagaagaaaatccggaaatcatcggcatgattgacctgtcagatttgcggagtaatcaaaacggggcacgcaccggcacaatcgggaagctgacactgctgcaggaaatcataaagacacgtaaaaagcttttcgttttacatgtgacaagagggctgcagacacttctgaatgacaagccgtcgttagccggagccgaaacagccggactatataaaatgctgagcgcggagtatcaaaagataaaatcaaaaacaatagatgtagacgggcatgtcgggactgcggcggaactgagacaggtaatcacagatgaagcttgcgctgacgggctgtatagtgaaatctgctaccggaacggtgatcgttatattccatacgtcgagaaattaaatgcggcggaaataaaccggaacctatccggtctgccggtatgccgtacggatcaaaccttggttattacagggggaacaagagggatcggagcagaacttgccagacattatgccggcaagggagtcaaaaaacttgtgctgatgggagtaaccgaccttccggaatctgataaaatagccggcatgttagaagacaccgatgaaaagtcacctctttattcgaaattacaactgctgcatgagttggatcaaaagggagttcaggtggaagtgtattccgggccgctcacggaaaaagaaaaattacatcgcttcttttcagaggtgcgaatgaagttcggcaaaatcggcggggtgattcattgcgctggtgcagccaatcattcgaatccggcttttattcataaatctgatcaagaaataagagaagtatttgagccaaaggtgcaggggatgcaagtacttcatgacgtttttattgatgacgaacttgatttcttcattttgttttcatctgttgcgagcgcttttcctttattaggcgccggaacaagtgactatgccgcggctaacgcttttatggattactttgcggcgtatcagcatgcagccggcaaaacatattatcaatcaattaactggccgagctggaaggacattgggatgggcgaggtgacaagtccatcatatcaggcactcggtttactttcacactcaacagaaacaggtatttccatgctggatgaaatcatgacgataaacggatatccatgccttataccggcaaagacacatccggagaaattcaagctgaagcagctgcttcagacaagaattcaagcggctaaaaataacccggatgctgaggaaaaagtgatctctggtcatggtgacaatgaagctatgatcaggaagttaatggagattttttccgcggagctgaaaataccttacgggaatttagatcaggatacgtcttttgcggattacggagttgattcaatcttactggttcagcttgtcaaaaaagcggaagatgcatttcaaataaaaattgaaccttcggcttttctggagtatccgagtttttcacaactgggcgtctatttgaacgagttatttgcaagtgaggggatcagtcctcaaattgattcagaaaatattgaggttcggaataaagagcaacatataaatcaaaatgcttccgaagtacgggacagcggatctcaaatgcaaccaaccagtctgaatcaaatcgctattatcggaatgggctgtgagtttccggatgctccggacacagaaacattctggagaaatttgaagaaaggacaacatagtgtccgtgaagtcccggcgtcgcgatgggatatttcttcatactactctgacacctatgaaaaaggaaaaagtatcagtaagtggggcggatttcttcaagatattgagtctttcgatcccgcgttttttaatatgaacaaaagtgaggcatcagagcttgatccgttaatcaaaaaatgccttgaggtcagcgtccagacattgagagacggcggctatacaaaggaagaagtatcaaacaaagaagtcggcgttttcatcggttcgcgcaccgggacgtttatgtccaaaataggttccccttcaaaaaatacgatcgtgggtataggacaaaatttcataggcgcgcatatctcacacttttttaatctgaaaggaccgaatctggttgtagacacggcttgttcttcttcattggtcagcgtccatctcgcttgtcaaagcctgatgtcaaaagagtcagatatggcaattgcgggcggggttgacattttgctggatcaaaagccttacgtcatgctgagtgaggctcgggcgctttcacctgaaggaaaatgtcatacatttgatgagaaggcagatggatttgtaccgggagaaggatgcggcgcagtccttttgaaaagacttgatgacgcccttgccgaaggtgacagaatttacgcggtaattgactcctccgcggttaataatgacggacagacaatggggatgacaacacctaatccgaaagcgcaaagcgcagtgataaaaaaagccctgaaaaaggcggaatagatgcagatactctcagttatgtcgaaacgcatggcaccggtacgatgataggagatccgattgaattaaaagcgctgactgaagtgttccgggaggttacggaagaaacgcaattttgcggagtaggcagcgtaaaaacgaatttcggacatttaatgagcgcagcggggatagcgagtattataaaggttgccttatccataaaaaatcagatgctcccgccgacactacattgtaaaacgccaaatccgcgttttaaatttgatcagtcgcctttctttccgaacacgtctttaaaagaatggcgtcccagaaaagggattttgagagccggaatcagttcttttggattcgggggcacgaacgcacatatgatattgagcgacagccatctcacgttaggatatggagagacaaaaagacacccgctttctccggttatattcaataaggaacaatgctggatcgacaatggagaagctccagaaaaggaagagtcagaattgctgattcctttacttgatttcaaagaattataaagaaaagaaaaggaatgagacaggtggccagtaatcaaaactatcagttcacattaacaattaaacatacggactatattgtcagggatcaccgggtgcatggcacccggattatacccggtgtcacatttttagatatgatataccgtatggcgctgagtaaaggtttgcctattgaagaactcgagtgtcagaatattttgtatttggaacctgtagcaacatcggacacctttgacagagaaatccgcatccgttttcagggattggaacagggatgggaaatccaggcgaagagcagaaaggtaaaagatgaccggattctggatgaaagctgggatgagaatatgaactgcaggctcatgcagaaattcccggaaagcatgagttcaattcatatcgatgaaatcaaacatgcctccgtccgtgaagccgatatggagatatgctatgactatttaaaaaaggttgatatagagcattttgaatttatgaagagtctggggaaggtttatgcgtctgatcattctgtacttgcagagttgtcgctcagccaaattgccaaacaatataccggctattttcaattgcatcccacttttcttgatgcgtctaccatcatatcgatcctttatcaggcatgtcccgaatattttacacaaggatctccggcaagccggatgaaaacgtatattcccattcatattgaatctttccgtatgacgaagcgcctggaagacaggtgttatgtgtacatagagaagcaagaccaaaatcatgattcaggggatgtcatccaagtcagttacggtttgtacgatgcacacggggagatgatcgcttattttacacggctgtctgtgaaacatattcgctcaaaagatttaattgaaaatctgaagcagactcgtttagaaactgaagcggcttctcagccaaaagacggcctgatgagaaaagattcaatcatagatcgaagcgaaagcattgagacacaccttaaagaattaatatccggggtttcaaatatagatctgcgtgacataaggacagacattggtttttatgaacaaggcctggattccgcttctttgcttgccattgtcaaagaacttgaaaacaaaacaggggaacagctgtatcctacactcctgtttgagcagaaaacgatccgggaactcgccgcgtatattaaagaaaatcaaaaaatgtccagttatttcttaacgcaaaatcaaccggctgaaaagcctgacatgaaagaaagtaagaacgaaaatctttccgctcttataacagaaggagacattcagcagctgatcgcagacatcaaagggactgcccctgaaacactctctgtggtaaaaggtttttatgaacaaggcctggattccgtcacacttatgcaagccgtaaaggcattggaggagaaaacaggcagggaactgtaccctactttattgtttgagtatccgacgattcaaaaacttgcaaattattttgcggagagcggcgaaaagacttccgttgacaaagacctccctctacatcatggagagaatcatacggctctgacctatttaacgccgtattggagacaaaaggctgccgcttgggacccgcattgcggaaataaaaagaaaagaacatgtctgctgtttcaatatgacagagagctttttcattttatgcgggaaaatgctgaaaatggattcgaaaatacacagatcattctcgttttatcagggaatcgtttctcctatcacggagacggaatttatgagatagatcacagggaggaagcccactttgacaggcttgcagctgatctgaaaaaaagggggcaaatgcccgacaccgtggtgtacgggtggccggaaggatcatttgccggcccggaaaaaataagtgaacagctttctaaaggggcttacccgctattctttttcagccgggcattgatgcgcagcaaggcggaaaaaaaggttgtatcgcttttcctttatccggcggaccataaaaatgatcagccgctttacgcttcagtccatggcgcagggcagtctattttgcttgagaacccgaaactggcccttaagacaatcgggatatcagtttcagacaagacatcgttgccggctcttacagctgaaatcatcagatgcgaatcaactgaagcgcatccgggagaaaccgatctttattatgaaggaaatgtgcgctgggtccgtgccttacgggaagcagaaccggctcaaaactcagatttctcctttaaagaaaacggagtatacatgattacaggaggggccggcggcttaggccttatatttgcagaacatatcgcagcgcaaacgaaagccaatattattttagcgggccgttctgaactgacggaagacaaaaagaacaaaatcagccgaatgaaagcaggcggttcttccgttcaatatataagaggagatttttcagatagccgcgatgcagagcgaatcataaaaactattaaaaggaaattcggagaaatcaacggtgtgatacacagtgccggtgtgacgcacgacgctttattgattcaaaaatcaaaagatgaaattcaggaagtgatcgctccgaaaataaatgggacggtcttattggacagcttgctgcaaaccgaacctttggacttctttgtgatgttttcatcaagcagctcgatgtacgggaatatcggacagacggattatgcattggctaaccggttcatcgatctttttgctgagtggcgtgaaggaatgaggcggaaaaaagaacgctccggcgtctcagtagccatcggctggcccctatgggaagacggcggcatgaaagtggataaacaaactgaaaaatggatgaaacaaaaaatcggtatggttccccttagtaaaaccaatgggatcaaagcttttcaagattcactctctatgaacgcatcacagctgatcgtgtttgaaggtgacaaagaaaaattggaatctgcacttcaagataccttcaaggaggatgaaagccgtgagatccaaataaatgaaacagctgatacaaggcatcaagacattgccattatcggtttaagcggaaagtatccgatggctgaagacttacctgaattttgggagaatttaaagagcggaaaagattgtattacagaaatcccgcctgaccgctggaatatagatgatttcttcagcgaagacagagatatgaaagggaagtcttacagcaagtggggaggttttatcagcggagccgatcaatttgatccgcttttctttcatatttccccaagggaagcagaacttatggatccccaggaaagactctttttagaaacggccaaaaattgttttgaagactcagggtacccgagaaacatgctggaaaagatgaaagtcggtgtatttgtcggtgcaatgtggggccaatatcaactatttgaaggagaagaaaatggagcggctttttcgccggcttccgtctattcttcaattgccaatcgggtgtcttattattttcatttaaaaggtccgagtttggctctggatacaatgtgctcttcatcattgacctctattcattacgcatgccaaagcatacattgcggagagagcgatatggcattagccggcggagtgaatttgtcaatacatccgaataaatataagttcctcagcatgggacagtttctatcaagtgacggcagatgccggagttttggaaaagacggaagcggttacgttcccggtgagggagtcggagccgtattgttaaaaccattgaaaaaagcaatagaagatcaagatcaaatatacggcgtgattaagggaagcgccgttaaccatggaggaaagacgagcgggtattccataccgaatccggatgcgcaggcggaggtcatttcagaagcgcttcgtaaagctgacattgatccgaacaccgtcaattatattgaagcgcatggaacagggacatcattaggcgatccgattgaaattcaaggactgaaagattcctatcaattgaaccatccttgcgccatcggttcggtgaaatccaatatcggacatttagaatctgcggcaggaatcgctgcggtaacgaaagtgcttctccaaatgaagaataagcagcttgttccttctctgcattccgatattgttaatccgtttatagattttgatcaggttccttttcaagtgcagcggaaagcggctgaatggaatattccgcaaaacagccatgctgttcatcctttgagagccggggtaagcgcttttggggcaggaggaacaaacgcgcatcttatattggaagcgtatgaaccgccaaaagcatttgatcatcaaagcggccgagtgatctttgttttatcggctcaagacaaacaacggctgataaaatatgcaaaggttatggctgattttctatcagaaaatgaatcgaaggataacaatcataaactgcgtcttcaggatattgcctatacacttcagacgggacgcgatcatatggaagaacggctggcgatagtggcagattccgggcaggtcattgctgaagagctttcagcttatatcaggggtgaaaaaagcagcctgagccataccggtaatacattcgaatcagaagttcacaatgaaatgcctcacgtttgttcagattacgccgaagcagcatccaaatgggtaaatggaagaaagatagattgggagacttttgaggtgaatcggaatgcccgcaggatttctatcccgggacaaccgctgatcaaacagcggtattggatagcggaaaaaggggaagcacttgtttcagcggatgtgagtaagacgggccaccctttcttggggagtaacacgtccgattttcatcagttcagtttcacgaaaaaaatcagccgtaatcatccgttcgcactaagtctgtctgaaggaaacgtgtcctttttcccttatgcatctttggctgaaatggctatcgtcaatgcagcggcggcatttggacaaccagttcaaacattgaccgatttattgtggaccgaaagcatgaacggaatgacagatatacgggaactgatgattacgctgacgcctgagcgtgactttgcgcggtttgacatatatgcaaacacaaaaaatgagaataaagtacgtcttgccagcggaaatgcgcatatggttaagcctgaaagcggtatgcttcctgaagcgcttgatattgctgaagtcaaatcagaaatgactgaacatccggctgaagcgccttttgtcattgaatcagcgaaaaacagttacggaatgctgtcgcttcattcaatgccggatgagctttatgcaaaaagagaaaattttacgatttctcctgaagcgcttgagtccgcgattcaagccagtgcattttttgtcagcggagaaaccttcccggaattgatcggaatgggagcggcggatgtctatcagcctctcgctcaaaatttttatgtttatactcaaaaagtgaaccggcagaacagccgtgatgtaacgtgtcatatgacatttacagatggaaacggaagcattctggcggagtgcagagatgtgagattcagatatggtcatgaaaaagacactgttcagacggacgatgaactcattcgtctcctgcgtcaattggaaaccaatgatattgatcagaaggctgtattgaaacaattaatgggggaagaatgatgaacggaaaacgtgaacaaatcagcgatattcttgatctgattcaaacaggacaaatgtcggctgacgaaggctatgcccgtgtaacatccattcagaatcaaaaatcacgggcatcgaaccatcctcttttatattacaagccggaatggacagaatcgttcattccgagtacgaagagcgtacccttgacgggattgctcctgatttttgcagaaaatgaacggcaaatacaagaattgagcggtttgtttaaggactgcactctcttgtttgtcatccgcggagaagaatttgctgttttacatgatgatacgatttgtatgaaccacgtgaaaaaagacgattatctaaagctgttccgatacattcatgatcattatcagccgcccgaaaagattcttcacttgtggtctgattctcaggctgacatgagtaagggaggtatacagaaacaattggaaaacggattgttttctcttctgtatattacacaggcgctgattgaattaaaatggaaaaagataataaaactgacgcatatttttcaaactcagaataaagaacaactgccgctgcatcatgctctcggcggattggtgaaaaccgttcaccaggaacaccccaattttcactatcagattatcaatatcactcaatcagagggtgcgggagccgctcttccagcaatagctgatatatatcagagagagtgtgacgaaaaacgggatatccattttgaagtgcgctatgaaaacggcagacgttttacgaaaagctataataaagccggcttattcgatttaacccagccgctgaaacatcatgaaaattatctgattacaggaggcctgggcggtctcggttatatactggcaaaacatctgtcggaaaaatggaaagcgaatctcatattgacagggcgctctgatttaactgaagagcagaaaaaaaagatcgaatatttaagaagttcaggttcaacagttgaatatatccgatctgatgtttcaaaacaaagtgatgctgaacggatgtttgcttttgcaaaagagcagttcggcaccttacatggagtatttcacagtgccggcgtactccgtgactcttttatcttaagaaagacaaaagaagaaatcgatcaagtcacaagttcgaaagtttatggcgcgctctggctggcggaagaaatcaaaaaaatgaaagttgaattacttgtcttgttttcatccacatcggcagtcttcggatcagccggccaatgtgactatgctttcgccaatgcctttttggatcagtatgcagcagttatgaccgcaaaagagtctgccgaaagggtggtgtcagtcaattggccgctatggacttccggcgggatgaatattgacgatgaaggaatatcctacatgaaacaggaactcggccttgacccgctagatgacggtgacggaatacaggctctggagaacagcttgtgtcaatcatctgaacagctgatcgccctgaaaggccgaaaagaaaagattgaggatgtgctgaagcgtgccggcacaatcagcttacattcagaccggcaggaagatgccgatttacaaagcgatgaattaagacaaaatatcatcagttatctaaaaaatataatgtcagaggaattgaaattaccggtctcactcatagatgaaaaacaatacctggagaaatacggcattgattcagtgatgatcatgcgcctgaccaaaaagctggagcaaagtatcggcagattgtcgaaaacattattttttgaatatcattccatatcgcagttagccgaatatttcctgagtcatcacagcgaacgaatgatgaaactgctgaacccggccggcaaatctgaacttgtttcatatcaaaaaaagcaaaaaagaaaaccagtggaaacaaaagcgccggcacgctctgaaggagaaggttcaaaagagcacattgcggccgatcccctttctgctgatatagccattatcggtgtcagcggcagatatccgggtgcggaaaacatcagagagttccagaatgtgctgatgaatggacgggattgcgtaagcgaaattcctgatgaccggaaggaaatgctcgagggaagctgctataagtggggaggttttctgaaaaatccagaccggtttgatcctttatttttccggatatcaccgaaagaagctgcttttcttgatcctcaggaacgtctctttttagagacagtgtacaataccatagaggatgcgggttataaaccttcagatctgacccgcaaaaaggtcggagtatttgcaggcgtcacatatggaagctatcaatttttcggcgttgaagaatcacttaaaggaaatgaactggccgtcgggtctccattttctgcaatagcaaacagaatatcgtatttctttaattttaaggggccgagtatggcggtggatacaatgtgttcatcctctcttaacgccattcacttagcctgtgaaagtatacgaagaggagaaagcacacttgctgttgcgggcggagtcaatcttacacttcatccgaataaatatacattattaaatcaaagccgcttctttgcaagtgatggccgatgccgtacattcggcgagggcggtgacggttatgtaccgggagaaggagtgggctccgtacttttaaagccggcggcggaagcggtaagggacggagatcatatttatgcgctgattaaagcgacagcggtcaatcacggagggagaacaaacggttttacggttcctaatccaaatggtcagtctgaactgatacaggacgcgcttcagaaagcttgtattgaccctcgtacaattagttatattgaagctcacggaacgggaactgctctgggagacccgattgagatcaccggattaacaaaagcgtttcgggaatttacggagcacactcaatattgttcaatcggttctgtcaaatcaaatatcggtcatcttgaggccgcagcgggaattgccggtttgacaaaggttcttttgcaaatgaaactgaaaaaactgtttccttccatacatgcggagacgttgaatccaaatattgattttaaagcatctcccttttatgtacagcggtcattgcaagactggaagaaaccgaaactgcaggaaaacggaaaaacagtaactgttccgagaagagcgggaatcagctcattcggagcgggaggaacgaatgttcatatcattatagaagaatatgaagaaacaaacgtctcaacagaacatgttgagaacgaaccgcatattgtcctgttatctgccaaagacaatgaacgtcttcttgagtatgccgaaaacatgaaagattttattcagcgttcactaagtcctgaagtaaaggataaacagactgatatgaaagaaaaggtgaatgaagtactcaaaccgtttgtttcggaattgcttcatatccatccggaagaaattaatatttctgatcacctgagtgaatttggcgtagggcctttggaattaagccggatggcggattttattaacgaaatgtttcatattgaactcacgatgtatgaattaacggattgcccctccattcaagcggttactgaatacttactgaaggaatatgccggagcgataagagacatgttcccgaatgaagtgatggaaggcggccaatcggaaagcgtcgttttacgggatctggcatacactacacaatcgggcagagaagcgatggaggccagagcggcgattaccggtacctctcttaaagaaatgaaagataaattatctcagttttgccgcggtgacaagcaagttccaggcgtatatgttaatcagcaatcagatgcatttgctgaaaaaatgaaggcgttaacggaaggcagagcaggcgaattgtttgtaaagaccattattgagaacggtgaagcggaaaagctggctcaattatgggtttggggggcggatatcgactggaaatccgttcatcaacatttacagcagccgggtaaacggatctcaattccgacttatccgtttgcaaaagaacgttattgggttccgtccaggactgagaggacagagatccctcagcattcttctcaacatcacttgcaaaaaaaatggagggagaatccgtttgtaaatccatccgaaacaaaagagtacggactgacagtcgcatttgtgaatcaagacacagaatcaattgcccgcaccatttgtccggatatagatcaggagaatctgattgtcataaaacatcactcttcatatataaaacactctgatcaaatgtttgagtgttctttattagatgaaaaccacgcatacgacgttatctgtgagatcttctcgggcggtgagcggcaggtcgaaaatatatttgatttctcagatatcggaaaccagagtgaaaatcagaacggcatcccatatggtaaattcttatttatacaagaaataattaagcggagaaaaaaggaaacaccattatccattttacaactaaccaatggcttgcaggtatttaaagcggaaaaaccaaagctgacgggtgcagaatcagctgcttttctgaaagccctttctgcggaatacggctttgttcatgtgaaaacaatagatatagacagcatgaaagaaacgcataagctgaaacaaatctttgagattgaaagggcgcaatgtacaggagagaatgaagtatgctaccgcagcggcgtcagatatgttccgtattttgaagaagaaagaatcgataccggcggcggtcctgtttcatttcctgcggataaagccatcgtcattaccggcgggacagggggcattggcagagcaatagctgaagatttggtgaaacggggagtgaaaaaactcgtgctgacgggtacgcgtccattacctttgcgaagtgaatgggatcatttgctgaaagagggcagacaggacgaaaagacagtcagcaatataaaactgtttcaaagttttgaagaaaaaggtgtcgactatctgtattacagcggttctctcacaaatgaagagaagcttcgttcattctttcaccaagtaagccttgaatttaaagatattagcggtgtcatacactgtgccggactgcacagcggcggaaatccggcctttattcataaaagaatgagtgaatttaagacggtgtacgggccgaaagtcactggacttcagaatttggagcggatttttaataataggccgctggatttctttattctgttttcatcaattgcagcacagtcacccaaactgtcgaaaggaatgactgattacgcgtctgcaaatgcatatatggactatttcgcggcttatcattttcaaaaggggagaacgtatttcacgtccatcaattggccgagctggaaagaagtcggaatgggtactgtgacgagtcctttatatgatgaattgggattggactctctatccacgcgggaaggactggcgattttgtatcatgcactggagaaaaaatcggccaatatcattcctatcgtgaaaaaaggaacagtgtttcatgcagacagtctcctgaacatcaataaaaccggcaagacttcatttccggcccgaagacaggagactcccggcacttttgatcattcagaagggcttgtcagtgaactttctgccgtatttgccgaggaattgagcataccccttgaaaagcttaacccaaatacggattttcaggaatacggtgtggattctatacttcttgtcagcattatacatcgtatagaagcaatgattcagaaaaaaatcgaccctactgtgcttcttgaacacaacacgattcatggtctcgcggaatatatcggtaagacggcgccgccgttgaaaaaacaaatcgaacagactgattctcaaagcagcaatcagcatgatatgcagtctgtgacgagccgaaatacagaaccgcagacggcttccactgcaaagatagctgttatcggaatcggatgtaagtttccgggcgcggctgataaagaggaattttgggacaatctgagaaaagggaagaatcatattaaagaagtacctgattcccggtggaatatagaagaacattactctccggtgcagcaaaagggaaaaagcatcagcaaatggggaggatttattaatggaatcggcagcttcgatccggagtatttccgtatggaagaggagaaagccatccaaacggatccgctgataagacatttcttagaaacgagtgtacagactgtacgtgatgccggttatgaagaaacagaattatcgggaaaaaaagtcggcgtatttgtcggttccagaatgggcggctacggtcacaaactgccgaaagaaagcagcagccacatcgtcgggcttagtcaaaactttattgcttcacatgtgtcgcatttctttaattttcacggtccaagcatggtgtctgataccgcttgttcttcttcattagtcagcattcatttagcctgccaaagcataaaaaacggtgattcagaaatggcgctggcaggaggggcggatctgcttttggatgaaattccttacctgatgttaacagaaggaggagctctttcgccggacggtcagtgttttacttttgatgaaagggcaaacggctttgtacccggagagggttttggcgctgttcttttaaaaccgctggagaaagcaaaagctgacggaaatcggatatacggtatcattgaagcatcagctattaataacgacggtgcgacaatggggattacgactccgaatcctaagcttcaagagcaggttattcaagatgcatttgaaagagccgatatcactcccggatcagtcagctacgtcgaaactcacggcacaggcacgatgattggagatccgattgagcttcaggctctgacaaaagtattccgaagagacacaaacaaaacgcaattttgcggagtaggaagtgtaaaaaccaatatcggacacttattaagcgccgccggagcggcaagtttcattaaagtgattttatcaatatggcataaggaaattccgcctacattgaattgtgaaacgccaaatccccgctttgaatttgaaaagtcgcctttttatccgaatacagaactgagaagctggaaggatggaaaacggagggcgggcatcagcgctttcggtttcggcggaacaaacgcccaccttttggtaagcggcctggatgattcatatcattccgtcagaactccgctgccgcctgccgagtttgtcagaaaagagtactggccggattcaaatcgaaaaaaacaaatcaaacagaataaaaaacggcttcttgaaattattgatgaaacagagtagcacctgctctgtttctttactttgtaaaagaagaaaggttgtcgagttgcatgaggttcagcgtattagtcaaacatgacgattatattgtttcagaccatgtccttcatcaagtgcgtacgatacccggcgtaacgtatctggatttaataacacgatttttagctgagaaagggatatcaccccgaagttttgaaatcaaacatgttttattccgtgaacctgttgcgacgtcagtccattttgataaaaaagtcaccttccagtttacggaacaagaaaacggctggcttgttgaaacaacaagcaggaaatgggtcgctgaaaaggcggaaggtgaagcgtcagtcaacttgcaggcggaaatcataagaaaaaatgcgatagacgaaaagacaatttcaatcgaagcattaaagaaaggggccgtccggacttcgaatgctgaagccgcctatcgtaatttgcgcaggggcggcctgattcataaagattttatgaaattggaaggtacggtatatgaaggtgaaaattatattctgggagaggtcagtttaagcggactttcaaaagaatatacagatgacttttacatgcaccccgcatttttggatggatctctcagcctgttgggagtccttacatcagacttgccggatgaaggaacaaatgcgtttatccctatatatattgagacattccgggcactgcataaaacaaccgggtcttgttttgtgtatattgataaaaacagtataacgcagccgccttctaaagacattttatatgcggacatagaagtatacaggcctgatggagagcttgctttttattatgagcgattcggtgtgaaaagagtcagaaatgaaaaatcaatacaaaggctggagcattcccaaaaagctaaagacgtcggcagcgtaacgaacaataaagaaatgatcagaaataatttaatccaagagatagccggcatgattgaaaagcctgctgaaacggtgaagaatgatatttccttttacgagatgggcttggattctaaacagttattagacttatctaaaaaattagaactgttgttaggttcaaagctgtacccgactttattatttgattactccacaatcggtgaattgacggaatatctgcaggagaaatacggagctcgcgttacagactctatctctgatacagttcagcaccaagacagtcaaaaaacattaacagatgagctgtcatccattattggagatgtgacaaacacgccgccaaataaagcggacaaacaccaatctttttacgaactgggtcttgactcaaaacagctgctgcatatatcgaaaatgctcgaggaaagattggatacacaattgtatccgacattgctttttgattataacaatattcatgatttagcagcttatttagaagaaaaatatgatgtgcgtaatacgccggccgcagcttttaaagaaaaaacgcaaacgaaagagccgtctgaaaagccgatgcttgaatctttatatttacaaaaagaatggatagaatcgccattaaagtccggagaagtgcctaaggaaaatacattgattttcgatttcggcagttcattgagtgatgaaatccgaaagtacatcggcagtgaaaatgttatttatgcggaagccgccgctgaatatgaaatggtaaatgaaaagcattataaatttaatccggagcagtctgctcattacaccagactgttagatgatatgaaaaagtccggagcgtttccggcgtcaatcattcattacctgtcaaaacaagcttatactgaggcagcgttagatttgactcacagcttttattcaatcctttatttaagtaaagcgttgatccgtcaaaaaataaaagataacatcaaccttttgtacgtacatgacaaggatcaatatacaaatccgatttacgccgcgattggaggcttttttaaaacgcttaatgcggagcagccgaatataaagtgtaaaacggttgagatttcttcaagacaaaccattgaaaaagcatctttgcttctcaatgaattaagtgccggacatcatgaggctgtgaaatatgacggcgatcaaaaaaggcgggtgacagcatacaaagatgcttcgctgcaaccagggcaaaaggccgcaaagtttgtaaaaaacggagtgtatctcataatcggagggttaagcggcatcggctggattatttcagcgtttatttatgcaaatcacggagccagcgttatcattgccggacgatcgaaaatgacagcagaaatggaagaaaaattagacagcatccgatatgacggggcaaacatttcttacatccaggctgacatgtcagataaacagcaggtcatcaatttagcggaaaaaattcatgctgattattccgaaatcaacggggtcatttacagtgcaggcgtgttaaaagactctttcattatgaataaaacagacgcggaagctcaggcggtgctgcaatcaaaggtcaatggtgtgattcatttggatgaagcgctcagaaatatgcctttagacttttttgttttgttttcttccatctcttcagaaatcggaagtttgggtcaagctgattacgcctacgccaatcgttttctggagcattttgccgagtggagggaatgtatgagaaaggagggggggagatcaggaaaaaccatcgctgtaaattggcctttctggaaagacggaggcatgtcagttgatgccggcattcaagacattatgaaaaccgagtacggacttcacccattagaaaatactgccggaatcaaagcttttgaacactcgcttctcggccaaggccaccagctgatcgtgttatacggagaaaaagaaaaaatacaaaataatttcaatccgttatccgcccgttcagcaccgcctctggtaagagattcagcgattgcagccgattttgatgcttcgtcaatcgttacggaagaagaagctgaaagtcctttccgaatactcggcacagcttccaatcgtcatctagacgattatttgcattattggagcagactgaagaaaggagcccttcagcacgatcaaagcgatgccgcaaaaaaactcatcgctttttaccagacagaagaaacggaaaccgttcattttctggctaacacagaaaatgcccggcatatggaaatattgatgagcggtaagggtgaaacaattttactgatttgcggttttgctaccactgcttacatgtggaaagaacaaatgaaggagtgggcagaccaatttaatgtaattgtcatacacacaccgggttacgggctgagtgaggggagcgccgattttacactgagcgggctggctcagacttttattgaagtgctgaacgagataggggttgcttggccgatccacattgcggcagcttcttggggaggcatgataggacagaggatagcctatgaataccctgaaaaagtaaaaacactcattctttccggaagttacaccgaatacgaagaagaccctgaaagcagtgttgaggaaaaactgaaaaatgattttatagctataggaaaatcgcatgaatatgaaagtttatacaggaatcaattcttaaatgcttctattgaacgttttatgaagatacatcaacaagaaggctattctacgatcggctttttaaaagacatttatacaagaacgcttatccttacgggagagaaggaaagcgtagttgatcagaaagaaacaaaaaggctgaagaaactgctgagcaatgcagaattaaagaaaattaagggagcggggcatcttccgaacatcacacacccggaagaatttaataaagcggtgtcagaattcatcaagaaatcagtaagtaagggatgaaaacgatacatacagtacagggggagaaaacaatgaaacaaacaataagcaatccggcatttgatatgaaacaaattaacgctcttaacagccattatcagacgatgatagacaatggagatctgcaatgcgcgagttatatgatatcaagaggaggcgaggtttttgcggctgagtcgttaggggaatttaccggcggacaaaaagaaaagcaaacatttcagcttgatacaatcagagaaatcggttctttgacaaaagtgtttaccgctgcagccgtcatgcagctcgtcgaaaaaggtctgctcgatctgaaaatgccggtcaagctcattttgcctgcatttgataaaccgggtttcggagacattaaaattttacaccttttgactcatacggcgggattaagttttgagctggatattcaaaaggctgaaggcattgacttaacgaatgaggaagaatggataagctatctggtcagtacgcctttagagtacggagtggatgaagcatggaactattccagaaccggctttgtcatacttggcatcattatttccaaagtaacaggcatgtcctacgaacagtatgtaacaaagcatattattgaagcgctcggattagaaagaacgtttttttatgtgcctgatgctttaaaagaagaagtttgtgtgatcaatgagcacgagtgcgtacagctggaaaaaagtcatcacccgtattttccgaataaagcgacaagcggtctgtactcttcattggaagatatttggaagttagctgaaatgtttagaaataaaggcagattgaaagataagaagctgcttggaagaaaaacagtcgaggccatgctgagaaatcaaataaagcccggtcttcctttttacttcttcggagcgccaagagaggagggcggctttggtttaggcattaatttgtggccggccggtgaccattatttcatgacagaaggcacgttctcacatcttggaatgggttggtgcggcatgttttctgatccagccgaagattttacgtatgtatttttcactccgatttccgagtttcatcctcatgccgtactgacgccgctgaatatcgtgtgggcgggtattgaataattagacaaaagcatcgtcccgcctgttcggcaggcgggacgattgctaactgcccgtttttatcccgcggcaccttctcaaagcctgccctcgaagttaaataacttaatttactctttgtaattttttttaattatagtacagtagagcgtttttataatacagtttaaagtcttttatagtacagtttggcgcagtatgatcttaagttttataagcggtttcaaaataaggttataaataattgacggctttgtttaattactgtaaactatggttgttgatcatattgtactaataaaaaatctttttttattagtacagtttaaacgtcattatctttgcttaagcgctatgtgaatttctgaatgattaattttagaattgcagagcatgataagactgtttttaatacggatggctaaacggtatcctaaccctgttaaatcaaaagaagaggtggtttaaaaaatggctgcaaagacaaaaacttcaattgttgatagcaaaaaacaatttgatgctattaataagcagtttgaaacgttccaaattttaaatgctgaaggagaagtcgtaaataaagacgcaatgcctgatctttcagatgatcagttaaaggaattaatgagaagaatggtgtatatccgcattttagaccagcgttcaatttctctttcccgtcaaggacgtttaggtttctatgcaccgacagcgggccaggaagcttctcaaattgcatcacacttcgcgcttgaacaggacgactttatccttccgggttatcgtgacgttcctcagctgatttggcacgggcttcctttacatcaggcattcctgttctcaagaggccattttaaaggtaatcagatgcctgagggagtaaacgctttatcacctcaaattattattggtgctcaaattattcaaaccgcaggtgtagctttagggcttaaaaagcgcggtaaaaaagcggtagctattacttacactggtgacggcggagcttctcaaggtgacttctatgaaggaatgaactttgccggagcatttaaagcgccggcgatcttcgttgttcagaataaccgctatgcgatttcaactcctgtagaaaagcaatcatccgcacagacaattgcccaaaaagcagttgccgtcggtattacaggtgttcaagtagacggaatggacgcactagccgtttacgctgcaaccgcagaagcacgccagcgcgcaattaacggtgaaggtccgactctgattgaaactcttacattccgttacggacctcatacaatgtccggtgacgatccgactaaataccgtacgaaagaaatagaaaatgaatgggagcaaaaagacccgctcgtacgtttccgcaagttcttggaaaacaaaggactatggtctgaagaagaagagaacaaagtgattgaacaggccaaagaagaaatcaaacaagctatcaaaaaggctgacggcgaatcaaaaccgaaagtaacagagctgattgagaatatgtttgaagagccgacgttcaacttgaaagaacaacttgaaatttacaaagcgaaggagtcgaagtaagccatggcgcaaatgacaatgattcaagcgatcactgatgcgttacgcacagaactgaaaaacaatgaaaacgttctgcttttcggggaagatgtaggcgttgccggaggcgtattccgtgcaactgaaggccttcaaaaagaattcggtgaggaccgcgtatttgacacgccgcttgctgaatccggtatcggcggtctcgctctcggtttaggcctgcaagattaccgtcctgttatggaaatccagttcttcggatttgtatatgaagtaatggattcaatctcaggacaaatggctcgtctccgctaccgttccggcggacgctggacttctccggtgacaatccgttctccattcggcggaggggttcatacacctgaacttcacgctgacagtttggaaggccttatcgctcagcagccgggtattaaagttgttatcccttccactccttacgatgcaaaaggactgctgattgcctctatcagagacaatgatccggttgttttcttagagcatatgaaactttaccgttctttccgtcaggaagttcctgaagaggaatacacaatcgagcttggcaaagctgatgtgaaacgcgaaggtactgacctttctatcatcacatacggcgcgatggttcatgagtcgcttaaggctgctgaagagcttgaaaaagaaggcgtttctgctgaagttatcgaccttcgcactgtaagtccgcttgatattgatacgattattgcttctgttgaaaaaacaggccgcgcaattgtcgtgcaggaagctcaaaaacaagccggcatcgctgccaacgttgtagctgaaatcaatgaccgcgcgattctgagcctggaagctccggttctgcgtgttgcggcgcctgatacagtatttcctttctcgcttgctgagagcgtatggcttccaaaccataaagacgttcttgaaactgcgaaaaaagttcttgaattttaatcaggcatcttaaaagacggtaaagagagtccttttctcttatgatgaaggagtctgtttactaggttcaatgcttgcgtatgcataactaaaatttgcttaatcaactaggaggtcgaaaactgtggcatttgaatttaaacttccggatatcggggaaggtatccacgaaggcgaaatcgtaaaatggtttgtgaagccgaacgacgaggtagaagaagacgatgttctggctgaagtgcaaaatgataaagcagtggtagaaattccttcacctgttaaaggaaaagtattagaattaaaagttgaagagggaacagttgcaactgttggacaaacgattattacgtttgacgcacctggttacgaagatcttcaatttaaaggaagccatgattcaggagaggcgaaaactgaggctcaagttcagtcgtctgctgaagcagggcaggatatctctaaagaagagactcctaaagagcctgcaaaagaaaccggcgcaggacagcaggaccaagcggaagctgatccgaacaaacgcgtgatcgcgatgccttccgtacgcaaatatgcccgtgaaaaaggcgtggatatccgtaaagtaacaggttcaggcaataacggacgtgttgtaaaagaagatatcgacagctttgcaaatggaggagcggctcaagaagcgggaccgcaagaaacagctgcacctcaggaaacagctaaacctgcagcagctcaggctcctgaaggcgaattccctgaaacacgcgaaaaaatgagcggtatccgtaaagcgattgcgaaagcaatggtgaactctaagcatactgcaccgcacgtaactcttatggatgaagttgacgtaacaaatcttgttgctcaccgtaaacagttcaaacaagttgctgctgatcaaggcatcaagctgacttatctgccttacgtcgtcaaagcattaacatccgctttgaaaaaattccctgttttaaacacatcgattgatgataaaacagatgaagtgatccaaaaacattacttcaacatcggaattgcagcggataccgaaaaaggcctgcttgtgccggtagtgaaaaatgccgaccgtaaagccgttttcgaaatctctgatgaaatcaacagccttgctacaaaagcgcgtgaaggcaagcttgcacctgcggaaatgaaaggcgcttcttgcacgatcacaaatatcggttctgccggaggccaatggttcacaccggttatcaaccacccagaggttgcgattctcggtatcggccgtattgctgaaaaagcgatcgtccgtgacggtgaaattgtagctgctcctgtcttagctctttctctcagctttgaccaccgtatgattgacggagcaactgcacaaaatgcgttaaaccacatcaagcgtttactgaacgatccacaacttattttaatggaggcgtaatgttatggtagtaggagatttccctattgaaacagatactcttgtgattggtgcgggacccggcggctatgtagctgccatccgcgctgctcagcttggacaaaaagtaacagtcgttgaaaaagcaactcttggaggcgtttgtctgaacgtcggctgtattccttcaaaagcgctcatcaatgcaggccatcgttacgagaatgcaaaacattcagatgacatgggaatcactgctgagaacgtaacggttgactttacaaaagtccaagaatggaaagcttctgttgtaaataagcttaccggcggtgttgcaggtcttttaaaaggaaataaagtggacgttgtaaacggggaagcttatttcgtagacagcaactctgtccgcgtaatggatgagaactctgcgcaaacatacacatttaaaaacgcgatcattgctaccggttctcgtcctatcgaattgccaaacttcaaatatagcgaacgcgttctgaactctacaggcgcactggcgcttaaagaaattccgaaaaagctcgttgttatcggcggcggatatatcggtactgagcttggaacagcgtatgcgaacttcggaactgaattggttattttagaaggcggagatgaaattcttcctggcttcgaaaaacaaatgagttctctcgttacccgcagactgaagaaaaaaggcaacgttgaaatccatacaagcgccatggctaaaggcgttgaggaaagacctgacggcgtaacagttacattcgaagtaaaaggcgaagaaaaaacggttgatgctgattacgtattaatcactgtcggacgccgtccgaacactgatgagctcggccttgagcaagtcggtatcgaaatgactgaccgcggtgtcattaaaacagacaagcagtgccgcacaaacgtaccgaacatttacgcaatcggtgacatcattgacggacctcctttggctcacaaagcgtcttacgaaggtaaaatcgctgcggaagctatttcaggagagccggctgaaatcgattacctcggtattccggcggttgtattctctgagcctgaactggcttctgtcggttacactgaagcacaggcgaaagaagaaggcattgaagtcgttgcagctaagttccgtttgcagcaaacggacgtgcgctgtctcttaacgaaactgacggcttcatgaagctgatcacccgtaaagaagacggtcttgtaatcggtgcgcaaattgccggcgcaagcgcttctgacatgatttctgaattgagcctggcgatcgaaggcggaatgactgctgaagatatcgcaatgacaattcacgctcacccgacattgggcgaaatcactatggaagctgccgaagtagcaatcggaagcccgatccacatcgtaaaataatgatgtaacaaagaaacagcccccgtttgtaaaagcgggggctgtttttattgtgcaagcacatgctgcataggtttgatgatatcctcttttttctttacggatccctcaatcttcatgaccacatgccgatgattgatcaccatcagcgcagggaacgtgttgatttcctcttcccatccctttctgttgtcataaaccttcatttgatcgacatgatggggatatttcttttctaaatcaagaatcgcatcgtaataaggaacttctttatctatatgattttcatcggaaaaaaacaagatttgagtgtgatgaatgctgtcgatccggttatttttgaatggaatgacagtagaaaccgaacagcttgacagaacgaacagcatcaaaaaaaagggaatcaccgtacggtagcgcatctatcttactcctctgttttatataatatattggttcatccatttataaggactatattaagtgtatcacgagaggtgaaaaacctaaggcttgttactgaattgttatataattgaaaccgtttttaatgaagaaataatacgtgtgacaacttgcacagccgatgtgtaaaaaaggcacattgtttttcgtgagagcgctgttttttcgttatactgggggcaaaaccatatcaggagggattgcatgtataaagccattgcagccgtcatatgtatgtgcttactcgccggctgccaatcaaatgaaaagatgcaaacaaacaaaccccattctcaagccgcggccaatcatgccaaacgggaaaaccatcatacaaaagagaaaaaacagaaggcggagccccgttactatatcaatccgaaaaccttttctgtggaaaaaatggatgaacagaaagagaaaaaaccgatcgcattggtaacgatcgatgacgcgcctgatcagcatgccgctgagattgcggacaaactgcatgatctcaatgcgtcagcgatcttttttgtaaacggacattttttgaaaaaagatgaaaataagaaagcgcttaagcatattcatgagttaggttttatgatcggaaatcatacaatgactcatcaaaacttaaaagatctttccgaacaaaaacaacgggaagaaatcattggcgtcaataaagcggttgaaaaggtaataggagagaaacccgcatttttcagggcgcctttcggaagcaatacggactacagtgacagacttataaaaaaagaaggtatggtgaaaatgaactggaccttcgggtatgattgggatcagaaatatcaatccaaaaaagcgcttaccgatatcacactgagcagtccttacctgcgggacggcgccaacatattgatgcatgaccggaaatggacggctgaagccatgccggacattgtaaaaggattgcgtcataaaggatataccgtgattaaccctcgagctataaaaagaccgtaaaaaataaatgtgttatacaatttatcagttgacatattaaatgtgacataataatataataacaacaagtaaaaattaagcgttttcaaattctgagaaatggggaatgacagatgggtacaattgtttgccaagactgtaacgaagcgattcattactttgaggatgagaaggtcacgacgttatacggaacatgctgcggacaatgccagtgtcatcttgaagaagagtaaaaagcgtaaaaaaggcccgaaacgatttcgtttcgggcttctttatgtttattggatggctttttgctctttgatgactctgatcatttcaagcgtggcatcttcgggaccctgcacaggaaggccggcgtccaagtttttaaaaatgtagctgatattttcttcagtaatgatctcacccggaataaagatcggaattcccggcgggtacaccatgacaaactctgcaatgatccgtcccgcggattctgttaacggaatgacttccgtatttgcgtaaaacgcgtctcttggcgtcatcgctaacagaggaatctcaggaagcagaacttccgtttgctgatgagcataatcatttgcggaagcctgctttgaaatgtctgtaagcgcgcttacaagacggtcggcatctcctgctctgtctccgggggtgaaaatacataaaatattatacaaatcggacagctcgacttcgatattaaatgattcgcggagccatttttcaacgtcatgacccgtcaggccgaggtttttgaccgaaatgattaatttagtcggatcataactgaaggcagcttttgacccagtgatttcttcgccgacacagcggatgccttcaatttgattgaggcgttcccgtgtctgatccgccagcagaatcgtatcttcaagaagatcgcggccttctgtagcgaggcgttttcttgcgacatccagtgaagcgagaagcagataggatgttgacgttgtcgtcagcatgcttaaaatcgactgtactctttctttggaaacaaggccttctctcacatttaaaatggagctctgcgtcagggagcctcccaatttgtgcacgcttgtggctgccatatcagcgcccgcctgcatggcggacagaggaagcttatcatgaaaatgaatatgcacgccgtgcgcttcatcgacaagaacaggcacatcgaaagaatgcgcgagctttacaatgctgctcaagtcagctgccacaccgaagtatgtcggattgatgacaagcaggccttttgcgtcagggtgttccgtcaaagcccgctcggcggactcaagcgtaatgccgtgagaaattccgagctcatcgtcaatttccgggtgtataaaaatcggcaccgctccggaaaatacaatggccgacataatggatttatgaacgtttctcggaatgatgattttatctccgggtccgcatacggccatgaccatcgtcataatggcgccgctcgtcccttgtacggaaaagaaggtatggtctgcgccgaatgcttccgcggccagatcctgggcttctttaatgatgccctttggcgcatgtaaatcatccaggggttcaatattaattaaatctatgcttaacgcgttttctccgataaattgtctgaattccggatccattcccgcgccttttttatggcccggaatgtggaattggacaggctgtctgtccgcgtgctttttcagtccgctgtacaggggtgtttcatgttgcggcaattgttttcccacctttatcataatacctacggattagtttgtattacattcagttttattacccgttttttaaacgtaaaacaaatgaattatattatgaacttgaaagaaagtaaagaacaatttatgatctatggaagatgcttatttttgagcatgatgataaaggagtgaagacatttggaatatcaatatccgatgaatgaggactggacgacagaggaggccgtggatgtcattgctttttttcagcaggtggaaaacgcctatgaaaaaggagctgaccgagacagacttctgaatgcgtaccgccgctttaaagaaatcgttcccgggaaagcggaagaaaagaaaatctgcagccaatttgaagctgacagcacctattccccgtatcggactgtgaaacaggcgaaacaatcagatcaagcgattatcaaaatgtagacaaaagcgagccggcaatcggcccgctttttatgttatgagactttctgagtcagtgtgtataaaaaggaaagcttcctaaaagcatcttcaatggtttgcaggaattcattgttgttcatgttgatcacgtcttctttttgcagctgaatgccgcataaaagctctgcttttttcactgtctgcaggcgttcaaataatgttttcagctgctcctgatccatgtcggactgcttgtacgcacctggcttcgtatgatccggcgaccatacaaaatgaccgggaatctgttttgtgatttcctcctgcttcgcttccagcaatctgccgtattcctcttttatcggagattcataaatgatggcaaaccatacaaacatatgggtgtcccataaaccgatctgaaagtgagggagtttcttatagccgcgtttgctgttggcaaaggcaacccagctgtcagccggcgggttgacagatcttctcgcgtgcttggcgacatgcgggaacatttcatctcctgtcaatgctgacaatgtcggtgcgaaatgctctcctaacaaggtcagcttcggacggacttgttcttttaacacctccatgcgcggatctaaaccttctattgtaaatgtatcgaagtcttcttttgtaaaacgcatctgagtcatctttttcctccttaacgtaagtattcatattttaccacagccgccgcccgccgcaaaaacattgagaacgtttgagtcgagaggaatggtggtaaaaaacgaataggtaaacacacaattttaagaatgttgttacagccgaatataagtttccatacgatataagaagtatcattaatgaattggaaaaatgggatgcttttttaacaaatgatctctggaaggggcgaaagacaatgaggcaagtggtgaaggaaggattcagggaggaaaaaaataaccgtgtagctgtctggagactagaggttgattatgaattggcaaccctgtacgaggccatgcaaaaagagaatgaagatcaaatcgatctcagcaaaagaaaactggaacgtctcagaaaagaatggattcggcttaacggataaagaatagtaaaaacgaaccgcaggaaatggttcgtttttacgtgagaaggcatttttttcattttccttgctttttcatcgcctttatcagtatgctatagaataagctatacatagaaaagaggtacacggtatgacaaattggacggaaattgatgatatcgcaaaacaatgggtaaaagaagccggaacgagaatcagacaatccatgcaggaaagcttgacgattgaaacaaaatcaaatccgaatgatttagtcacaaatattgataaagagacggagcgctttttcattgaccgtatacaaggaacttttcccggacaccggattctcggagaagaagggcagggggataaactccgctcccttgacggaatcgtctggatcattgatccgattgacgggacgatgaattttgtccatcaaaagcggcatttcgcgatctccatcggcatctttgaagacggaaaaggcaaaatcggcttaatttatgatgtgatgcaggacgaactgtatcacgcattcagcggaaaaggggcttatctgaatgatacgccgcttgctcctttaaaagaagcttccattgaagaagccattattgcaatcaatgccacatgggtgacggaaaacagaaggattgacccgagtattttggcgccgctcgtaaaacgggtcagaggaacgcgttcctacggttcggcggcacttgagctggccggtgttgcggccggccgcattgacgcatacattacgatgaggctcgcgccgtgggattacgctgccggctgcgtgctgctgaacgaagtcgggggcatttacacgaccacagacggcgaaccgttcacgtttttagacaaccacagcgtgcttgcgggcaatccggctatacataaaattatctttgacgactatttacatgctgacaggtagagattttgaagaagaagatctcgggtttctggagcagctggcggcatcacacccggtgtggaaaaacgaagagttcggaacaaaaaatgcggcggagtttatgcttgcatactccatgtacaatggaacgtggctcgtatgggagattgacggcgctcctgccgccgtcagttttcatttggaatgggcgccttcaaacggaaaaccgtggctcggaaccgtggccgtcgctccggaggcaaaagagaaaggaatcggtcgcgcggtcattgaagagattgcgggccggctgagaggagagcataaagcgatgttttcagccgttcccctggacaggcaggaatgggttttgtttttaagccaatgcggctttgaacagcttaagcttgaaaaagacgatcgggaaaagacatatatgatcatggtgaagccattgtgaaatgttcagatataaaaaagagaccggatttctccggtctcttttcttgtttacaagccgaccgcattccaggccgcttctacgcttgcagcgtcttgagagccgtaaaggtcccgcgctgattgaatcaaagctgcttttgcatctttaaagcttgatgacggagtgagatataccgtcagtgcgcgatagtaaatctgctccgcttttttcactccgatttttgtaatcgtgttgtaagcggctttgttcggaattccgctgtttgtatgcacgccgccgtagtcgccggcatcagtgttcggaaggttttgataatttttgtaatggtcgggctgtccgtattttgtcggattggataagctgcggagagccggctggctgaccgtaatatcctcaccgatatcccagtcctcagtatcggtgaagtacccgaatacatcggagaaggattcgtttaaagcgcccggctgattttcatagttcaggttggctgtttcctgtgtaacgccgtgtgtcatttcatgggccgttacgtccattgaaccggaaagaggcgagaagaatgagccgtcaccgtcaccgtaaatcatttggtcgccgatccaggccgcgttattgtatctgctgccgtaatgaacggaagatacgattttgccgcctctattgtcgtagctgttgcgtttaaacgtctgatagaaataatcatacactttgccgagattgtaatgcgcatcaaccgcagcgcgctgagaagaagttgtgaactggtttgtagtgcttgatacgagcgtgcccggcaggttatattgtcggttttgcagatcgtacgtaataatttgtgttccggtaggcttcgaaagatcacgcattacatatttgccgttttcagaagaaatatttaatgagaccgtttttcctttaagagtcgtacctgttccggttgcagcggcatgctccactttgttttgctttttcaggactttccctgtttccgcatcaacggttacttcccagttagctggttccggttcgatgtagcggatggttacatcataggcgagtcggtatttaccgtcttttgtggccgctgctttcagctcggctttgtttttgtttgcaacgttgccgttggagacggcttcaggtgatttgccgattgctttaaaagcatgatccagcgcctgatttgcagataattttttgctgtttgccgttttggcagaagcatcgttgtttaattcaccgttaatcgcatagacattgttggatttatcgacgtgaataatgacttgcgagtctttcacaggcacaccgttaacgacaggcacataacggaagtgcttatagccgagatcatcggtcgtgtggtcaatcagcttcagtctctcagaagggttgcctttgaagactttgccgttttgtttcaagtattgcttgattgctttgtcactgactgaaggcaattcagattgcaccaaagaatgcttcggcacaaagttcgtcaggttttctttaagctgaggattctcagcggcctgaacacccggaagactgatggttaaactcataaaggaagcggcgacagcaacagacaatttcttacctaaacccacaataaatccccctttttgaaaataatgaaaacttatattgttataataaaccagcattctctcattctgcaatataaaactagacttcgctgatgaattgatagaatcgtcccgtaaaggcttcaggcgggcagcgtcaggggataagccgagaggcacgtgttgaatcaaacatgagtcgaatgatgcgatttattctgaaaaaaatgacaaatgaagtcgggagaaataatagaggaaaaatgttccgatctgtaaaactttttttatagccgtttgtctaaacaggtgaggccttaataaacgaaaaggattgtttcagatgtcagagattttcagtcattttattcagcatttcgacagatatttcaagagctgtcttacgaagagattgctgatgttttggactggagtctttcgaaggtgaagagcactctgtacagggcgagaatgcagctgaaacagcacttagcggaaaaaaggaaggacggacagatatgacttgctgtttagtgagagatttactccctatatatattgaaggcgattgtgaaacagaaacggagcggtttatttcccgccaccttgaatcatgcggtaagtgcgaaagtttatatcatatgatgaaggagccgcttgacctcggcagccccgagatgaaggagcccgcctgttatgcagaagaagaaaggcggtttaaggaacggtattacgggaagctgctgataaaagcagcctgtttgttcggcgctgttttctttatcatgctgatctttaaactgctgattaaaaaaaacgcccggctgcatgacatgaccgggcgttttatccgtttactcagccggatgaaaggctgtataaatgccttcaagcaagtcctgaggcagtgaattaaagaatccggcacacagctttgcttctttttttcctgctcctgctttttcagcaaggtcctgatcaaacgtatacacaccgtcttcttcaatcagcgcagattgaaggatatgaagactttgggaaaaagtggtgaacagctgatcaacgataagggcctctttttccgtaaatccgagctccaccgctttttctttattaaatgtatattcgccgtccgttttctcaatacattgagaaagaacggttaaaaattcggttgaactgtcccacagcttttgaatggtctgtgcggcttctttatctaatcccaattcaaccgctttttcaccgtcaaaataatagacgccgtctttttcgtaaatcgattggctgatgatgtcaatgagttttgccgcgtcttccggtgttttctctgcggaaacctgcagggtatgcggttcatttgcctggatcgtttttgcgccggcagaatcaagcggactgaatgcaagcaaggcggctgaggcggttgcggcggcagttacagcggttttcttcaaaaaagatgttttcatttcattctctccttgtcatgtgtatttgcttacagtcacaagtataaaaagacaatgatggaattgatataggaggtatggtattttctgcataacgatgccggactatttcagactgtatattctgagggaatctgctgatgtaactagaatgggggccgtcattcccggcttcctgactagacggcgggggagataagccttacatctggagtctgtttttgaggaggtaaaaaagcctgaatctttgattcaggcttcataagatattgtctttccatgtttacggaattttgcaaagggtcatgcttttaatcaagcagtccctgttcgcgcatttttttctttacggtgaaaccgcttcccatcatggcgataacgagaacaatgcttccgatgatgccccatgcgcttttctcagcgattgatacgccgatcagcatcatgctgaagactgctgcgaatgcaaataataataagagccaattcaattttttcatatttccatcccctttaacgtcatactttcagtttacagaaaaacgtaacgcttttaaagaggatgtgtggtataatatgaaagttatctaatttttttaggagatgaaaatgtgaaacttcgaaacgatcttcgcaacatcgcgattattgcccacgttgaccatgggaaaacgactttggtagaccaattgcttcaccaagccggaacattccgtgccaacgaaaatattgccgaacgcgcaatggattcaaacgatcttgaacgtgaacgcggtattacaattcttgcgaaaaatactgcgattaactataaagatacacgcattaatattttggacactccgggacacgccgacttcggcggagaggtagaacggattatgaaaatggttgacggcgttctgttagtcgttgacgcttatgaaggctgcatgccgcaaacccgtttcgtactgaaaaaagcccttgagcagaacttaaatccggttgtcgtcgtaaacaaaatcgaccgtgatttcgcccgcccggaagaagtcattgatgaagtgcttgatttgttcatcgagcttgacgcaaacgaagaacagcttgagttccctgtcgtctacgcttctgcgattaacggaacggcaagtctggatccgaaaaagcaggacgaaaacatggaatcactgtatgaaacgattcttgaacatgtccctgccccggtagataacgccgaagagcctcttcaattccaagtggcgctgcttgattacaatgattatgtcggccgtatcggtatcggacgcgttttccgcggaacgatgaaagtgggtcagcaggtttcattgatgaaacttgacggaacggttaaatcattccgtgtaacgaaaatcttcggtttccaaggattgaaacgcgtggaaattgaagaagcgagagcgggagaccttgttgccgtttcgggcatggaagacatcaacgtcggtgaaacggtttgtccggctgaccaccatgagccgctgccggttctgcgcattgatgagcctacgcttcaaatgacatttgtcgtaaacaacagcccgtttgcaggccgtgaaggcaaatatgtcacagcccgcaaaattgaagagcgtctgaatgcgcagcttcaaactgacgtcagtcttcgtgtcgaaccgactgcatcaccagacgcatgggttgtttcaggacgcggtgagcttcacctgtccattttaattgaaaacatgcgccgtgaaggctatgagcttcaagtgtctaaacctgaagttatcattaaggaaattgacggcgtcagctgcgagcctgttgagcgcgtgcagattgacgtgcctgaagagcataccggttctgttatggaatcaatgggtgcgagaaaaggcgaaatgcttgatatgattaataacggaaacggccaggtccgcctgatctttaccgtaccttcacgcggactcatcggctattctactgagtttctgtcactgacacgcggtttcggtatcctgaaccacacgtttgacagctatcagccgatgcaaaaaggccaagtcggaggccgacgtcagggtgtgctcgtttccatggaaaacggaaaagcgacatcttacggaattcaaggtattgaagaccgcggcgtcatcttcgttgagcccggaacagaagtgtatgaaggcatgattgtcggcgaacataaccgtgacaatgaccttgttgtcaatgtcagcaaaatgaaacagcagacaaacgtacgttccgctacgaaggatcaaacgactacgattaagaaagcgcgcattatgtcgcttgaagaatcactcgagtacttaaacgaggatgaatactgcgaagtaacgccggaatccatccgtttaagaaagaaaatcctgaataaaaacgaacgtgaaaaagcggcgaaaaagaaaaaaacagcaggaatgtcttaatcacttgcagaatttgaaaaggtagaacccgaacggaaaaggggagggggatctttttgaatgaagtaagtgaacggctgtcgttctttgcggctctttaccaagtggatgagcatccgctggcgggaatgtggctgttatacggaacgatcgtcgtgctttcggtgattgtatttaaactcggctttgccaaacggctgccggttttgaaggctgcggcagtttatctctttctcgtgctcggctgcaccgtgctgacttttttcggtgtgtttttgccggtcggagaagggcttgttgtcgccgccttgattttgatcatttacaaaatccgtctgcaccagtccaaaaaaagccagtcagctaaaccgcaataaaaaaatgaccttgccttccggcgggtcattttttattgcggtttattttttcagtttatcttttttcgctttttgtccaggatgaaaggaaaagtgtccggtattcagccgcgcctccgttttgattttgattcggtcatggcattcccggcacatatatgtatgaatcggacgattgcggaggcgtttggctgtcagtgtttcatcatcaatttgttcaattttgtcgcaaatggaacattttactctcattgattttcacctctttcactatgacaagcattatatcatggatgcccctcctgccaaagggaaagaaagcagcgcccttcttttggagcgggcgctgctttttactggcggtttttcatatgatgatccgattgatcgttctgttcgttctgcagcttgttctggtctctttggttcagctgatcatcattcgattgagtcggtgattctttttcattgtcggtcacatcattcgggacttccggcatgacacgaccgacgatggcggcaagttcgtccaaaatgcctgaaacggggcggccggctttaatgtcgctgcccatgcctctcagacgggaaaccgtatcaggatcagccacgacaacggcattggcgccgtaaggatcgttttttaacgcctgggcgaccgtgtatttaatgctctccactttgcttctttctaaattgtcatccacatcgattccgacaacggagtatcttccgagtacaaccgcggtggcatctgaaatgccggggattttttcggttacctcgacgagatgcttagcgatgtctgtccggccgggattttcagctgtctcaggagccgtattttttacatgaatcggttttgcatcacgctgatcggttgattcgttctggatattgcggccgcggccgtcctgtacagcagtgcagccggtcaggataaacaaggcttgtatgataatgaaaagaattcgcacgtcagattccctccttgaatgctttcatttattttattgttgaattaaccttctatctttattcaccaaatcatatattttagcaggcatccccgtttttcgcggaaagagaagcacacgatgggctttgatccttatttcaggaggctgagacttgagtaaaatttatgtgttagatacgaatgtacttttgcaggatcctaacgccattttttcctttgaagaaaacgaagttgtcatccccgccgtcgtgctggaagaggtcgattcaaaaaagcggtatatggacgaggtcgggagaaatgcgaggcacgtatctaagctgatagacgggctcagggagaaaggaaggctgcacgagaaagttccgcttcaaagcggaggaacgctcagaattgaactgaaccaccggtcatttcatcagctccaagaaatttttatcgaaaaaacgaatgataaccgcattttggcggtggcaaaaaatttaagccttgaggaggaaacgaaagaaaacggccgcctcgtcatcctggtcagcaaagatgtgcttgtcagggtaaaggcggatgccatcgggcttttggcggaggactttttaaacgacagagtcgttgaccatcatgaaatatatagcgggtacaaagatatatttatgaataaagagcggtttgcctcgttttataaaaacaaacaaattccagtcaaggagcttcagcagcatcaggtttatccgaatcaatttgtgctgatgaaagatgaattaggaggatcttcgtctgcggtcggcatggcggataagaaaggagagaccgtaaaaagactcgttttcgatgatgagcacgtatgggggatcaggccgaagaacgtccagcagacaatggcgctcgaactcctgctgagggaagatatcccgcttgtcaccctgatcggaaaagcgggaacgggaaaaaccttgcttgctctcgcggcagggcttctgcagacggaggatctcggtatttataaaaagctgatcgtcgcgcgtcccatcgtcccggtgggaaaggatatcggatatttgccgggcgaaaaagaggaaaagctcaagccgtggatgcagccgatctttgataatcttgaatttttattcaatgcgaaaaagccgggtgaacttgaagcgattttggcaggaatcggatcgattcaggtggaggcgctgacatacattcggggaagaagcattccggatcagtttattattatagatgaggctcagaatctgacgaggcacgaggtcaaaacgcttttgacaagggtgggagagggcagcaaaattgtcctgatgggcgatccggagcaaatagatcacccatacttagacagtttaaacaacggacttgcttatgttgtagagcggtttaaaggacaaaccgtctccggcagcgtgaagcttgtgaaaggtgagagatccggccttgcacagcttgccgccgatttgttataaaacttcgatttctgtgacgcccgttatcggtttttcaaagtctccgtccacgtaaaaatggaccggaccgccgtcttgaagcggtttccccgcatcgctgaaatgcgcgattgcgtccatcgccttttcaagcggcacttcggttctttctgattttgaaataaatgcgcacaggacagcgctttctttcggctcggcatttgctaaaacagcgccgagcttcatggcgaagctgccgttcatcagtctttctttttcataacgtttttcactttttaaagtcggcggcgaaatgcgcccttctctgatcacccgttcaggatcaagcgtatgctcctgggtttctgcagagccgtcctgatgaacaggctgattgttttcaaacggaaatttgcggtcatcgaaaatccagacactcggatcaattgtaatcgggtatgtaacattgccttttacttgaataacgctcatgttgaagcccccctttacttaaagtataaaagttttcgcatgaattgtcactttgcgttgcaaattagatgtatacaacggcagcgaagtgaggatgatcgacatggtatgccggcattaccaagagctggacgcattagttcaggaagcgaaaaaaagaaccggagaaggcaaagtggcagactatattccggctctggctgaatctgaacaagacagcctttcggtcacgatttatcatgcggaaaatacatgtctgacggcaggagacgccgaccggacatttacgctgcagagcatttcgaaagtgctttctctggcgctcgtactgatggattacggaaaggaaaaggtgttcagctgcgtgggtcaggagccgaccggcgacccgtttaactccatgattaagcttgaaacagtgaatccgggcaagcctttaaatccgatgattaatgcgggagctctcatcgttacgggtttaattaaagggcattcgccgaaagaccgcctggattacctgctcggattcatcagaagacttgcgaacaatcaggacattacatattgcagacatgtcgcggaatcggaattcaaatcttccatgattaatcgggccatgtgttattacatgaagcagtatgacatttttaaaggcgatgttgaagaggtcatggatttgtatacaaaacagtgcgcgattaagatgagcagtctggatttagccaaaatcggctgtgtattcgcccttgacggcaagcatccggaaaccggggagcaggtcattaaaaaagatgtggcgagaatctgcaagacgtttatggtgacatgcggcatgtacaatgcgagcggggaattcgcaatcaaggtcggcattcccgctaaaagcggcgtttcgggaggaatcatgggcatttcgccgtacaacttcggaatcggtatattcggcccggcgcttgatgaaaaaggcaacagcatcgcgggtgtgaagcttttggaaatcatgtctgagaaatacaggctgagtattttttgaaacattttttatcataacatctgcttaaatcctcttgcaatttcatctgataccctttatgataaatagaagaattaggtactcgcctggggaacggagggatacttttggcttcagagattatagttgaccatcagcagaaagcattcgagctgttgaagttagatgctgagaagattttgaagctgatccgagtacaaatggataacttaacgatgcctcaatgtcctctgtatgaagaggtcttggatactcagatgttcggactgtcgagggaaatcgattttgctgtccgcctgggattagttgacgaaaacgacggcaaagagctgctggacagacttgaaagagaactgtctgctttgcatgacgcgtttacaggaaaataaatgatcaaactcaaactattcaacggtttgggtttttttataaccgtaaaccgtttttttgcatcttcttttcgtaagacggtctcttaatctgcatttcatccgaaaaactataaagaaactgcgtaaattgtttatgaattatagtaaaatataatacgcaataggtattaaacgtaagctttaagcaggaaagaggatgttatgtttaaaagaatgttaaaatcttacgattattcattgatatgcgctatcattctgctgtgcagtttcggattggtaatggtatacagctcaagcatgattaccgccgttatgcgttacggcgtgagcagcgactatttctttaaacggcagctgttcgccgtcatcgcggggtttgtgctgtttattatcgcggccgtttttccgtacaaagtgttcgcccatcaaaagattcagaaaatcatactgcttgcgtcagtggctgcgctttgcgcgctgtttgttttcggacatgttgccggaaatgcgcaaagctggtttaaaatcggcggaatggccattcagccgggggaatttgtcaagctgaccctgatactgtatcttgccgcggtgtacgcaaagaaacaaagctacatcgatcagcttttgacgggggttgcgccgccggtgatcgtcaccgtagtcatttgtgcgcttatcgctattcagcccgacttcggaacggcgatgattatcggtctgatcgcgttttgcgtcattatgtgttcgggattcagcggaaggaccctgctcaggctggttctcatggcgggaatcgtattactccttgtcagcccgatcatttatctgaaatgggacgatattttgacacccgggcgtatgagccggtttgaaagccttgaaaatccatttaaatacgccagcacatcaggtctgcagattataaattcgtattatgcgatcggctcaggcggttttttcggtctcggtcttggagaaagcattcaaaaatacggttatctgcctgaatcgcatacagactttattatggcggttatttcagaggagctcggcattttcggcgtcctgtttgtcattgtgctgctggcttttgtggtgttaaaaggtttttatattgcgagaaaatgtgaagatccgttcggaagccttttggcaatcgggatatccagcatgattgcgattcagacctttatcaatctcggcggtgtcagcggtttaattccgatcacaggtgttccgctgccgtttatcagctacgggggatcatcaatgtttttgttattgacgagcgccggtatattggtgaatgtcagcatgcatgtcaagtactcagaaaagaagaaaaagagggagcccgttccgtctaaaggggtaaaaagacggcagacggaaaaatctgtgtatctctaaaaaacaagtgtatacacagggcggatattcctttattataaactacatatttattaggccaagggggagaaaagtttgtcacaacaatccatccaaaaagtgttagtagcaaacaggggagaaattgcgatccggattttccgggcgtgcacagaattgaacatcagaacggtagccgtttattcaaaagaagattcgggctcctatcatcgctataaagcggatgaagcttatcttgtgggcgaaggcaaaaaaccgattgacgcgtatcttgatattgaagggattattgagatcgcaaaaagaaacggcgttgatgccattcatccgggctacggatttctctctgaaaatatccaatttgcgagacgctgtgaagaagaggacatcgtattcatcggaccgacgtcagcgcatttggatatgttcggagataaggtaaaggcgagggagcaggcggaaaaagccggtatccccgttattccggggagtgacggaccggctgaaacattaaaagatgtcgaacaattcgcaaaagtccacggatttccgtttattattaaagcatcgctcggaggcggaggccgcggcatgagaatcgtccgaagcgaaagcgaattgaaagaatcgtttgagcgggccaaatcagaagcgaaagccgcattcggaaatgatgaagtgtatgttgaaaaactgatcgaaaatcctaagcatattgaagttcaggtgatcggagataaagaaggcaatgtcgtccatctgtatgagcgggactgttccgttcagagacgccatcaaaaggtcattgaagtggcgccgagtgtatctttgcagcctgaattaagggacgaaatctgtgaagcggctgtggcgcttgcgaaaaatgtcggctatatcaacgcggggaccgtggaatttctcgtagcgggcggtgaattttactttattgaagtgaacccgcgcgtacaagtggagcatacgattacggaaatgataacgggggttgatatcgttcagacgcagattctcgtcgcgcagggccacggactgcacagccgcgccgtcaatatcccagagcagaaagacatttttacaaacgggtatgcgatacaatcacgtgtgaccactgaagatccgctgaatgactttatgcctgacacgggtaaaattatggcttaccgctcaggcggcggtttcggcgtccgccttgatacgggaaacagcttccagggcgccgtcatcacaccttattatgattcactgctcgtcaagctgtcgacatgggcgctgacgtttgaacaggcatcagcgaaaatggtccgcaacctgcaggaattcaggatcaggggcattaagaccaatattccgtttcttgaaaacgtggcaaagcatgaaaaattcctgacgggccaatacgacacatcgtttatcgacacaacgcctgagctgtttgttttcccaaaacagaaggaccgcggaacaaaaatgctttcctatatcggcaatgtcacggtgaacggttttccgggaatcgggaaaaaagaaaaacctgcatttgataagcctcagaccgttacgttagatatcggggaaaagccggcaagcggtacgaaacagattcttgatgaaagaggcgccgagggacttgcagactgggtgaaagagcaaaaatccgtgctcctgaccgatacaacgttcagggatgcccatcagtccctgctcgcaacacggatcaggtccaacgatttgaaaaaaatcgcgaatcctacggctgccctgtggcctgaactgttcagccttgaaatgtggggaggcgcgacatttgatgtagcgtaccgtttcttaaaagaagacccttggaaacgccttgaagatctccgtaaggaagtgccgaacacattgttccagatgctccttcgttcatcaaatgccgtcggttatacaaactatcccgacaatgtcattcaaaaatttgtccggcagtcagcggagtccggtatcgacgtattccggatctttgacagcctgaactgggtaaaagggatgacgctggccatcgatgccgtccgtgaaaccggaaaagtggcggaggctgcgatttgttacacgggagatattcttgataagacccggacgaaatatgatttgcaatattatctttctatggcgaaagagcttgaggcgtctggtgcgcacattctcggcattaaagacatggccggtcttttgaaacctcaagccgcatacgaacttgtctcagcgctgaaggaaacgattgatattcccgttcatcttcatacgcatgatacgagcggcaatggcgtctttctctatgccaaagctgttgaagcgggtgtggacatcgtggatgtcgccgtcagctcaatggcgggtctgacttcacagccgagcgcaagcggattttatcatgcgcttgaaggaaacagccgccgtcctgaaatggatgtccggcaggtggaaagactgtcacaatattgggaatccgtccgtcagtattacagtgaatttgaaagcgggatgaagtctccgcatactgagatttataatcatgaaatgccgggcgggcagtacagcaatctgcagcagcaggcaaaaggagtcggcctgggcgatcgctggaatgaggtgaaagacatgtacagcgttgtcaaccgcatgttcggcgacgtcgtgaaagtaacaccttcttccaaagtcgtcggagatatggcgctttacatggtgcaaaacaatttaacagaacaagatgtttatgataaaggcgaaacgcttgattttccggattcagtcgttgagctctttaaagggcagatcggtcagccgcacggcggatttccggaaaaactgcaaaagctcgttctgaaaggacagacgccgatcacggtaagaccgggtgagctgcttgaaccggtatcttttgaaggcattaaagaagaatggaaagaaacgcatcagatggaattgagtgatcaggacgcaatcgcgtatgctctttatccgaaagtatttactgaatatgttaaaacggctgaacgcttcggtgatatttccgtattggacacaccgactttcttctacggcatgacactcggtgaagaaatcgaagtggaaatcgagcgcggaaaaacgctgatcgtgaagcttgtatctatcggtgaaccgcagccagatgcgacacgtgtcgtttatttcgaattgaacggccagccgcgcgaagtggtcattaaagatgaaagcattaaatcgtccgtacaggaaaaattaaaagcagatcggacaaacccaagccacattgcggcatccatgccgggaacggttattaaattgttaacggaaaccggggcaaaggtgaataaaggcgatcatctgatgattaatgaagcgatgaaaatggagacgacggtacaggcgccgttctccgggacaatacagcagattcatgtgaaaaacggtgaaccgattcagacaggcgatttactgatcgaaattgaaaaagcgtaaaaaataaacataaaaaacctgatccgccccgtgtgcgatcaggttttttatatgtgaaaaggccgaagctttgatgcttcggccttttcatgtgcctcagatgttccgctgttttgattcatagcggaagcgggcgattaataataagaaatagcataagacaccgaacagaccggcaataaagagcgaatgggcaagtgcaaagccggtggccatttctgaataaacaaccatgattccggagagcgcctgtaatacaacaaaggcaagagccgctatccagcccccaagaatctgtttttggtctttgtaggagcgcaccgcatgcgcaaaagcgacaagaatccatacgaacagaagcagcgctgccgttctgtggcccatctgcacccactcctgaaaatgagacggaagtccgtggttcagtctgctgcaaagcggaacgtcaggacaggcaaggcttgattttgtatggcgcacataagcccccgtataaacgacgatatacgtgtaaatcgaaaggccgatcatatgaaactgcattttcctgccgattctgagcggcttgacgagctttttgtctgatttatcagcttcaaatatgagcagcgtcaaaatcagaacagaagcgaaagaaatcagcgatatgccgaaatgaagcgccataacgagcgcatttgatccgaaaacaaccgctaatgcgccgagaagcgcctgtaaaaataaaaagataatggacataatggcgagaaaggttgtttcacggaaaacaggcgtgacttttctccatgcccaaaaagcgagactcagcacgagaacgattgagacaccgcttgcgagtctgtggctccattcaatgatagaagcggcgttaagctccgggaaaaaccggccgtggcaaagcggccactgccttccgcatccgagacccgatcctgtttttgtgacaagagcgccgccgatcagcacgacgagcataacgaacgtcgtcagcacgccgagcgctttcaaagctttattcattttacattcaccttcttaacaaactggacaaaatgatatacgtaccaagtgtaagcgaatatgtgttttgtggcaattctcaattctgtttgttcacaaaaatataatagaatcaggacttcttagataatggggttgattattccagatgggtctgatagaaataaagtaaccgctttattatgaagccggcggatttggtaaaattcataaaaagttcacaaataaattcctgtttctcgtttaatatttaagaggatgtttttttacaggtcattatcttgtatgatagagttgcaggtcttaaaaaacctgctttaggtttgtaagggaggtttacgttatggctaattccagaattttaaacgatacagctatagacggacagattgaagagacgacggcatggaaggatttcctttcgcttatcaaaataggaatcgtcaattcgaatttaattacgacttttaccggcatgtggcttgcgttacatatatccggtctgagttttttaggcaatttaaacaccgtgcttcttacattaataggatcttctttgatcatcgccggttcttgtgcggttaacaactattacgaccgtgatattgatcatttaatggaacgcacgaaagtaagaccgacggtaaccggaaagattcagccgaatcaagcgctgtggtcaggaattttactcattgctttaggacttatcatgcttttgatgaccaccgtgatggcagcagtcatcggttttatcggcgtgtttacgtacgttgttctttatacaatgtggacgaaacgccgttatacgattaatacggttgtcggaagtgtatcaggcgccgtgccgccgttaatcggctggacagcggttgaagggcacatcggtgttgtcgcgtgggttttattcatgattttattcatctggcagattccgcactttttagcgcttgcgattaaaaagacggaagattacagagcagcgaatattccgatgcttccggtagtgcacggctttgaagtgacgaaaagacagattatcgtctgggtcgcatgcctgctgccgcttccgtttttcctcggcagtctcggtcttccgatcgtcattctcggcactttgctgaatgtcggatggcttgttctcggactgatgggattccgcatgaaaaacatcatgaagtgggcaacccttatgtttgtctattcgcttaactacatgaccatttattttgtagcgatggtggtcttcacgctgttttaattgaataatgagcttgtttgatcgccaaaacaaacaatgacaactagtaaacgccgccttgaccttttgtttaatcaggcggctttgcttttatacatagatggaattttaagtaaaaaatctcatattttaagaaatgaggaaatgaagtatttcggctggaagcagatttactgcttgtgcatctcgtactgattcaaaaaaggggttgggtgaaatgttaaagcgttggcgtcttttatcattattagccttagtgccgcttttattgagcggctgtggaaaaccgtttctgtccacactcaagcctgccggcgaagtggctgataaacaatatgatctgacggtgctcagcacacttatcatggttgtcgtcgttgcggtcgtagcagttattttcttttacgtcattgtgagattcagacggtcgcgtataggggaagacacgataccgaaacaggtggaggggaaccgttttttagaaatcacctggaccgttattccgatcctgcttctgattattcttgtcattccggttgtcatcgatacattggcactggcggatacgtcgccgatggataagaaaaaccgtaaagcagaggatgcgctcgtgattaatgtaagggcgaatttatactggtgggaattcgagtatcccgattacgggtttgtgacaagtcaggagctgatcgttcccacagatgaacgcgtctatttcaagctgaagtcctcagatgtgaaacactctttctggattccgtcagccgggggaaaaatcgatacgaatacggataatgacaacactttctttctgaccttcgattctaaacgcagcaaagaagcgggagaatatttcttcgggaaatgcgcagagctgtgcggaccttcacatgcgctgatggatttcaaagtgaaaccgctgccgtcaaaagaatttaaacaatggacgaaagcgatgaaaaattataagcatacaacagattccgatttagcagcacaaggagaagagctgtttaaggaaaaaaactgcctgagctgtcatgcggttgagcccaatgataaacgggctgaagcggcaagaacggctccgaacctcgctaccttcggtgaacgggtcaaagtggccggcattaaggatgcgaataaagagaatataaaagcctggctgaaaaatccggacagcattaaaccgggcaataaaatgacaggcacttatccgaagctctcggacgctgaaacggatgcgctgtatgaatatttaaaagggctgaaagcggagaacaagtgaggacagggagatatcagggggaggtcgcaaatgatgaatacgcttacaggacagcaaagaaaaagctctttgctttgggattatttgacgacggttgaccataagaaaatcgcgattttatatatgatcgccgggggatttttcttcgtcgtcggcggacttgaggccatgcttatcaggattcagctcttgaggccggggaacgattttatgggtgctcagcagtttaatgaaattatgacgatgcacggcacgacaatgatcttcctggcggcaatgccgctgttattcgggctgatgaacgcggttgtgccgctgcagatcggggcgcgtgacgtatcattcccatttttgaatgcgctcggattttggctgtttttcttcggaggcatctttttgaatctgagctggtttttagggggcgctcctgatgcaggctggacgtcgtacgcgtcgcttgcgctgaattcgaaagggcacggcatagactttttcgtgctcggcctgcaaatatcaggcttaggtacgctcattgcggggatcaattttctcgccacgattattaatatgagggcgccgggtttaacgtatatgagactgccgctgtttacgtggacgacatttgtggcgtcggcactcattttattcgcatttcctccgctcaccgtcggtttggcgctgatgatgctggatcgtttgttcggaacgaatttctttaatcctgaattgggcggcaatacgataatctgggagcatctgttttggattttcgggcatccggaagtatacattttaattcttcccgcctttgggattttttcagaaatcattcccgtatttgcgaggaaacgtctgttcggttattcgtctatggtctttgcgatcgtgctgatcggctttctcgggttcatggtatgggttcaccacatgtttacaacgggactcggaccgatcgctaatgcgatatttgcggttgcgacgatggcgatcgcggtgcctaccggcattaaaattttcaactggcttttgaccatctggggaggaaacgtcaaattcacgacgcctatgctgtatgccgtcgcctttattccttctttcgtactcggaggagtcacgggtgtcatgctggcggccgcagcggcagattatcagttccacgatacgtattttgtcgtagcgcatttccactacgtcattatcggcggcgttgtgttcggcatcctggcgggcgtgcatttctggtggccgaaaatgttcgggaaggtgcttcatgaaacgatggggaaaatttcgttcgtcttattttttatcgggtttcatcttaccttcttcattcagcattttctcggcttgatgggaatgccgcgccgcgtttacacatatctgcccggccaggggcttgataccggcaacctgatcagttcaatcggcgcgtttttcatggcaggcgcggccgctttactcgtcgtcaatattatttatacctcaataaaggggaaatacgtcgggaacgacccgtggctggacggtcgtacgcttgaatgggcggtctcttcgccgccgccggaatataattttaaacagcttccgtttgtccggggacttgacccgctgtggattgaaaagcaggccggaaatgaagggatggcgcctgcagagcctgtagaggacattcatatgccgaacggctccatcatgccgtttatcatatctttcgggctgtttgtggcagcgttcgggtttttataccactccgattattcatgggggcttccggttatcttcatagggctcggcatcacattctttaccatgctgcttcgctctgtggtcgatgattacggctatcatattcacaaagaagatctgccgaatgatgataaaggggtgaaggcgtaatgcagctgcaggaaaaaatgacggctgaaacctttccggcttctcctgaaaaagcaacgctggaggggaaaaataagtttttgggattttggctgtttctcggcggcgaaacggttctgttcgcctcgctatttgcgacattccttgctttacgggaatctaaagccggagggccgtcaacggctgagatgtttgagctgccgatcgtgtttatcgcgacgatgcttcttttgacgagcagcttaacgagtgtgtatgcgatgtatcatatgaaaaatttctcctttaaaaaaatgcaggtgtggcttctggttaccgtattattgggagcgggatttttaggggttgaaatctatgaatttatgcattacactcacgagttcggatttaccattacaagctctgcgctcggctcagcgttttacacgctcgtcggcacacacggagcacacgtggcgttcgggctgttgtggatcagcgcgctcatgatccggaatgcgaaaagagggctcagcctttataatgcgccgaaatattatgtggccagcttatattggcattttatcgatgtcgtgtgggtctttatctttaccgttgtatatttgatggggatggtgggataacgatggacgataacaaaaacagagagactgtcagtacggatcttgaatatcggagaaggaaaaatgccgaggagatgaaatatcaggtcatctccttcggcttgatgatcggccttacgcttgtcgcgtttttgacggtggctgcagacggcattgccggatggtttacgatgccgtttctgatcctgcttgcggtcattcaggtcatctttcagctgttttactttatgcatatgagccagaaggggcatgaagcgccgtcattatttctgtattcgggaatatttgtcgcgtttatcaccgtgcttgcatttgtcacgattatttggtggtaatcggggcggcggggagtgagagatttgattaatttggaaatgttcgggtttcgcgcaatgtggagcccgtatctgttttgtataactgccgtgataacaggtgtttacttttactggtgcagccggcataaaggacgtgtggccgttaaggagaaggtgctgtttgtgctttccgcgctatttttttacgcggctgcgggaagtccggtcgatttattgggccatgtgatgttcagcgcccatatggcgcagatggcggttctgtttttagtcgtaccgccgctgttgatctccggaattcccggctgggcatggaaaaaactgatcttccgtcctgtcgtaaagccgctgttttcatttttttcaatgccgcttatcgctttagtgctgtttaacggtattttttcgctgtatcacatcccgtttatatttgatttcgtcaaaacggattcgctgtatcacacgctgatgaacggactcatctttgtaacggcgttttttatgtggtggccgcttgtgcataaggtggacggtctgccccgtctcagcggtttaatgaagctggggtatattatggcggacgggattttgttaacgccggcctgcgcgctcattatgttcagcggggcgcccatgtatgccacgtatacagatccggcggcttgggccgaagcaatgaagctttgcgttcctttagatttgctggaggagatccctttatccgggccggagatgtttaacacgctacctcctctggaagatcagcagcttggggcagtgctgatgaaaatcattcaagaggcggtctacggaatatatttggctgtcatcttttttcagtgggtcagaacggaacgggaaaaagatacgctgtcagagccgccgtatatcgagcataccgtctcataaaaaaaagtacagcagaatatgctgtacttttttattacatttgcactgtttttaatgactcttccaattcaagcagtaaagctttgctttcagcgatgacatgttccggaaattcttcagcgctgccgtattctacgccgtgcggataataatgctttcctaaaagaggggccttcagctgaatcacggcccgtctgccgccgacatcgccctcttttgccgttccttgaatccgcagataaaatgtccctcaggtactgaaaactttttgtcgtaagtcactctttcataatcccattgtccagccagaatgagccctttgccttccatcagatcgttcaagcggctgagctccgctgttaccccttcaagaccgctgttttcaaacttcaaaccttccccctccttttaaaaatgccctttcctgacaatcatagtatgaaagcgttacactttcaatgattcatacggtgaaagtatgcaaaaacaaaaatttgacgacaatagtagcagaaaaaaggaggaattccgcaatgacaaagatcaataagctcatgacgtcagacttgcaatattgtacagtattagataatgtatatgaagctgcggtgaagatgaaagacgcggatgtcggcgccattccgatagtggatgaagacggcgccacacttgtcgggatcgtgacagacagagatctcgtattacggggaattgcttcaaaaaagccgaactctcaaaaaataaccgacgcaatgacagagcgggttatcagtgcagaagaagacgcctctgtggaggaggtgctccatttgatggctgaacatcagctcagaagaattcccgtcacaagggataaaaaactggtcggcattgttacgctcggcgatctttcgttggccgagcaatcaaatgagcaagcaggccgggcgctgtctgacatttctgaagacggaggtccggaggggtttatccattaaacataaatcacggacgatgcaaataggctgtactgtataagagtacacaaaaacagaacggtttgatgatatggggtgagaggttgaaaaatattgcaagggctctcgttatccttttgcttatttacggagcgtatgttctgtttatacaatatggatcggctcctcagaaaaagaccaatcaggaggagcctcaggtttccaatgaagaagagagcggaaaacggctgaaaatgccgtcatccggactgctttctctcatggggaaatctgccgccgatgtgaaaaagaaacttggggaaccgtcccggaaagatccttctgcctacgattacgagtggtgggtgtacaaccaggggaaagaccaatacgtacaagtcggtattttgaatgataaagccgtgactttatacgcttcgggaagcggcatcaacgcaaaaccgtttaagatcggcgaatcgacgggcgaagtttttaaaacgacgcaggtttctccttttgtcaatgtgactgacaagggaaacacgtatcggtttgagttttccgaagaagatatcaatacccgtcccaccgtcaagataggcggaatgtatgttcagctgtacatggacaaatttgacgggaatctgtcaagcatcagggcttttgatgcggaaacgctggtgaaacaaaggccgtatgaggtcatgtacagaggaaagctgacagaacccgagccagtttctgataaaaaatggaacgacattgaacgagcgagtgaacagcagattctcgacattacaaatgtcatccgcgtgaaacacggactggcaaggctgaaatgggacgaaggcgccgcgaaagtggcattcggccacagcaaggacatgaaggataacaagtatttctctcacgtctcaaagaaatacgggactctgaaggaccgcttggaaaaaggcgatgtgaaataccgggaggccggtgaaaatattgcctacaactatgtggacggtcctgcagccgtggagggctggctgaacagcgaaggccacaggaaggcgctgttaagcccggattatacgcacctcggtgtcggcgtggaccggaagtattatacgcaaaacttcattaagccttggcagtaaaaaaccgcagaggggcgcgtcccccgcggtttttttatgatttttcgcgagcggcgctcctgctgaaaaaaatatacctgctttttttcgcaatttaggcgaacattaaggcgcatgaaccgatacattatagcaggcaaaacttttcggagggggtgagaattgtggcgaatcagcaatcacggcaatcaatcgatgattttaaacaattcgtaaaaaagcatcccaaactgatccaaaatgttcgcaaggaacaaagaagctggcaggaagtctatgaaaactgggttctcctgggcgaggatgattcgatgtgggacccttttaaagacgaggccgttcagccttcttccgacgcggaaaccaaacaggaaccagctgaaaagaacgatttcgtttcaaaaatggtcactgccgtcaaaaagatggatatcaaccaaatgaatgagcagatcaataaaatgagccagtccatttcatcattgcaaagccttttaagccaattttcggggagcagcacgaagcagccccggcaaggctccggacaacatcctttttcattcagaaaggattaaagaaggggatcgtgtatgcgaaaagaggttcaggaattcatatccgcagatgaggaacggaaacggtttatacggcagcgtcccgtctggtaccgcagacttgcgagaaaaccggacgatctcaattcctttcagcttgacatgatgaatttttatgaaaagacgataccgcatcgggtaagtcaattctcaaacgggattcaaatggcgcagatgatgatgcagatggtacacgccatgcgttcgcaggattaaaaagcgtttaaacgccgcattttccaattgggtggtttcatggtaaactagcaactggaggtgcgtatttatgtatgcaacaattgagtccgtcaagcttcaaagtgaagcggaacagcttgccggcatgattctgcagtctgagacggctgaaaattaccgcgattgttacaagcgtctccgtgaagatgaagaggcagggcggatcattcgttcttttatgagcgttaaagagcagtatgaggatgtgcagcgctttggcaaataccatcctgattatagagagatttcccgcaaaatgagagaaatgaagcgggagctcgatttaaacgataaggtggccgaatttaaaaaagcggagactgagcttcagtcgctgcttgacgagatcagcattgaactcggaacggccgtctcggagcatgtaaaagtgccgacggggaatccttattttgacggcctgtcatcctgcggcggcggctgcggttccggcggcggctgcggatgcaaagtttcctgacgagacggccgtctcgtcttttacataaaatgaacagaaagtcaggcgggtgatcatgatggaaaataagcgccaaggcataatcgtatatctgcattctttaaaacacagcaaaatgctgagaaaattcggcaacgttcattatgtttccaagcggctgaaatacgttgtgctgtattgcgatatggacctgatcgaaaaaacaatggaaaagatttcttcttattcttatgtgaagaaggtagagccttcttataaaccttttttaaagctggaatttgaatcaaagcttgataaagcgaaagagtacgattataaagtcggtatataaaaaaatccccgcagatacctgcggggtccttctattccttaacaagttaaggagaaggaaaagggagaggagaaaccggaggaagaacttatggggaaacgtaagtcttctccgcggttggcaacaacatcattcattgatgctgttacacgtagtcttgacaggaatgtgaatatgtatacacgtttttcacgttcattgtttgaaagaatgctttatgataagatagggattgtttttatacataacggctcagccgatgagaaacatcaaagttttcagaaaaagtggtgtgaataatgagagtaatttccggttcaagaaaaggacgagccttaaaggcggtgccgggcacatcaacaaggccgacgacggataaagtaaaagagtctatttttaatatgatcggcccgtattttgacggaggaacagggctggatttgtttgcggggagcggcggcctcgggattgaagcgctgtcgcgcggatttgaccgctgtatctttgtggatcgtgatttcaaagccatccaaacggtaaaagcgaatatcaaagcgctcgatctgctgtcttcatcggaagtataccgcaatgatgcagagcgggccctctatgccgcggcgaaacgggaaaaaggttttgacggaattttcttagatcctccgtataaggaacaaaagctgaaagcgcttatcgaaatgattgatgagcagaacatgctgaatgaagacggttttgtcgtagccgagcatgataaagccgttgtgcttcctgaagccgtcggcgcgctttctgtaacaagaagggaaatttacgggcttacaggagtgacgatataccgaaatagggggtaatgatgtggcaagtatagctgtatgtcccggaagttttgatcccgtcacctacggacacctggacattatcagacggggggcaaacgtgtttgagcaggtgtacgtatgcgtgctcaataattcttctaagcagccgctgtttacagtcgaggaacgctgtgagctgttaagagaagtgacaaaagacattccgaatattacggtcgagacgtcacagggactgttaatcgactatgcgaaaaaaaagcgggcgaaggcgattatcagggggctcagagctgtttctgacttcgaatatgagatgcaggggacttccgtcaaccgcgtgcttgacgaatcaatagaaactttttttatgatgacgaacaatcagtactcttttttaagttcaagcatcgtaaaagaagtcgcaaaatataacgggcctgtttcagagtttgttcctccggaagttgaacaggcgctgaagcagaaatttaaaggatgagaagcgctgatcggcgtctcatcctttttttgtccgtgctgacagcctgtaacaataaatcaatgcgtatacggcgagagctgtcagcgtgatggcgggcccggtttcaacaagtgtattccatccgctgacggcagcagatcccgcgtcctgatcgcggaaagggaggaatacggactggtaaggttcgtccaatgcaaggtaaagcggcttccacagtaagagaataaagagtgcggcataaatgccctgaaggatacgcgccgcgaaaaacggtttaaagcggatatctgtttccgataaaatgccggctacctgggcctgtacggaaaggccgctgaacccgagaataaaactcacaatcatggctttcggcagcaaggcggcatcagcttcactgaccagcttgctcccaagtgtaatttcaaacattccgctgataagagggatgtccagatttgccggaagatgaaaaagggaaagcagcgcgtttgtaaatacagaaagcacatccatgacttgtacgattgataataaccggctgaaaaccgaaaacaatataataaaaccgcccaccatcagcaaggtttgtacagaagaggtgacggcgtcgcccaaaatttttccgagcggccgcttttccgaaagccgcgccttgtggagggccagaaatgcttccttcagagaagggagagcgatcgtctttttaccggtatacgccgcttcttctttccgtccgtatgaacgcatcgtcaggccgacggcgatgtttccaagatagtgagccgatgccagcagaatgccgagagacgcgttatgaaaaaagccgaccgccacggcagcgaatataaataacggattggatgaattggtaaaagagacgaggcgttcagcctctactctggagatttgtttatcctggcgcagccgtgcagtcagcttcgcgccggccggattgcctgaagccatgcccatagccagtacaaatccgccgacccccggcactctgaaaatgggacgcataaagggttcgagtaaaaggccgacaaatttgacaatgccgaatccgattaaaagctcagatagaataaaaaacggaagcaatgaaggaaaaacgacctcccaccacatggaaagaccggttttggaggcttcgaatgaggcctgagggtgtgaaataaccgtcgccgtcaaaaaaatgaaaaacaatgaaatcaaaaatgtatgaaacttagacaaattcattcttacctccccgatgctaaaattgcacactgacatttatatcatgataaaatatagaacagaccttaaaggcggccgggcaagtacctatttgtcatcctgtactaatatacgagcataggggttcaatttagaccatagaattcatgtataggatgtctattagggggttcgtcgcgttggccaaacctacaatcgggttagcgttaggttcgggaggggcaagaggcatcgctcatctcggagtgttatccagtttacataagcatcagattccaattgatatgattgccggcagcagcatgggagcattagtcgggagcttttatgcggccgggcatgacgtggctacgatgaaaaaagtcgccaaagcatttaagcggcggctgtatgcggattatacgatgccgaggctcggatttttaaaaggagaccgcatcaggcagctcgttcatgcctatacgtacggcaagccgatagaagaactgcggatcccgctcggcatcgtggcctgcgaccttcagaccggcgaaaaactcgtttttacgaaaggttcagtatccgaagccgtccgcgcgagcatcagcataccgggcgttttcgtcccgcaaaaaatgaacggacgtatgttagtcgacggcgcggtggtcgacagaataccggtgtccgccgtaaaagacatgggtgctgatatcgtcatcgcctctgacgtatcccgggtgaaaaaaacggaaaaagcggcacatatttttgatgtaatcatgcaaagtatggatatactgcaaaatgaattggtccgtcaccagaccattgccgcagacgtcatgatccgcccttctcttgaatcattcagctcaagttcttttgccaacattgatcatatgatcacagcgggcgaagaagccgcagaccggatgatcggccggattaaacaagaaatagagaactgggagggctaactcatatgaaagcaaaacattttcgctgggtgtttatcatcctgatcttattaattgctgttacatttattaagcttccgtattacattacacagccgggagaagcatcagagctgagaccgctgattaaggtggacggaggctatcctgaaaaaggaagcctttccttgatgactgtcaaagtaggccccgccaatccgtatacatatctttgggcgaaagtgcatccttacgatgaaatcgtccctgatgaaagcataaaagaagagggcgaatcggactcggattatatgaagcgccagctgcaaatgatgaaaagctcccaagaaaacgcggtcattgccgcttatcaaaaagccgggaaacaggtgaaatactcatttaacgggattttcgccagctcagtcgtctctgacatgccggcaaaaggaaaaatagaggtcggtgataaaatcatcagcgcggacgggaaaacatacgaatccgctgaaaagctgattgattatatcagcagcaaaaaagcgggggagaaagtaacgtttcacattgaacgggacacgaaagaaaagaccgttgacattgcgctgaaatcattcccggacgacccgaaaagagcgggaatcggcgtcgcgttatatacggatcggaacgtgaaagtaaagccggatctccatttcagcattgaaaatatcggcgggccttctgcgggtctcatgatgtctttagaaatttacaaccagctgacaaaacctgacgaaacaaaaggctataatatagccggaacggggacaatcgacgtggacggcaaggtcggaccgatcggcggaatcgatcagaaagtcgtcgccgcagacaaagcgggaaaagatattttctttgcgccgaatcaaaacggagctgaaaattctgattacaaaaatgcggtaaaaacggcgaaagcaatcaagtccgatatgaagatcgtccctgtcgacaccatgcaggacgcacttgactatttggatcatctgaaagtaaaaagcacctgatacaggcaggtgctttttttacgcattcaaaaaacgctgttcgtcttcatcatagcggatcggcgcttgtgaaaattcctgtttctcaaaaaatgtgcgttcaggttcttttatcggcaggctgtaaacccgtcccgccagtatgtccagatccagagcgggatgagagaaagaagagagcttgctgacgagaggtgcggtaagctcttttttctttgccgacaggtacgcctgtccttttttcgtcattccgagaagacggatataaggagcgcttgaaggctgtaagagccgatgcatgtcctcctttttcgtccgtgtcagaatgtgcgtgttcatccgctgcagcctcgtccacgtgtatcgttttgttttcaatcgttccatcatttcgcgataggatcgggcttgtctgatggtgcgcagaattctgtgctcaaggccttcttccacttcatagattcggctcaattcttcagcggacagagtgctgaggctgtattttacatatgaaaaatagtcttcggtgctgtgccatatcccgtatgaatttctgtatgcctccagctcacgcgcagacgcttccgggagaaagctccttgcggccgccgttcctttttctatcagcgctttccggatgcttgttgcgctggctatccggctgttatctccgggaagctcggcgtcatgatactgggaagcgattctggctgtcgtataaggcttcatagcggaaccgaaggcgtgtatcgctctaacgtagtgaaaaccgagaatattgttcggcttggacaaatcgagcatgtcccgccctttgaatatgtgtgaaaaagcttttgaggcggcggccggatagctgagaccctttttcagctcctctttcagaatcaggctgcagtcatcttcctttcggctgaacgcttcagacgcttcaataaagggttcgatccgcccgttttcgctgccgaaaaacaagctgctgcatcctaaatgatgaagaagcgaaacgctgccgcgcgcgaataattccgctttttgtacggcatacatataagggagctcaatgacgatatccacgccgttttccagcgccatttttgtccgggcccactttgagacggcggccggttctccgcgctgcaaaaaagggccgctcatcaccgccgccgcgacgctgctgtccgttttgatttttgcttgttccgcatgatagcggtgtccgttatgaaagggattatattcaacaaccaggccgactgctttcatatttgtcccgcctttcttgctatgttttgcttcgtgtggtacatttgcaaatgaagtgcatattttagtccgtttcgtttagtgtatgcatagcctatccggctgtcaacgattgcatgacggcggcattatgctgtaaagaaaaaatattgacaaaaacattctgaaaagctataatcatgtttgttgctttcctgaggtgatacaaatgaaatggacgatttatcagcttcatcaaatggcgaaaaagagctttgaatttgatgaaacagttgagttaaatgagctgacaaaattgaattctgacatccgccgcatttctcccgtccgggtgaagggccgcgcggagattgaatccaagcaagtttcgtttgactttacgatttcaggcgaaatggttttgccgtgctcaagaactttagttgatgtgccgtatccatttacaatcgcgacaaaagaactgtttagatttcataagtcggatgatatagaagatgaggacgttcatattgctgaagacgatatcgtcgacttaactccgatcgtaaaagaagagattcttttagaaattcctatgcaagtcttttgtgaaactgaacaaaaagaaggagccgctccccaagtggggaaggattggcaagtgatttctgaggaagacaagaaaaatcaaatcgaccccagacttgcggatctgaaaaagctcttaacacaagatgatgaatcttaactctttaaggaggtgggaataatggctgtaccttttagaagaacttctaaaatgaaaaaaagattgcgccgtacacatttcaaactaaatgtacctggtatgacagaatgcccgtcatgcggagagatgaaattgtctcaccgtgtatgtaaagcatgcggatcatacaacggcaaagacataaatgttaaaagcaattaatgtatgaagaaaagcgcgggaatctcggttcctgcgcttttctttttttttgcccctccggcctgcttccgccgaaaaaattgtgagcgccagtagtctatctaatctatcagcggcatatgtatgaggtaaatgagcaaatatggagggagatacgattgacgataacgagacaagacgcgtggacgcaagatgaagatttgctgctggccgaagtggtgctcaggcatattcgggaaggcgggacccagctttccgcttttgaagaagtcggcagagcgctgacgagaacggctgccgcctgcgggttcagatggaattcttatgtcagaaaacaatatcagtcagggatagaactggcgaaaaaacagcggaaggaattaagaaagcagatcggggtgcattccgccaatctgccgggaaccgtcaaacagcctccgatccgcagggcggaaggagaaaaagagctgtccattgatgatgtcattttgtttcttcagcaatttaaagagtcgccggccgcagcggatgtgcgtcatgaaaaagaaaaactcacagaacagctgaccgcgctgcaaaaagaagtcgaggatctgcgtgaggaaaatgaaagcttgagaaacaagctggagatgacggaagaagattataaagcgttaattgacattatggacagagcgagaaggatggtcaattcaaaagaagacgacaggaaatcggcgcagagcctgtaaaatgaaccggcctgagggcggcggcccggccggttttttattatgccgtttctccggatgtcatttcaccgtccatatcgggatgccagatgtaaggattttctcctttatcacgcgccatatcatatttaacgggctcaaaattcatcttatcccagaattctgctgatttcatgcgtgaatttgtcctgatcggcattctgaaggattttgcaaaatcaacaagcgcttttccgtatccgttgttttgatagcccggaagaacctcaagcttccaaagttccaaaaagtcctgacgctgatcaaaatacggattcgcgcctccgtttacctgatataaactcattctcgccactagtttatccccgaagtaaatcccgtaaaaaggcgaggtgctgtcattttcaatgatattatcctgaagatcttcaagcatcgacagctcctgcatcccgtattccttaaaccttttaaattcttcgagtgtcttaaagttgatgagcaggcgctctattttcaacacaaactccccctttgttgtgttctaccattattgtaaacgctttaattgaaaattccaactataatatgcttgcctgtctttttgctcaaaacgaaattgaagtaatttgcggcggcttctgctatgataatatggaaaaatgcagatatagggtgtgacagtgtgaaaatcggaattatcggcggcggagcggtaggccttttatgtgcttactacttatcgtcccgccatcaggtaacagtcattacgcggcggacggagcaggctgatgcgattaactcaggcggtatacggcttttgaaagacggaatagaatgtacggcggcatgcagagcgcaaacaggcatcacttccggattcgacctcttaatcgcagccgttaaacagcaccagctcagtgctgtgctgcgggatcttgagacggtaaaagggacgaatgtgctgtttttgcaaaacggcatgggacacatacacgacattagagattggcatacggatcattcgctttatgccggcacagttgagcacggagcaaaaaagatatcggatcatgccgttgaacatacgggagcgggagccgtaagatggagtgtattcagcgcatcccggccggaaacgctcaaaagcatcttttccggcatgcaccgggattttcccgtatatgatgaaaacgactggtatcggcttttaacgggaaaactgatcatcaatgtatgcatcaacccgttaactgcattgctgcgcgtgaaaaacggagagctgttaagaaatgacgcttacaaaaaatatatgagaaacgtgtttgaagaagcggagacaatacttggcctcgccgatagagaaaaagcgtggaacaaggtttgcgaagtttgcagactgacggaaaaaaatcattcttccatgctcgtcgatatcatggcaggcaggcggaccgaggccgatgcgattatcggctaccttgtaaaagaagcggaaagccgcggattgccggccgttcatctcacgtttttacaccgcagcataaaagcgttagaaagaaattgaaacaaagtcttttgaggttttccggtaacatgctatactcatttcggaaacctaactatttattggagaaaggaagttccagacagatgcagctaactgaactttccatcaaaagtcaaaataagtttgtgcagcactatatagatggagaaaacatgtcttcattttttgattatgatattcattcagaggacgtatggcaaaagcggcttcatgacctctcttcgcggccgtttgccagagaggaattagcggattatttatcctcctatcacgaaaaatttcactccgccgccatgcaggcctccatcgaaaaactgagagatccaaaaagcgcagcggttgtaggcggccagcaggccggtcttttaacggggcctctttacaccatacataaaattatctccattatcgtacttgccagacagcaggaagaggcgctgcagattcctgtcgctccgattttctgggtggcgggtgaagatcacgatctggaagaaattaattatgtgcatacgtcaacagagaataaaggtccggtgaagcggaaactgccgcagtcgtactggaaaaaaacatcggcggctaaaaccgagcttgatcaggaaaaatgcgcggcttggattgatgaagtgttcgctgcttttgaggaaacggatcacacaaacacactccttcaaaacgtgaagcgatgtttacgctcatcagagacattcacggacttttttgagctgttgatcgccgacttgtttcaagaagaaggccttattctgatgaattcgggagatccggggattaaaaagctggaaacgggtatgtttcagcagattttaaaacacaatcacgagcttgtcaaagccgtgtcagaccagcagcgtcttatgcgggaagccggttatcacccgattattgaatcggacaaagatcaggctaatctgttttacgaacacgagggagagcgtttcttaattgaaaaagaaaacggcgtttttgtcattaaggagcttgacctgaagtggacgaacgacgagcttcatacccatatggaagaaaaaccggaatgtttcagcaataacgttgtgacaaggccgcttatgcaggagtttctcatcccgactctggcgtttatcgcgggaccgggggagatcaattattggggtgagctgaagcaggctttctcattaatgggcttccgcatgacgccggtagtgccgagactgaacattacgattcttgagcgccatattgaaaagaagctttcagaacggaatattccgcttcaggaagcgatcgaacacggcaccggacacctgaaagacgcttattttgaagagcagattccggaagagttttcttctgtaatggaacaggcgaagtcgcagattgaagctgtccataaaagcgcaaggaacgaagcgctgaaggtcgattcaagccttgagccgctcttacagaagaatgccgccttcattcaggatcagctcttgtttttagaacggacggtaacgaaaagaattgaagaaaaagaaggttttgtgctgcgtgactatgaaagaatccaaaacagcatcagaccgctcggcgctccgcaggaacggatttggaatgtaatgtattatttgaaccgttatggtccaaaattcttcacaaccttcaaacatctgccattttcttttcaaaaccaacatcagattgtcaaactttgaaataaagttttaaagaaccctgaatagttcagggtttttttttatgtgtaaacagtgtaaaatgaggttgtggagagaagtggcggatagtggtgagtttaggggagaaagtggggtccttatcatgtttatgggtgaataccagcatacaattgatgcaaagggccgcatgatcgtacccgcaaaattcagagaaggcctcggtgagcagtttgtgctgacaagaggacttgaccaatgccttttcggctatccgatgaatgaatggaagctgattgaagaaaagctgaaggctctgccgctcaccaaaaaagacgcccgcgcatttacccgattctttttttccggtgcgaccgaatgcgaactggacaagcagggaagggttaatattgcgtcatctcttctgaattacgcaaaactggaaaaagaatgtgttgtcatcggggtttccaatcgaattgaattgtggagtaaggtaatatgggaacaatacacagaagagcaagaagattcattcgctgaaattgctgaaaacatgattggatttgatatataatggatcttcgtgcatcacaacaacaactgacaattcaattcattcctgataaaggtgggaccgacacaaatgtttcagcataagacagtacttcttcgtgaaaccgtcgacggtttaaatatcaaaccggacggaacctatgtggactgcacccttggcggcgccgggcacagtacatatttattgcagcaattatcggaaaaaggacgcctgatcgcctttgaccaagatgacacggcgcttgaaaacgcacagaaaacattgtccgaatacaaaggacagctcattctggtaaaaagcaactttcgttatttaaaagagtgtttacatgaacacggcattacgagtgtcgacggaattttatttgatttaggagtatcctctccgcagcttgatacaccggaacggggattcagttatcatcatgacgcaccgctggacatgaggatggaccagtcggccgcccttacggcgaaagaagtcgtaaatgaatggcggtatgaggaccttgtgaggattttctttaaatacggagaagaaaaattcagcaagcagatcgcccggaaaattgaagaggcaagagaaaaatcgcctattcaaacaaccggccaactggtcgatctaataaaggacgcgataccggctccggcgagaagaagcggaggtcatccggccaaacgtgtattccaagccattcgaattgccgtaaacgacgagcttcaggtatttgaagaggccctcttgcaagcgatagaggtgctgaagccgggcggaagggtgtctgtgatcacttttcactcgctggaagacagaatgtgcaagacgacattcaaggaaaaatcatcacttcccgaactgcctccgggtcttcccgtgataccggaagaatttgaaccggaattaaaactgattacgagaaagcccattacggcatcaaaagaggagcttgaagaaaataaccgcgcccggtcagcgaagctccgcattgcggagaaacgaaaataacgggcagcaaatgacaacattaaaggaggtcatcagcctatgagcaacttagcttaccagcaggaaaaacaacaacggccagtgataagtcccgaaaaaaaggtgattgtcaaaaagagggcttccattacactcggggaaaaggtgctgctcgtcctgtttgccattgccgttctctccacatcaatgtttatcgtatcaaaggcatacgcggcgtaccaatccaatattgaggtgcaaaaactggaggagaaagtatctgagaagaataagcagatcggtgatctcgaaaagacggctgctgacttaagccagccgcagcgcctgatggatatcgctaaaaagcacggtttgaatctgaaagataaaaaagtgaaaaacatacaggaatgataacccatgccgaaaaaaaataagtttatgaacagaggagcagcgatactcagtatttgtttcgctctctttttctttgtcattctcgggagaatggcgtacattcaattaaccggtaaagcaaacggagtagaacttgcaacaaaagcgaccgagcagcacgaaaaaaagcggacgatagaagcgagccgcggctctattcttgaccggaacggcaaagtgcttgcagaggacacggcgacatataagctcattgccgtgcttgataaaaaaatgacgagtgatccgaagcatcctcagcatgtcaaagacaaagagaaaacggcggaaaaactggcgaccgttatcaatcttgataaaagcgagattctggacatcttaaacaggaatggcgcgaagcaggtggaattcggttcagccggccgcgatatctcttatgcgaaaaaacaaaagatcgaaaaaatggatcttccgggtatttctttcttaagagatacgaagcgctactatccgaacggcatatttttgtcaaatgttctcggctatgccgatgtgaatgaaaaaacaaacgagatacaaggctctttaggacttgaaaaaatactgaataactatctgacggaacgtgacgggtccgtcacttacgaaagtgataaatccggctggaaacttccgaacagcaaagaaaaaatcaccgcacctaaaaacggtgacaatgtatatttaaccattgatcagaaaattcaaacctttctagaagacagcatgacgaaagtagcggaaaaatataaaccgaaaaaaattatggcggctgtcgtagaaccgaaaacaggcaaagtgcttgcgatggggcagcgtccgagttttgacccgaatatcagaaacgtcaccaattattacaacgacttagtgtcgtacgcgtatgaaccgggttcaacgatgaagatctttacgcttgccgcggcgattcaggaaaatgtgttttccgcaaacgagaaatataaatcaggaacatataaagtgggaggcaaacctgttaaagattggaacgatggcgccggatggggtatgacaagcttccatgacggcctcatgaggtcatcgaatgttgctttcgccaaactggccaacgaaaaactggggtttgaccggtttaatgagtacctgcacaaattcgggctctatcaaaaaacagggattgatctgcccggtgaagtatcaagtaaaattaactacaaatatgattttgacaaagcgtctacggcttacggccaagcatcggcgataacaccgatccagcagcttcaggccgtcacggcgattgccaataacggcaaaatgatgaaaccttacgtcattgatcatattgtcgaccccgatacgaaaaaagtcgtcaagcagacaaaaccggagcaagttggcacgccgatttcagccgatacggcgaaaaaagtccggaacctgctcggagaagtcgtgacgtcagacatcggaacgggaaaaccttataaaattgaaggttttgacgtcgcgggtaaaacgggaaccgcacaaatcgccgggacaggcggatatttaaggggaacgagcaactatgtgttttcattcatgggcatggcgccgaaaaatgatcctaagctcgtcatctatgtagccgtgcagcagccgcagttaaaagcgggtcaaagcagctctgatcctgtcgcggaaatctttaacccgacgatgaaaaacagcctccactacatgaatatcgaaccgacggaaaaaacagattccggtcaggaagaaacgaaaagccaaaagatgcctgacctgacagataagacagtcacgggcgctgagaaggaagcgaaaaatgaacatctcacaccgattgtcatcggcagcgatgttgccgtaaaagagcagtatccgacagccggagaagatgtgatcaccaatcagaaaatcttcttaaaaacagacggaaagatgacgatgccggatatgtccggatggtcgagacgggaagtgcttcaattcagcaaagtatcaggcattcacatcgatgtgagcggtgaaggttacgcttcaagccaaagtgtgaaaaaaggcaaagaactgaaagaaaataccgtgatcaaggtgaaatttaaaaatcctgattaacgggacagagaagtccgcggatgcccgcgggcttcttttttatgcgccgccgttctatgtgtccaagctgaggcataaattgaaacaagcctaaataaggagtggacggtcccttgcgcgtttcaaatgtaacggttcgaaaacgtttattactggttttgctttttggcgtaatcatttttttgatcattgacagcagattaggctatgtccaatttgtgatgggagaaaagctgacttcactggctaaggattcctggagccggaatttgccgtttgagcctgagcggggagaaatccttgaccgaaacggcgtgaagctggctacgaataaaagcgcgccgaccgtctttgtcgtaccgcgccagattcaaaatcccataaaaacgggcaagcttctcgcgtcagttttaaatatgtcggaagagaaggtctacaaacacattactaagaaaacctccatagaaaaaatctcacccgaggggcggaaaatttccaataaaaaagcgaaagaaatcaaagcgctcgacttaaaaggggtttatgtggctgaagacagcatccgccattatccgtacggaagctttttgtcccatgttctcggttttgcgggtattgataaccagggccttctcggattggaggcttattatgatgatgacttaaaaggtgtaaagggatcagtgaaattttatacggatgccaaggggaagaaaatgcctgatgaagcggatgattacacccctccgaaagacggacttgatatgaaattgacgattgacgccaaggttcagacgattatagaaagagagctcgataatgcagcggcgaaatataatccggacggaatgattgcggtcgcaatgaatccgaaaaacggggaagtgctcggtatgtcaagccgtcctgattttgatccggctgactatcaatccgtagatccgtccgtttacaaccggaacctgccggtatggagcacatatgaaccgggttcgacctttaagattattacgcttgcggcggctctccaagagcaaaaagtaaacttgcaaagagaccacttttatgacaaaggatttgccgaggttgacggcgcccgcctccgatgctggaaaaagggcggtcacggttcgcaatcttatcttgaagtcgttcaaaattcctgcaaccccgggtttgtacagctgggggaacggctcggaaaacaaaagctgtttcaatatattaaggacttcggctttggaaagaaaacaggcattgatctgcaaggggaaggaacggggattttattcccgcttgacagagtcggcccggtcgaacaggcgacaaccgctttcggacaaggggtttccgtcacgccgattcagcaggtggcagccgtttccgcagcaataaacggcggaacgctttatactccgtttatcgccaaagagtgggttgatcccgttacgaaaaaaacagttaagaaacaatcgccgattgcgaaaaggcaagttatttcccaggaaacgtcaaagcagatcagatatgctttagaaagcgtcgtcgctcagggaacggggcggaatgccttcgtggaaggatatcgcgtcggcggaaaaacaggtaccgcacaaaaggtcaaagacggcaaatatctcgaaaacaaccatatcgtctcctttatcggttttgcgccggctgatgacccgagcctcgtcgtgtatgtcgcggttgataatccgaaaggcacgattcaattcgggggaaccgtcgccgcgccgattgtcggaaatatgatgagagacagtctgccggagctcggcgtgaaaccgcgaaaaaatcaaatcgagaaaaaatatcaatggaacgacacaaaaacaatagaggttccgaatgttgtagggatgtctgtctctgatcttgagtcgctgcttgtcaatttgaatattgactcctcaggaaaaggaagcaaaattgtgaaacaatcacctgcagccggaacgaaagtaaaagaaggctcaaagatccgtgtttacttgagtgaagaatgagtctttttgaggcagccgattgttttcggctgccttttatcataaagagaaaaaaagaagataacttttaagattaactggatgtatccttttatttacgctaaaatatgaactgtatgtttaaaagccattctgacttttataaacggttatcatgataaaagaatgaatagaatttctgagaggtttgatacaatgaaacttacaaagctgcttacatatttaatggccgaacctgttcaaaatgactttcatgaccctgacataacttcaattgagatggactccagggaagtgagaaaagggagtctttttgtgtgtataaaagggtatacggtagacggacatgatttcgcccaaaaagccgcagaaaacggcgcagcggccatcgttgccgagaaagagcttgacgtcgatgttcctgtcattatcgtccgccggtcacagcgggcgctcagcgttctttctgacgcgttttacgggcagccgacaaagcagcttcagcttatcggcatcaccggcacaaacggcaaaacatcaacgacgcacatggttgatgagattttcaaaaaagcgggaagacagaccggtttaatcggaacgatgtacattaaaatcggggatgagacattcccggtcaaaaatacaacgcccgaaagcgtcacactgcaaaaaacgttcaagaaaatgaatgatgagcatgttgacacagctattatggaagtgtcttctcacgctctgtcactcggcagggttcacggctgcgattatgatatcgccgtattcacgaacctgacgcaggaccatttagactatcacaagacgatggaagactacagacaggctaaaagcctcctgttttcccagctgggcggctcctttaaccatgaaaagccgaagcgggccgttttaaacgcagatgacaaagccagtgcttattttgaaaaagtgacggcggcgcacatccttacatacggaatcgagaacgatgccgatgtcatggcgaaacaaatcgagatctctgcgcaaggcacaaattttgaactcgttacgccaaaaggaacaaagcagatcacggtttcactcgtcggccgcttcaacgtgtataacgtactggctgcagcggcgacagcgatcgcagcgggtctgccgtttgatacgatcacgagcgctcttgaagagctgcaaggtgtcagaggccggtttgaactggtgaatcataatcagccgtttcctgtggtcgtcgattacgcgcacacgcctgacagtctggaaaacgttctgaatacatgcaaagacatgacagagggcaagcttttcgtcgtcgtcggctgcggcggagaccgggataaaacgaaacgcccgaaaatggcggaaattgcggtgcggattgccgacgaaccgattttcacttcagataacccgagaagcgaggacccgctggccatattaagagatatggaaagaggggtagaaggcacctactatcacagtatcgcaaaccgcgagcaggctatcttttttgctattgccaacgcgaaaaagggagatgtggttctgattgccgggaaagggcatgaaacctatcagcagatcggcaatgaaacattcgactttgatgacgccgaagtagcgggaagagctattgttgagctgaataaaaagtaaaacaggaaagagtgttagaatgagtgaaatgaaaagaattacggggacacaatgtgaatatgataaatacgtatgtcgtttgaacgaaacgggaggagaaaagagcaatgcttgagcaagtgattttatttacaataataatgggatttttaatcagtgttctgatatctccgattcttatcccgtttttaagacgtttaaaattcggccaaagtatcagggaagaggggccgaaatcacatatgaaaaaatcagggacgccgacgatgggcggggtcatgattatcgtatccatcgctattacggcgattgtcatgacgcagaaattttcgcatctgagcgcggaaatgtttcttctgctgtttgttacgatcggatacggcctgctcggctttctggatgactatattaaagtagtaatgaaacggaatctcggattgacgtcgaagcagaaattgatcggccagatcattattgccattgtattttacggagtatatcattattgccatttttcaaccggcatcagggtgccgggcacacatctgtcaatcgatctcggctggggatactttatcctcgttctctttatgcttgtcggaggttcaaatgccgtcaacctgacagacggtctggacggtctcttgtccggtaccgcggctatcgcattcggcgctttcgccatccttgcgtggaaccagtcacaatatgacgttgcgattttctcggttgccgttgtcggcgccgttctcggttttcttgtattcaacgcccatcccgccaaagtatttatgggggataccggttcgcttgcgctcggaggagcgatcgtgaccgttgccattctgacgaagcttgaaattctgctcgtcattatcggcggagtttttgttattgagaccttatctgttatcttacaagtcatcagctttaaaacgacaggaaaacgaatctttaagatgagtccgcttcaccaccattacgaattggtcggatggtctgaatggagagttgtcgtcacattctggactgcgggactgctgcttgccgttttaggaatttacatcgaggtgtggttataagtggaaaacgaactttttttgcgaaaacaaaactttctggtcctcggactggcgaaaagcggatatgcggctgcgtcgattcttcatgaaaaaggcattaacgtcgtcgtgaatgatcaaaaagcctttgaagagaacgaacctgcccaaaggctttcagaaagaggaatcgaggtcatctgcggtgagcatccgacgtcactttttgatcagcatcacattaccattctgatcaaaaatcccggaatcccgtatgaaaatatcatggtggaggaagcgcaaagaagaggcatcccggtttggacggaaatcgagcttgcgtattatatcaccaatgcaaaattcatcggcattacaggttcaaacgggaaaacaacaacgacgaccctgatttatgaaatgctgaaagctgactcgataaaggcgctgatcgcaggaaatatcggcactgtcgccagtgaagtggcttatcatgctgacggtgatgaatggatcgtcacagagctttcttcgttccagcttatggggactcatgcgttcagacctgaaatcggcctgattttaaatgtgttcgacgctcatttggattaccatcacagccgtgaaaactatgaaaaagccaagcagaacgtgtatcttcatcagcttgagagtgatacggccatcgtgaatcaaagcgatgaaacagtcgtgcggcttgccgaaagcggaaaagccggcaccgttccgttttcagtgcaccaggaactgtcaagcggcgcatttattaaagacggaatgctgatgttcggcgatgaagcgattctgcctgttgatgacatcgtgctgccgggcgcgcacaatttagaaaatatattggccgctgtagccgcggcaaaaacggcgggcgcgtctaataaagcgattcagaaggtgctgacaagctttaccggtgtcaaacaccgtctgcagtatgtaacagcaatccggaatcgtaaattttataatgacagcaaagcgacgaatattttggccacaagcaaagcgctctccgcgttcaaagcaccggttattctgcttgcaggcggactggaccgcggcaacggttttgacgatctgaaaccgtatatggacaatgtcaaagcggtcctgacgttcggacagacagcgccgaagatagaaaaactgggcaatgagctgggaatacaacatgtcaaacgtgtcgataatgttgaacaagcagtatctgcggcgtttgcgctctcaaatgaaggagacgtcatcctcttgtcacccgcgtgtgcaagctgggatcagttcaaaacatttgaagaacgcggtgacatgtttatagatgccgtgcatatgcttaagtaagggcttgtctctgttcatcggcagccctaaatgacttatgcttggggtgtcgattgctttgactactaaaaaaacagcgcctgatttgttattagttatcattacgttattgcttttaacaataggattaattatggtctacagtgcaagtgcggtatgggcggattataaatttgacgactcgtttttcttcgcgaaacggcagctgctgtttgcggggatcggcgtcattgccatgtttttcattatgaatgtggattattggacatggcgcacatggtcgaagctgcttctgatcatttgtttttttctgcttgtgcttgtgctgattccgggagtcggaatggtgcggaacggttcaagaagctggatcggagtgggagcgttcagcattcagccttcggagtttatgaaactcgcgatgattgcgtttctggctaaatttctttctgaaaaacagaagaatattacgtcattcagacgcggattcgttcccgcgctcggaatcgtgttttctgcatttattattattatgtgccagccggacctgggaacggggacggtaatggtgggcacgtgcatcgtgatgatttttgtatccggtgcgcgaatcgctcattttgcgttcctcggactcatcggtttaagcggatttgcggcgcttgttctgtccgctccttatcggattaaacggattacctcttacttaaacccgtgggaggacccgcttggaagcggatttcagatcattcagtcgctctatgccgtaggtccggggggactgttcgggatggggctcggccaaagccggcaaaagtttttttacctgccggagccgcaaaccgatttcatttttgctattttatctgaggaactcggctttatcggcggttcgctcatattgctgctgttcagtattttattgtggcggggcgtcaggattgccctcggcgcgccggatttatacggaagctttgtcgccatcggtattatttctatgatagctattcaagtcatgattaatatcggcgttgtgacggggctgatcccggtaacaggaattacgctgccgtttttaagctacggaggctcatcactgacgctgatgctcgcagcggtcggcgtgcttttaaatgtcagccggtactcgaggtattgatctgtatcttgcctcatcactcatgatctattcgttatctataaaaaaacagacaacatcaataaccctgtcctaaaaaacagggttatcgctatgtgattaagggggacatacgaatgcgtattgcagtaagcggaggcggaaccggaggacatatttatccggccctggcctttattaaagaagttcagcgccggcatccggatgtggaatttttgtatatcggaacagagaacggtctggagaaaaaaattgttgaacgggaaaatatcccgttccgcgccattgaaattacaggtttcaaacgaaaactttcttttgaaaatgtaaaaaccgtcatgcgtttcttaaaaggcgtgaagaaaagcaaatcatatttaaaagagtttaaaccggatgccgttatcggtacaggcggctatgtatgcggtccggtcgtatacgcggcggcaaaaatgggaattccgacgatcattcatgagcaaaacagcctgcccggcatcacaaataagtttctctcgaaatatgttaataaggtggcaatttgctttgaagaagcaaaatcgcattttcctgctgaaaaagttgtgtttacgggaaacccgagagcctctgaagtcgtctcaattaagacaggccgctcattaactgagttcgggctgaaagacaatcaaaaaacggtgctcattttcggcggaagcagaggcgcggctcccattaaccgtgccgtgatagatatgcaggaagaattgaaaacgagaccttaccaagtgctttatattaccggggaagtgcattacgagaaggtaacggctgagctgaaaggcggaaaagccgctgataatatggtgacaaaaccgtttttgcaccaaatgccggagtacttacaatcaattgatgtcattgtggcaagagccggagcgacgacgattgcggagatcaccgctctcggcattccgagcgtgcttattccgagcccgtatgtgacagccaatcaccaggaagtcaatgcgaaggcgctcagccagcatgacgctgcaatcgtactgaaggaaaccgagctcagcggagaaaaactgatcgctgcgctggacaaaatcgtcatgaatgaagaaaccttaaaagacatgagtgagcggacaaaatcactcggtgttccggatgcggcagccagactgtacagtatcatggaagacataaaaaaatagagcaaatggaatgcggaggtttatgatggagaacgtaattcaggaattaagagaccgcgaagtcggcaaagtgctggaacaagaaccgctcgcgaaccatacaacgatgaaaatcggcggcccggcggacattttgatcatccccaacagtgtggaagcggtcaaagatattatggatattgtgaagaaacatgatctgccatggacggttatcggccggggttcaaatctgctcgtgcttgatgaaggcataagaggagttgtcatcaaactgggcgcgggtctggatcatttggagattgacggtgatcaggtgacggtcggaggcggctattcggtcgtccggcttgcgacttccatgagtaaaaaaggaatgtccggtctcgaatttgcagcgggcatccccggatcaatcggcggggccgtctatatgaatgccggggcgcacggatctgatatgagtgaaattcttgtgaaagcgcgtatcttatttgaagacggcacaatcgaatggctgacaaacgaagagatggatttcagctacagaacgtctgttttgcagaaaaaacgccccggcgtctgtctcgaggcagttcttcagcttgagcaaaaggaacgggaagccattacggcgcaaatgcagcagaacaaagattacagaaaaaatacgcagccgtattcaagcccatgcgccggaagcatattcagaaatccgctgccgaatcatgccggaaacctcgttgaaaaagcgggattaaaaggacatcagatcggcggagcgaaagtatccgaaatgcacgggaattttatcgtcaatgccggcggagcgactgccaaggacgttctcgacctgattgagtatgtgaaaaagacaatccgtgagcagtatgatgttgacatgcatacggaagttgaaatcatcggagggaatcgttaaaaggttctctgatttccatgagctcatgtgatatacttttaacaaatgtcaaacggcatcacagcatgccgtttgtttttcaatcagacgaatgtcaagctgtttcattcttagtgaggtggacaggcagtgaacccaaatcatgaaagagaaaaaatcgtaaatattgaagagcggattccgaaaatcaaagagcagcggaaacaaaaagcaaaccgccggctgatttcattcattgtgctcttttttatgatggtgctgatcatcgtgtacttgcagatgccgatcagcaaagtgtcttctgtcaccgtttccgggaacgaaaacgtgtctgtaaaagagatcaacgcgctttctgatatacataacggacaaaccgagttctggagtctgaacaagaaaaaaacagaagaaaagattgagcagaataaactggtgaaaaaggcggatctttcaaaagtatttcctaataaagtcagcattcacattgaagaatacaagacgatcgcgtatctgcagcggaatgatgtgtattatgaagtgctggagaacggcaccgtgctgccgaacgaagtcacgccggatgacgcgggcccgattttggttgactggacaaacgcgaaaaagcgggtcaaaatggcggagcagcttgataagctttccggttcgctaaagcagtcgatttctgaaatctattatacaccggtaaaaatggaccaggaccggatcaagctgtatatgaacgacgggtatgtagttaccgcttctattaaaacatttgccgaccggatgaagacctatccttctatcgtttcccagctggacggcgggaaaaaggggattatccacttagaagtcgctacgtattttgaagaatttaacaaaggtaaatccggcaagaaaaaagaaaatgattaatagttctaaagaactaattttaaggtgattcaaaagaatctattacaatcagcggggcagccgatataaccgatagcggaataattatgactatgtttgtttttgcccgggatatggctgccggacaaggggaaaattctcaatgcaatgggcgtgtcttcttcaatgaacattgcatttggaattttcctcctgtttcttcttttttcggatgtttctggcaatatctatagcttttctggaggttcatcttagtgtagactaatggaaagcgggtatatttgcatctggtttgcacattatggcaccgtgacaggaaatcttacggtaaggtgggccgtctctaaaaaaaataaaaaaaatgcgatataaaagaggatatacatagaatataacgaatagtttcattaaacataaattgtgagaaatcagataagaatttgttgatgctgttgtttttgttacacacttgtaaagccacattcattgtattgttgttccgcaaataatagaatagaatttgatcgaaatgtgaggaggtgccatagaatgaacaacaatgaactttacgtcagtcttgacatcggtacgtccaatacaaaagtgatcgtcggagaaatgacagatgattcccttaacattatcggagtgggaaatgtaccgtctgaagggttgaaaaaaggctcaatcgttgatatagatgaaaccgttcattctataagaaaagcgtttgaccaagctgaaagaatggtaggttttccgctgaaaaaagccattgtcggcgttaatggaaattatattcatattcaagatacgaacggcgttgtcgctgtttccagtgaaaacaaagaaattcacgttgaagacgtccgcagggtaatggaagcggcacaggttgtgtcggttccgcatgagcagctgatcgttgacgtcgttccgaaacagtttatcgttgacggaagagacgaaattaccgatccgaaaaaaatgctcggagtgcgcctggaagtagaaggcacgctgattaccggctccaaaacgatcttacataatttacttcgctgtgtggagagagcgggcgttgaaattactgatatctgcctgcagccgcttgcggccggttcggcggctttgtcaaaagacgaaaaaaacctcggagtcgccatgattgatatcggcggcggctcgacgacggtggcggtatttgaacaggggcacctgaaggagacagccgtcattccgctcggaggcgaaaacatcacgaaagatgtatcgatcggattgcgcacttccaccgaagaggctgaaagagtaaaaaaacaattcggacatgcattctacgatgaggcttcagaagatgaagtatttgaagtcaccgtcataggaacgaatcaaaagcaatcttttacacagcaggaaattgccaatattattgaagcaagagtggaagagattcttgagattgccgcagccgaaattgagcatatgggaattacagatctgcccggcggctttgtgctgaccggcggacaggccgcaatgcccggagtgctttcattggcacaggaagtgctgaggcacaatgtaagggtcgcaagcccgaattatatcggtgtaagagaccctcagtatatgacgggtgtcggcttgatacaatttgcctgccgaaatgccagaattcagggaagaaaaataggctttcatatgccggaagaagccgtgcaggaaatcgcggtctctcacgaagaagaacatcatcagcggccagaggcgcagcagcgtccaaaagcaaaacaaaaaacacaagccgaacacaacaaaccgagcaaaatgaaaaaactattaagcatgttttgggaatagattgatagtcattcggcagattaggaggatttagcatgttggatttcgaaacaaacatagacggcttagcatcaattaaagtaatcggagtaggaggcggcggtaataacgcggtcaaccgaatgattgaaaatgaagtgcagggtgtagagtacattgcggtaaacacggacgcgcaagctcttaacctgtcaaaagcggaagtgaaaatgcagatcggggaaaagctgacccgcggtctcggagcgggagcgaatcccgaagtcggcaaaaaagccgctgaagaaagtaaggaacaaatcgaagaagcgttaaaaggcgctgacatggtgttcgttacagccggaatgggaggcggtaccggaacgggagccgcaccggtgatcgcgcaaatcgcaaaggacttaggcgctttgactgtcggtgtcgtaacaagaccgtttacatttgaaggaagaaaacgccagctgcaggctgcaggcggtatcacggcaatgaaagaagccgttgacacactgatcgttattccgaatgaccgcattcttgaaattgtcgataaaaacacaccgatgcttgaagcattccgtgaagctgataacgtgcttcgccaaggggtgcaaggtatctctgacctcatcgcaacgcctggtttaatcaacttggactttgccgatgtcaaaaccatcatgtccaacaaaggttcagcattgatgggtatcgggatcgctacaggagaaagccgtgctgctgaagccgccaaaaaggcgatctccagtccgttactggaagcggcaatcgacggagcgcaaggtgttttgatgaacattacgggaggtacaaacctgagcctctacgaagtgcaggaagcagccgacatcgtcgcttctgcatctgaccctgatgtcaatatgattttcggttcagttatcaatgaaaatctaaaagatgaaatcgtcgtcaccgttattgcgaccggttttatcgaacaggaaaaagatgactcaaaaccgcagcgtccgactttaaaccaaggattgaagtctcaaagccaaaatgctgcgaaacgtgagccgaaacgagaagaaacacagcatcaaaacacggtgaaccgccatacatcacaaccggcggatgatgccctcgacattcctacatttttaagaaaccgcaacaaacgcggctgatgtaaaaaaggacaagaccacatggttttgtcctttttcttttttgtgcacagtcttccttcctatcccccatgatctatacagtgaaaaaagaagctttatacctatgacgaattgattgtttttaagtttcatacggctttctacagaatgtgacaatatctggatggaagattgtctacatttaacgtacagcatcgaaatgacaaacgattccaattatgaaggagggatacacattttatagggcgttaccaaataagggggatacgattgaagaaaaaaacgagaaacagatggacaggctccgttttaagcgcgattgtcgtcagttcactgttgtttccgggggcagtcggagcgaacagcacaccgggggcagtttcttttaccaaagatctttcttcctctaagagcattcagcataagatttccgattcagtcaagaagcgttttgaaaaaaatgataaagtcacgtttcttatcaaatttaaagagaaagccaatacgaaaaaagcggtcaaagaagcagaaaaaaatgccgagtctcattcgctttccgcagcaaaaaccgaatatcaaaagcggtcagccgttgtttcttctttaaaactggcagctcatgatgcgcagcagaatctgaaaacatatttggaaaaacaaaaaaagaaaggaaaggctgatcacatccattcctattatattgtcaacggaatggcagttactgcttcgaaagaggtaatggaaaaagccgcctcatttcctgaagtagaaaaagttcttccgaatgaaaaacgtcagcttactcaacggcaatcaaaagctccttttcaaatgaagaaaaaacaaaaagaggtcaaagcaaaggaaggcatcgaatggaatatcagccaaattgatgcgccgcaggcctgggcctcaggatacgacggaaccggcacggttgtcgcctccattgatacgggagttcagtgggatcatcccgcgcttaaggaaaaataccggggttacgatcctgaaaatccagcagcgccgaatcatgaaatgaactggtatgatgccgtgtcccataaagacgctccctacgacgatcttgaacacggcactcatgtaacagggaccatgacgggttcagaacctgacggctcaaatcaaatcggtgtggctccgggggcgaaatggatcgcagtaaaagcattttcagatgacggaggaaccgatgccgatattttggatgccggtgaatgggtgcttgcgcctaaagataaaaacggcacgccgcatcccgagatggcgccggatgttgtcaataattcctgggcgggcggttcgggaatggacgagtggtaccgcgatatggtgaatgcgtggagagcggcagggatttttccggaattctctgcgggaaatgaagacttatttacaccgggaggaccgggttcaatcgcaaatccggccaattatcctgaagcatttgcgacaggtgcgactgacatcgacaagaaactcgctgatttctcacttcaaggcccctcaccgtatcatgaaacaaaaccggacatttcggctccgggcgtgaatatccgttcttctattcctggaggaacatacgaaggcggctgggacggaacttcaatggccgggccgcatgtggcggcgacggcggctttgttaaggcaggcgaacgcctctattacggtcgatgaaatggaagacgttctgacgcgcaccgccgaaaagctgacagattccgtttttccggaatcaccgaataacggttacggccacggcctcgttaacgcttttgatgccgtttctgccgtaacggacggaatcggaagcgtagaaggcaaggtatcttctgcgggtgaagatcacaatccgcccagctttcatcatgaaccggtctcagaggcttacaaaggggcaaaccttccgttaacggttacagcagaagatgatgtaagcataactgaggtgatcctctcctatcagtttgatgaaggagagtggaaaacgacagccgccgttcaaaaaagcggtgatgaaaaaaagggaacataccaggcggagattccggacataacgggaagcaagataagttataaatggaccataaaagatttcggaggtcattctgtagaatctgatacgtaccgggctgacgtgaaaccgagcattacggcgggatacaaagaggattttgaatcacagccggcgggctggtccagttacgggacacatgatcaatgggaatggggtatcccgggttcagggcccggcgccgcattttccggagataaagtgtatgcgacgaatctgtccggcccttatgccgattcggccaacatgaatctcgtgatgcctccgattcaagttccggaaacagggcggctgtttttacaatttaaaagctggcacaagctcgaagaattttttgattacgggtatgtgttcgttctgccggaagggaaatcaaattgggagcaggcggccgtttacaatggtgattccgcaggatggaatgatgaagaggcggatttatctgcgtataaaggccaaaacataaagctcatgtttaatatgcagtctgacgaagtactcaatgaagacggatggtatatcgatgatatccggctttcaagcagccctctcggcaaggcggctaaaaaaagtaaacacaatagacaaacacctcccggccacctgaagaaaaaagccatcagtccgaaacaggccaaaccggcagtgaaatcacccggaaaaagagtgaaacgtgaaacaaacctcctgccgctcagagcgcaaatcagtgtcgccgagacggggaaatccgtatattccgaccctgcaagcggaagttacagcctgtcacataaggcgggaagctatacgctgaaagccgaggcttacggatttaagtccgcttcgaaacaagtttctattcaatcagacaaaaccgcacaggcagactttacactggagcaaatgccgtccggcacgctaaaaggaaccatcaccaatcagtccacaggcgaaccggtaaaaggggctgcgctttatgtggccgaggatgccgcaattgagccggcggtgacaaacgataaaggggaatattcgcttaaggcgtatgaaggctcctacacaatcaaagtagcggcaaaaggcttttacaatagcgaattttctgtcgacatcaaaggagatgctgaaaaaaacgtcaagcttaagccgtatgtcggttatgaaggggaaatcgcctatgataacgggacggaagaagccgcgctgtcatattttaaagccggcagcaaatctgccgttaagatgaccctcaaagacggaaaagaacacggtatgctgacgggaggcctttttaaattttggggcgccgactggcctgatccgggcggtaccgaatttcaagcagaagtatatgatgcatccggccctgatggagctccgggcagcaaaattgccggcccgttccaagctgaagcgcttcgaaacggcgagtggaccaaagtggatctcagctcaaaaggaatcgcggtcggaaaggatttttatcttgtgttccgtcagacgaaacccgatccttatacacctgccctgtcatctgatgacggcagcccgtactcgaacagaaactggcaatacctcgacggccgctggtcaaaagccgataaaacagacggaaactttatgatcagggctttggtcgactacgaagcttctgtgcctgagataacgtcgcctgaaaaccggtcatttacaaacaagaagtcaatcacggtgaaaggaacggcttcaccaaaaaccgctgtccgtcttaccaataacggtaaaaccgccgcagaaacgaaagcagatgcagacggcagtttccaggccggtgtcacactcactaaagatggcaatcggctgacagcggcatctgtgacagacagcgggtcaaccgacgagtcacgccctgtcacggtcatactggatgaggataagcctgatgtgacgattgacagtccggcaaacggtgataaaacaaataaagaagcagtgactgtaaaaggaaaagtgcacgacgcccatttaaaatgggtaaaggtgaacggaaaaaaagctgaagtaaataacggttcttatcaagcgagaacccttctggaaaacggcagcaatgagatcaaggtcacggcctcagatgaagctggtaacaaaacaacgaaaaagacggtaatcgatgtcaattacaatgctcccgtcatttccggattggttcccggagcggataaggaattaaaagccggagaatcagtgaaaatcgctttttcaagcggaaagaaattagacgcttccttcgtgatccgtctgcctctgacaaacgcccgggcagggagccaaaacgcaacagagcttccgctgagagaaatttctccgggacgatatgagggttactggacggcggcttcttccatcaaagcaagcggagcaaaaattgacgttatcgcaagagatgactacggaaatgaaacgagacagacggctaaaggaaaactttatatcaatgagtaaaaacagagcgctgccaaatcacggcagcgcttttttagttgaaggggacaatagaaaatcaaccttttcggccctcgacaaataaaacggttatcccttaaaaattgtactttaccctcaacattaattgacagactttcccacagagcttgctttatacttatgaaacaagagagagaaacagatatgtaagacaaaagaggaaaggggtcagatgtgaaaatctatctggatgtcatttggctgttgaacttttgttttgattctcttttgcttttattgaccgcctttattttaaaacgccaggtgaaaaaaagaagagtggccgccggcggtttcatcgggtcagccattgtgcttctgatgtttacgcctatttctccctttgtggagcatccggcgggaaaaatggcgttttcggtagtcatcgtgcttacggcttttggctttaaacggttccgatacttttttcaaaatttgttcgccttttatttcgcgacttttctcgtcggcgggggaatgatcggcgtacattccctgctgcagacagaatcaattgtgcagcaaggcgtaatggttacaagccagaccggattcggcgacccgatcagctggatgtttgtagttatcggatttccggccatatggtttttttcgaaaaagagaattgaagacatcgagacgaagtccattcagtacgatgaacttgtcatggtgcaggcggaattcagcggacagacaatccgcgcgaaaggattggtggattccgggaatcagctgtatgatccgctgacgaaaacgccggtcatgatccttcacattaacaaattcgctccgatcctcagcgaaaaggaaacggacttcatcaaatccgccagtccgcttgaagtgatagagcagcttgatgattcgttccgccatgcggataagctgaggctgattccatacaggggcgtcggccaggacaatcaatttttactctgtttaaagccggattacgtcacgattttaacaaaagacgagatgatcgcatgtgaaaaatgcctgatcggcatcagcacgaagccattatccgctgacggtgaatttgacggaatcgttcatccgaagatgctgacagggaaggctgtaaaacatgtttcctgacgaaaagtctgttattcatcatactcaaaacgcgtggtatttagaagggggaggaagatgaaaaaacttaagctgcgtctgacatatttgtggtataaatggctgatgaaactcggactgaaaagcgatgaagtgtattacataggaggaagcgaggcgctgccgccgcctttgtctaaagaagaggagcaggtgctcttattaaagctgccgagcggggatcaggcggcgcgggccatcctgattgagagaaacttacgtcttgtcgtttacattgcccgcaaattcgaaaacaccggcatcaatatcgaggacttaatcagcatcggcaccatcggtttgatcaaagcggtaaacacgtttaatccggaaaagaaaatcaaactcgccacctacgcatcgcgatgtattgaaaacgaaattttaatgtacttgcgccgaaacaataaaatccgttcagaggtgtcctttgatgaaccgctgaacattgattgggacggaaacgaactgctgctttcggatgtgctcggcacagatgatgatattattacgaaagacattgaagccaatgtggataaaaaacttttgaaaaaagcgcttgagcaattaaacgaaagagaaaagcagattatggaactgcgtttcgggcttgtcggagaagaagaaaaaacccaaaaagatgtagccgacatgatggggatttcacaatcttatatctcccggctcgaaaagcggattatcaaaagactgagaaaagagtttaacaaaatggtgtaaaattttttccatctgacagcccttactgctgcaaggattgccgccgccggatgtttatttctgtaaaatagcggtgcatatttttcccacccgaggagatacttaacgttgtacagcagctcctagtgggagggaaaaacgtgtcaagaaataaagtcgaaatttgcggggtggatacctccaaattaccggtgctcaagaatgaagagatgagaaagctgtttaggcaattgcaggatgagggcgatgattcagcgagggaaaagcttgtaaacggcaatctgcgccttgtcttaagcgtcattcagaggtttaacaacagaggagagtatgttgatgacttatttcaggtcggctgcatcggactaatgaaatccattgataattttgacctaagccataatgttaagttttcaacatacgctgtaccgatgatcatcggagaaatccgcagatatttgcgggataacaatccgatccgcgtctcgaggtcgcttcgcgatatcgcatataaagcgcttcaagtaagagagcggttaatcagtgagacaagcagggagccgacagcagaggaaatcgccaaagttcttgaagtgccccatgaagaaattgtgtttgcccttgacgccatccaggatccggtttcactgtttgagccgatttataatgacggcggcgatccgatctacgtgatggaccagatcagcgatgagcgcaacaaggatacacaatggattgaggagctggctctgaaagaaggcatgagaagactgaacgaacgggaaaaaatgattttgcgaaagcgctttttccaagggaaaacccaaatggaggtcgctgaagaaatcgggatatcccaagctcaggtctcaaggcttgaaaaggcagccattaaacaaatgaataagaatatccatcaataacggaaaaagcctttaaaccttgtttaaaggcttttttcatgcgatggtttacgtttgcaaaaaagtgatgtattctaatgtgtaaaagtttttagaaaatttaaataaagtaaacgggggaaacggcaatgattttacagctggacagtgtgtcattaaaaagaaacgggaaatggattttgaaagatattaactggcgcgtcgagaaaaacgaaaattgggtgctgtacggattaaacggagccggaaaaacggctttgctgaatatgttatgctcttattacttccccacttcaggagagatgcaggtgctcggccatcagttcggcaaaacagagctcggtgacaggctcagaaggaaaatcggccttgtttcggcaggtcttcagcacaaattatatgccgcggactccgcttttgaaatcgccctcagcggcgcgtacgcctcaatcgggctgtacgaaactccgagtgagcaggtaagggaaaaagcgatcggtcttctgaaggatttgggcgccatcagttacgccgacaggcggtatgaaacattatcacaaggggaaagacaaagagcgctgattgcgcgggcgcttatggctgatcccaaactgctgattttggacgagcccgtgacgggtcttgattttatggcaagggagcagctgctggacacgattacgtcgatcgccgaaaaagaaaatgcgccgtccatcctttatgtcacccatcacgctgaagaaattctgccggtatttgataaggcgctgcttttaaaacaaggcgaggtgttcgcctccgggaaaatcagggatatgctttctgacgagcggcttacagcgtttttcgatacgcctgtcaatgtcttatggaacaatggccgcccgtttttaacacgtgcaaaagaggcatcaaccgtaaaataacatcaattcaccctgggggtgctgccatgcggctgagagagacgttgtctcaacccttaacggacctgatccggatcatgccggcggagggaagcggtgaaaaaagcggaggaagatccgttttttacccgtttcattttaatgaaacgggttttttgatacagctaaaggggagatttccaatgcatcagattgatatgctgttacaacaggcggagaaacggaggcacgacttcatacatattgctgaaaggttgatcgcctttcccactccggccccgccagcaagaaatacggcagaagcccaaaagtgggtggccggctttttaaaagaaacgggctgctcggtcgatatgtgggatgtgtatccggaagatccgaatgtagtcggtgttttaaaagggacagattcaagcaggcatcaaagcctgattttaaacggacacattgatgtggcagaagccgggggcgaagattggaactctgacccgtttcagccgctcgtaaaagacggcatgctgatcggaaggggcgccgctgatatgaaaggggggttggcgtgtgttcttttctctctgaagctgatccatgatgccgcaattaagcttccgggcgacctcattgtacagtctgtaatcggagaagaagtcggcgaggcggggacgctggaatgctgcaaacgcggctatcacgcggattttgcggttgtcgcggatacgagcagcctgcatattcaagggcagggcggtgtcatcaccggctggatagaattgaaaagcaaacaaacatttcatgacggcatgaggcgcaatatgattcatgcgggcggaggcacattcggagcgagcgccatcgaaaaaatggcgaaaatcatcactgccttgggagagctggagcgccactgggcggtaacgaaaagctatcccggcattgcgcccggcaccaatacgatcaaccccgccgtcattgaaggcggaagacacgcagcgtttgtcgccgatgaatgccggttatggatcaccgtccacttttatccgaacgaaacgcacgaacaagcagccgcagaaatcgaagactatattaatcgtgtcgctgacagtgatctgtggctcaaagaaaacaggccggtgttcaaatggggcggatcttcgatgattgaagacagaggagaggtgttcccggcgctggaaatcgatccggatcatccggcagtttctgtcttggctgcatcacactctgccgtcataaaacaggagcccgtcattgatgtttcccaaaccgtaacagacggaggatggctttatcaggccgggattccgagcgtcatatacggccccggcgatttaaaaaacgcccactccgtaaacgaggaagtgtccgttgatgagcttatggactatacgaaaatcatgctgagatttattctcggctggtgcagccgcaaaaaagattgcccgatgtgacaaggttcagcccggccgttcatataataggaaaaagaacgggcaaagggcgtgatacggatgatcagcatatctgaatttcaaataaaagatgtggtaaacgtgtcgaacggaaaaaaactcggaagcatcggggatattgatattaacgtgacaacgggaaaaattcaggcgattattttaggcggcagcggaaaagttctcggttttttcggaaaagaagaggaaatgatcattccttggcgaaatatagttaaaattggggaagatgtcatcttagtgcgtgtaaatgaaccaaaggggggagcgtaatcctccctttacttgtaaaaagccggaaatctcaatgtttccggcacatttatttatctcatttttcaatcagccgctaaacgtatgcttaaaattgtgttaaaatgagtgggaaattacgcttttttaatgtttgtcgaaaggttggatctccatgaatacatatcacccgtttagtcttaccaccccctcggcactcatgatagaagactggaactgtgtgaatcagcttaacacaaaggtcatcgccggattcacaacgaaaaacggcggtgtcagcaatcctccgtatgagtcattaaataccgggttgcacgtccgggacgaagctcatgatgttgtgacaaaccgtgaagtcatagcgtccttatgcggtactgatctggattcctgggtgttcgccgaccagacacatgaaaaccgcgtccggcgcgtgacagccggggataaaggaaaaggagcgagagactattcttccgcattccgcgggacggacgggctctacacgaaagatgcgaatctttttttggccctttgttttgcggactgtgtgcccttgtatttttatgacccggtgaaatccattatcggcgctgcccatgccggatggaaggggacggtcaaacaaatcggacgcatcatgacggaacgctgggtaaacgaagaaggctcccgtttaacagatattcaggctgtcatcggttcgtccatcagcgcgggaagctatacagtcgacgaccgcgtcatcaatgaagtgcgggcgctgccctttacggctgaatccgccatatgcgaaacggaaaaaggccagtatcagcttgatttaaaagaggtcaaccgtcttcttctgatacattgcggcattccggaagaaaacatttcagtcagcggattatgcaccgaacgagagcatgaactattcttttcacaccgccgcgacaaagggaaaacgggacgcatgatgtcctttatcggaatgaaggaggcattagatcttgcgtgttgctgatcaattacgacatataaacgaaagaataaacgaagcatgtaacagatcgggccgaagccccgaagatgttaccgtcatcgcggttacaaaatacgtatcagctgaaagggctcaagaggccgttgatgccggtattacaagtctgggagaaaaccgggatgccgagcttatccataagcaggaagtcatcaaaggaagcccgaagtggcactttatcggcagtcttcagtccagaaaggtgaaggccgtcgttgaccgtgtatcttatattcattccttagacagactgtcattggcaaaagagattgaaaaacgggcgcagcatacggttcgctgttttgtgcaggtgaatacttcgcttgagccgtctaagcacggtttgaaaacagaggaggtcatcccctttatcagagagctttctgagtttagaaacatttctgtagagggcctgatgacgatggctcccctgacagacgatacagaaacgatcagagcctgcttccggcaattgcgtgatctgagggatcaggtgcaaaaactgaatcagacaaacgcgccgtgccgggaactgtcaatgggcatgtcaaatgattatgaaatcgctgttgaagagggcgcaacttttatcagaatcggctcttcattagtcggaaatgaaccggggggtgtaaacaaatgagcatgaaaaataaactgaaaaactttttctcaatggatgaggaggagtacgagtacgaatacattgaaacggagcaggatcatcaggaagagcatgaacagcagaaagataaacagcctgcttacgctcagaagccgcagggcaagcagaacgtagtaagcttgcaaagtgttcagaaatcctctaaagtggtcttgagtgaaccgcgtgtatatgcggaagcgcaggaaatcgccgatcatttaaagaacaggcgggcggttgtcgtcaatctgcagcgcatccagcatgatcaggcgaaaagaatcgtcgactttttaagcggtaccgtctacgccatcggcggcgacattcagagaatcggttcagatatttttctgtgcacgcctgataatgtcgacgtttccggcacgatttcggagcttataaatgaagacgaacatcagaggtggtaaagcaggatgattctttatcaaattttttccgttctgagttatttaatttacatctactcgtttgccctgatcatctatatctttatgtcatgggtgccgagtacgagagaaacggcggtcggacggtttctcgcagcgatttgcgaaccgtatttagagccgttcagaaggatcattccgcccattgccatgctggatatatccccgattgtagcgattatcgtgcttcggtttgccacgacgggactttggggcctataccgcatgatcgcaatgtatacttgaatgcgacagtttgatacgggcttggcaccagccaagcctctttacatagaaaggaaagaacatgagcgatatttaccagcacttcagacaagacgagcggccttttattgatcaggtgcttgaatggaaacagattgtcctggaccagtatcggatgaagctgactgatttcttagatcccagggaacaggtgattgtaaaagccgttatcggcgacgcctgcggtcttgcgtttttcggaggatatgacagagctgagcgcaaacgcgcgattttataccctgaatatatggaacctgaacaggatgattttgagctccgggcttttgacgttcaatacgctgaaaaattcgtcagcattgaccaccgctctcttctcggatcattaatggggatcggcttaaagcggcagaaatacggcgatctgattttctcagaggaagccgtgcagctcatcgtctccggtgaaatcgccgattttgtcagcactcagctgaccaaggcgggcaaagcgccggtaaagcttgagaaaatcgagctttccgctcttcacattcccgcttcagatgtcgaaataagggatgacacggtttcttcattgcgtctcgacgccgtctgcgcttcaatgagcaggcaatcccggcagaaagcgcaggcgcttgtgaaaaacgggctcgttaaggtgaattggaaagctattgaagatccgtcttatcaggttgctgaaggggacatgctctcgattcgcggcttcggacgatgcagtttggcaaaagttgacggaaaaacgaaaaaagacaaatggaaagttacatttgaacggcaaaaatgagtcgttttttcagtttttttctccatctgtgccgtatttgttttataatgtgaactagataaccgtactgaaatgtaaaaatggaggtggcaatatgccattaacgccgaatgatatccataacaaaacgtttacaaaaggttttcgcggatatgatgaagatgaagtaaatgaatttttaatgcaggtcagaaaagattacgaaatcgcactccgtaaaaaaacggagcttgaggcgaaagtgaacgagctggacgaaaaaatcggccactttgccaatatcgaagaaacgctgaataaatcaattctcgtagcccaggaagccgcagaagacgtaaagcgcaactcgcagaaagaagcgaagctgatcgtccgtgaagcagaaaaaaatgccgatcgcatcatcaatgagtcgctttccaaatcaagaaaaatcgcaatggaaatcgaagagctgaaaaaacagtctaaagtcttcagaacacgtttccaaatgctgattgaagcgcagctcgacctgctgaagaacgatgattgggatcatctgctggaatacgaagtcgacgcggtatttgaggaaaaagaataattttctgattttcttgacattcttcggcccgttcgaatataatacgttcataaattcagatgaaaagacgattgaaagggaccggcatgactcaaaacaggctataaagcgaaccggggaaggtgaaagcccgggatggccggaatcatgcagatcagccctttagtttcctttctgaaccgagagtaggaaaggacgttccatcacgttacgatgttcgagaggaaaagacggatgatccgttttttctaaaagggtggtaccgcgagataagctttctcgtcccttatgggatgagagggctttttttattttctgaaaaatgttgtggaggaatgaaaatggattacaaagatacgctgttaatgccgaaaacagattttccgatgcggggaaatctgccgaatcgtgagccggacatgcaaaaagactgggaggagcaggacatttaccgtcttgttcaagaacggacgaaagaccgcccgaaattcgtgctgcatgacggacctccttatgcaaacggagacatccacatgggccatgccctgaacaaaatcctgaaagacttcatcgtccgctataaatcaatgagcggctacaacgcaccgtacgtgccgggctgggatacgcacggactgccgattgaaacggcgctgacgaaaaacaaaaaagtaaaccggaaagaaatgtccgtcgctgatttccgcaagctttgcgaagattatgcatggcagcagatcgaaagacagcgcgaacaattcaagcgtctcggcgtcagaggcgattgggaaaacccgtatgttacgcttcagcctgaatttgaagcgcagcagatccgcgttttcggcgagatggcgaaaagaggctatatttataaaggtctgaagccggtcaactggtcgccttcaagtgaatctgccttagcagaagcggaaattgaatatcaggacaaacgttccgcgtctatttatgttgcgtttaaagtgaaagacggtaaaggcgttctggaaaacggagaaagcttcatcatctggacgacgacgccgtggacgatgcctgccaacctcggaatttccgttcatcctgatcttgaatacaatgtcatcaaggttggagacaagcgttatgtagtggcggctgaactgatcgaaaacgtagcggaggcatgcggctttgaaaatcctgaagttgtcgcatcatataaaggcagagaattagaatacatcactgcagaacatccgctgtacggcagagattcactcgtcatgctcggtgaccacgtcacaaccgatgccggaacaggctgtgttcatactgccccgggccacggggaagatgactttatcgtcggccaaaagtacggcttagaagtactgtgccctgttgatgaaaaaggaaacatgaccgacgaagcgccgggctttgaaggaatgttttacgataaagccaataaaccgatcacggagaagcttgaagaaaacggcgcgcttttgaaactcgagtttattacacactcctatccgcatgactggagaacgaaaaaaccgacgatcttcagagcgactgcgcaatggtttgcgtcaattaaagatttcagatccgatctgcttgatgccatcaaacaaacgaagtgggtgccggagtggggcgaacagcgcctttacaacatggtgcgcgaccgcggtgactggtgtatctcaagacagcgcgtctggggtgttccgatcccggtattttatgcagaaaacggtgagccgatcatcactgacgaaacgattgaacacgtgtctgagctgttcaaacagcacggctcaaacgtatggtttgaaagagaggcaaaagacctcctgccggaaggatttacacatccgggaagcccgaacggaatcttcacgaaagagcaagacattatggatgtatggtttgattcaggttcttcccatcaggccgttcttgaagaacgagatgatcttgtccgtccggctgatttataccttgaaggctctgaccaataccgcggctggtttaactcatctctttccaccgctgttgcagtcaccggcaaagcgccgtataaaggcgtattaagccacggatttacacttgatgcaaacggccgtaaaatgagtaaatcactcggcaatacgattgacccgacaaaaatcgcaaaacagcttggagctgaaattctgcgtttatgggtatcttccgtaaactatcaggccgatcacccggtttctgaagatattctgaagcaggtcgcggaagtataccggaaagtccgcaacacgttccgcttccttcacggcaacctgttcgattttgatccaagcatcaatgccgtggatgtaaaagatctccgcgaagtggatcaatatatgctgatcaagctgaataagctgatcgataaggtgaaaaaagcgtacgatgaatacgaatttgcggttgtttatcacagcattcacaatttctgtacgatcgagctcagctccttctatcttgattttgcaaaagatgttgtgtacatcgagcatgcggatcatccggaccgccgcagcatgcagaccgtcttttatgaaacgctgctggcgttagtgaaactgacggcgccgattctcccgcatacggcggatgaaatgtggtctcacttatcatttgttgaagaagcgagcgtgcagctgacagatatgccggaaaccattgctgttccggacagtcaggcgacagaagaaaaattcgaccgcttcatggagcttcgaaacgacgtgctgaaagctttggaaacagcccgtaacgaaaaaattatcggaagatcattggaagcgagccttactttgtatccgaacaaagaaaaccgcgacctcttgtcatccattaaagaaaacatcgcgcagctgtttatcgtctcagaactgacagtaaaagacgaaagtgaagcgccggaaaacgcgcaaagctttacaacaggaaaaatgaccgtagaaaaagcggaaggccagatgtgtgagcgttcccgcgtaatttctaaagatgtcggagccaatccgaaatatccgacattatcactgcgcaatgcggaaatcgttgaaaaatattatcaaaaataataaatgagaaagcgcccggtgtcagccgggcgcttttttacatgccagcaatgtcatcgattagaacggcaggaaaattcttatgggcttcaaatagcgctctgagggcaacaataaagctataacatcaagagcaggagttgtgatgaatgaatgatcaactgaccgcaatccacacggagcttctcatgatgaaagaagaacttcaatcaagattattcgaatattcttgctttcaaatgtcagcatctgttgaaccttcaatgaacgaccaagaagcaactctgatctatcatataaaagaagaacttcaggatgttcttcttgccctgtctaagtttgaaaacaatacgtacggttattgtgaaaaaacaggcgcccccattccgattgaaaaacttgcggtgctgccgacggccagaaccgctgatgatttttattatcccgctcaatttgaaaagaaaacccttccatactgggtaaccggagattatgcatatgatcaggcgctgtatgagtgacagcgtctgtttgcatacgcttatgatctgcctttactccggcatcttttactgataaaattcataaaggataaaagtaactgtatactggaggaacgtgtgtgctttattatcttatcgctctttttattattattgccgaccaattgaccaaatggcttgtcgtcagccatatggaattgggacaaagcatacctgtcatcgaccaggtgctttatatcacatctcatcgcaacacgggagcagcgtgggggattttagccggccaaatgtggtttttctacgtcattaccatcgccgtgattatcggaatcgtttattacatacagcgttatgcaaaagggcagatgttactcggaatttctctcggcttaatgctgggaggtgcggccggaaactttattgaccgggcggcgcgccaggaagtggtggattttattcatgtcatcatcgtggattatcactatccgatttttaatatcgcggactcctcactgtgcgtcggtgtaatacttttatttattcatatgctgtttgacagcgggaaaaagaaggagcaataacatgaatcaatttgagataaccgttcagcctgaacaaaagagcgaacggattgataaatttttggcttcaacgggagaaaactggtcacgcactcaagtgcagcaatgggtaaaagagggactggtatccgttaacggcaaatccgtaaaagcgaattataaaatgcagcccggcgatcaggtaaacgtcaccattcctgaaccggaagaattggacgtgcttgcagagccgatggatttggacatttactatgaagaccaggatgtcttggttgtgaacaaaccgcggggcatggtcgtacacccggcgcccggccatgtgacagggacgctcgtaaacggactgatggctcactgcaacgatctttcaggcattaacggcgtcatgcgcccgggaatcgtccaccggattgataaagatacctccggcctgttaatggtcgccaaaaacgatatggcgcatgaatcactcgttaatcagctcgtcaataaaaccgtgacgagaaagtacacagcggttgtccacgggttgatttcacatgatgacggaacgattgacgctccgatcgggagagataaaaaagaccgacaaagcatgaccgtaacaagagaaagcagcaaaaacgccgtcacgcatttccacgtgcttgagcgttttcaagacttcacgctcgtagagtgccgtcttgaaaccggaagaacgcatcagatccgtgttcatatgaaatatatcggatttcctttggcaggcgacccgaagtacggaccgagaaaaaccattgatttcaacggtcaggcgcttcatgccggaatattaggttttgaccatccgcggacgggcgaatacatggagtttgaagcgccccttcctgaagatatgaaaaaactcattgaacatttgagaaatagccattgacagcgagtttcttttctgaaataataaaaacaagctgaatagattctttaacacagtccagagaggctgagaaggataacggataggacagaagagatacacgtgtgtcttggtcctggaaaggaacccctctatgctctggcaggaggggttttttcttcttatatacgaatggagaggtgtcacgattgaatcaaaaagctgttattctcgacgaacaggccatcagaagggcgctgacaaggatagcccatgaaatgatcgaacggaataaaggaatgaatgactgcattcttgtagggattaaaacaagaggtatttatttagcgaagcggctggccgagcggatcgaacagattgaaggaaatccggtcaccgtcggggaaatcgatatcaccctttaccgtgacgatctcacaaaaaaaacgagcaatgaagagccgcttgtaaaaggcgcggacattccggccgatatcacagaccaaaaggtcattgtggttgatgatgtgctttataccggccggacggtgagagctgcgatggatgctctcgttgatgtcgggcggccgtcatcgatacagcttgccgtgcttgtcgacagaggacaccgggagctgccgatcagagcggactatatcgggaaaaacattccgacctcaaaagctgaaaaagtgatggttcagctgagcgaagttgatcagactgatatggtcgccatttacgaaaatgaataaccaccctttttaaatgcattccagagagtttgcaaagaggattttaaaacacaaagccgggcggatcgacacggccgggctttgtatgcctctttgcgcaaaaagcaaagaggtttttttataccatttgaaagtcaaccgggaggaaaacgccatgagtaagaaaaaagtaaacctgggagtcagggacgtccccaatccattgtcctggctgtcattcagcctgcagcatttattcgccatgttcggttcaaccatactcgtgccgaaactggtcggaatgagcccggcagtggcgcttgtcacgagcggaatcgggacactcgcctatctcttggtgacaaaaggccagattcccgcttatctcggctcatcattcgcctttatatcaccgattatcttggtgaaggcgacgggagggccgggggctgccatggtcggcgctttcctggcgggaattgtgtacggcctgatcgcgcttctcatcaggcagcttggaacggggtggctgatgaagctgctgcccccggtggtcgtcgggccggtcatcatcgtcatcggcctcggactggcaagcacagccgtcaatatggcaatgtatgctgatccgaatgcgaaggaactcgtttacagcctgaaacatttcagtgtagccggcgtcactttggccatcaccattatctgcgccatctttttacgaggatttttaagcttgattccggtattgatcggcattataggcggatatctgtttgcgctgacacagggcatcgtcaattttcagccggtcattgatgcaaaatggttcgccgttcctgaatttatcatccctttcaaagactacacgccgtcagtgacattgggcattgccgctgcgatggtgccggtcgctttcgtgacgatgtcagaacatatcggccaccaaatggtgctgagtaaagtcgtcggacaggattttattaaaaagccgggactgcaccgctccataatgggggacagcgtagcgacgattatcgcttcgttaatcggcggcccgccgacgacaacatacggcgaaaacatcggtgtcctggcaattacgagagttttcagcgtctttgtcatcggcggcgcaggagtgattgcgctgtgcttcggatttatcggcaaagtttcagcgctgatcagctctgttccgtccgcggttatgggaggcgtttccttcctgctcttcggaatcattgcctccagcggcttgagaatgctgattgacaacaacattgattatgaaaacaagcgaaatttaattatcacatccgtcatcctcgtgatcggcgtcggaggggcttttattcaagtatcaaaaggcgggttccaaatatccggcatggcgcttgcggcaatcgtcggagtcatcctgaaccttatcctgccgcatgcaaatgaagaagacgcgattgcatcggaaaaactaaatcatatgtaaaccttttaaagaaagtccagagaggcttggaagggttataacgggaagacgctgtacggctcttctctctttaaccgcaccccgagtctatagaccggggtgttttttacggccttcaagcggaaacggaggagaaaaaacatgaatcatttaacggcgatgtctgaactgagcgcggctgaaattacagaactgctgcgagaggcaaaagcgataaaagagggtgcagtccgtcccgatctcgcgggaaaattcgttgcgaatctgttttttgaaccgagcacgagaacgcggttcagctttgaagtggcggaaaagaaactcgggatgaacgtgctcagcttagacggcacgagcacaagcgttcaaaaaggcgagtccttatacgacacggtcaaaacactggaatcaatcggagcggacgcctgcgtcatcaggcacagcacggatgaatattacaaagatctgaccggcagagtcaatattccggtcttaaacgcaggagacggctgcggacagcacccgacccagtcattgcttgatttaatgacgattcaagaggaatttgagacctttcagggcctgacggtttccattcatggcgatatcaaacacagcagagtggcaaggtcaaatgccgaggtgctgacaaggctcggcgcacgtgtgctgttttccgggccgccgcagtggcaggatgagaaaaacgccttcggcacctgtgttcagacggatgaggccatacaagcttcagatgtcgtcatgctgctccgcatccaaaatgaaaggcatcagacagaagccgaccaaaaaggctacctggaagcatacgggctgaccgaaaagcgggcgcagagcatgaagcggcatgctatcatcatgcatcccgcaccggtgaacagaggagtcgaaattgacacaacattagtggaatgcggaaaatcaagaatctttaaacaaatggaaaatggtgtgtatatcagaatggcagtcttaaaaagagcactgcaaaccaatgtgaaaaggggagaagcggcttatgtcttatctcattaaaaacggctggatattaaatgaacagggagaaaaagcggtacatgatatccgggtaacgggtgaattcatttcggaaaccgggcttctgacagcgaaagacggagaaacggtgatcgacgctgagggactgttcgtttcacctgggctcgtagaccttcatgtccacttcagagaaccgggcggcgagaaaaaagaaaccattgagacgggctctaaagccgcggcgcggggcggttttaccacagtcgccgccatgccgaatacaaggccggtgccggatacgaaagagcagatggaatggctgcaaaacaggatcaaagaaacctcatctgtcagggtccttccttacgcatcgattacgatcagacaaaccggcgaagagatgacagattttgaggcgcttcatgaagcgggcgcattcgccttcaccgatgacggcgtcggagttcagacggccggaatgatgtatgaagccatgaaacgggcggcttcaataaataaagcgattgtcgctcattgtgaggataactcacttatttacggagggagcgtgcatgaaggttctttttcaaaagcgaacggcctgaagggtataccttccatttgtgaagcggtacatatcgcccgtgacgtgctgctggcggaagcggcgggctgccattaccacgtgtgtcatatcagcacgaaagaatccgtcagagccgtaagagacgcaaaaaaagcgggcatccgcgtgacggcggaagtatcgccgcaccacctgctgctttgtgacgaagatatcccgggacttgataccaattttaagatgaatccgccgcttcgcagcaaagaggacagagaggcgctgattgaagggcttttagacggcacgattgatttcatcgccactgaccatgcgccgcatacagaagaagagaaaaacacggacatgaagcttgcgcctttcggtattgtcgggttagaaactgcctttccccttctgtacacacattttgtgaaaaacgggacgtggacgctgaagcagctggttgatttcatgacggtaaaaccttgcgaggcattcggtcttccgtacggaacgcttgcaccgggggcgccggctgacatcaccctaattgatctggacaaagaagcggccattgacaaagatacatttttatctaaaggaaaaaatacgccattcaacaagatgaagtgcttcggctggcctgttgcaacgatggctgccggtaagcttgcatatgaagaagggagactcgtcaaatgaaaagaagactagtgctggaaaatggagcggtatttgagggtgaagcattcgggagcctggagcataccgcgggtgaagtcgtattcaacacgggaatgaccggttatcaggaaattttatcagacccttcttactgcgggcagatcgtgacgctgacgtatccgctgatcggcaactacggaattaacagagatgactttgaatctatcactccttttgtaaaagggctgatcgtaaaagaactgtgcgagctgccttccaactggcgctcagcttacacgcttgatgagtatctgaaaatgaaaaaaatccccggcttacaagggatcgacacgcgaaaactcaccagaatgatccgcacggccggggcattaaaaggaacgtttgcttcaagtgaggagaatgtcggagaggttcttgcaaggctgaaagaaacggaactgccgagaaatcaagtcgctcaagtatcggcgaaaacggcatatccgagtccgggccgcggcaaacgcatcgtgctcgtcgatttcggtatgaagcacggcatcttaagagagttaaacaaaagaaaatgcgatgtcatcgttgtaccgtacaatgtaacggcggaagaagtgcttcagctcaagccggacggcatcatgctttctaacggacccggagatccgaaagatgtgccggaagccattgaaatgataaaaggcatactcgggaaggtgccgttattcggaatctgtctcggccatcaattatttgcgctggcatcgggagcggaaacggaaaaaatgaaattcggacacaggggttccaatcatccggttaaagagcttgcgacagggaaagtcgctttaacagcccaaaaccatggatatacagtttcttcaatagatgagacagagcttgaagtgacgcacattgcgatcaatgatcaaacgatcgaaggactcaagcataaaacattgccggcatttacggttcagtaccaccctgaagcttcaccgggaccggaagacgccaatcacttatttgacagattcattgacttgatcgaaacaactgagaaagaaggggaagcggtatgccaaaacgcgtagatattaaaaagattttagtgatcggatcaggcccgattattatcggacaggcggcggaatttgattatgcgggcacacaggcgtgtctcgctttaaaggaagaaggctatgaagtcattctcgtcaactcgaatccggcaacgattatgacggatacggaaatggctgatcgggtatacatagaaccgctgacgccggagtttctcacgcgtattatcagaaaagaacggccggacgccatcctgccgactctgggaggacagaccggactgaatcttgccgtcgagctgtctgaactcggggttcttgaggaatgcggagtggaagtgctcggcacaaagctgtccgccatccagcaggctgaagaccgcgacttattccgtacgctgatgaatgagctgaatgaaccggtgccggaaagtgagatcatccgcactttacaggaagccgaggaatttgtcggccggatcgggtttccggttatcgtgcgccccgcttacacattaggcggaacgggcggcggcatctgctcgaatgaagcggaactgaaagagatcgtcgaaaacggattaaagctcagccccgttcatcagtgccttctggaaaaaagcatcgccggttacaaagagatcgaatatgaagtcatgagagacagcagagatcacgcgatcgtcgtctgcaacatggaaaatatcgatccggtcggcatccatacgggcgacagcatcgtcgttgccccgagccagactttgagcgaccgggaatatcagcttttgcgcaatgtttcattaaagctgatccgcgcgctcggcattgaaggcggctgtaatgttcagctcgcgctcgatcccgacagcttccaatattacattatcgaagtgaatccgcgagtgagccgctcatctgccctcgcttcaaaagcgacgggttacccgatcgcaaagcttgcggcgaaaatcgcagtcgggctttctcttgatgaaatgatgaatcccgtaacgggaaaaacatatgcggcttttgagcccgcgcttgactatgtcgtttctaaaatcccgcgctggccgttcgacaaatttgagtcggcaaaccgcaggctcgggacgcagatgaaagccaccggagaggtcatggccatcggacgcacccttgaagaatcgctgttaaaggcggtccgctcactggaagccgatgtctatcacctggaactgaaggatgcggaagagatttctgacgggcttttggaaaaacggatcagaaaggccggagatgaacggctgttttatcttgcagaagcgttcagaagaggctacacagtggagcagcttcatgagttttccgcaattgacgtattctttttgcacaagctctgtaagctggtcgcttttgaaaccgagctgaaagcggaaaaaggcagcctcgccgtcctgcagacagcgaaggaactcggtttctccgacaaatatatcagccgggaatggaatatgccggaacaagagctgtatcaaatgcgaaaagaagcagccatcaagcctgtatataaaatggtggatacatgcgcggcggaattcgaatcagaaaccccgtacttctacagcacatatgaggaagaaaacgagtctgaggtaacatcaagaaaaagcgtcgtcgtcctcggctccggcccgatccgcatcggacagggcgtcgaatttgactatgcgaccgttcactctgtctgggcgattaagcaggcaggatatgaagcgattattatcaacaacaaccctgagacggtgtccactgatttcagcatatcagacaaactgtattttgaaccgctgacggtagaagatgtcatgcacatcattgatttggaacagccggaaggcgttgttgtccaattcggcggccagacggcgatcaaccttgcggaagaattgagcgcccgcggcgtcaaaattctcggtacatcacttgaagatttagaccgtgcggaagaccgggataagttcgagcaggcgcttgaggcgctgaatgtgccgcagccgctcggaaaaaccgccgtgtcggtgaacgaagcggtcaaaatcgctgcatccatcggctatccggtacttgtccgcccttcgtatgtgctcggcggccgggcgatggaaatcgtctatcacgaagaagaactgcttcactatatgaaaaatgcggtcaaaatcaacccgcagcatccggtgttaatcgaccgttatctgacggggaaagaaatcgaagtcgatgccgtatctgacggcgaaacagtcgttattccggggattatggagcatatcgagcgggccggcgtccattcaggggattcaatcgccgtctatccgcctcagtctttaagcggagacattaagaaaaaaatcgaacaatacactgttgccttggcaaaaggccttaacatcatcgggttgctgaacatccagttcgtactttcgcaaggtgaggtgtatgtgcttgaggtaaatccgcggtcaagcagaaccgtgccgttcttaagcaaaatcactaagattccgatggcgaatctggcgacaaaggtcattctcggccaaaagcttgctgatttcggctatcaagaggggctgcagcctgaacagcagggggtgttcgtgaaagcgcctgtcttctcattcgcgaagctgagaagagtggatatcacgttaggccctgaaatgaagtcgacgggagaggtcatgggcaaagattcaaccttggaaaaagcgctctataaagcgctgattgcctcaggcattcaaatcccgaactacggttcagtgctgttgaccgttgctgataaagataaagaagaaggactgctgatcgccaagcggttccacgccatcggctataaaatcttggcgacggaaggaacggcggcttatttgaaagacgctcagattccggctcaagtcgtcgggaaaatcggcgaagaagggaaaaatctgctcgatgtgatcagaaacggagaagcgcaatttgtcatcaatacgctgacaaagggcaaacagccggccagagacggcttcagaatccgccgcgaatccgttgagaacggagtcgcctgcctgacatctttagatacggccgaagccattttgcgggtattggaaagcatgacattccgggcggatcatatgcctgcatccgaaaccaatcaaaaggcggcagtcacgatatgaaaaaagcgcatttgactgttcaatccaacttagaaattgccgaccggatttataagatggtgctgaaaggagagcttgtccggcaccttaccgagccgggacaatttcttcatctgaaggtgagtgacgcggtcacaccgctattaagaagaccgctcagcattgcggacgtcaatttcgccgcggatgaagtatccgttatctacagagctgacggtgagggaacgcgccttttgtccgggaaaaaagagggcggcaaaatagacgttctcggccctctcggcaacggatttcccgtgcggcggattgaacccggcaaaaccgcgctgttagtcggaggcggagtgggggttccgcctttgcaggaactgtcaaagcgcctgacggaaaaaggcgtaaacgtcattcatgtgcttggatttcaatcagcaaaggatgttttttacgaacaggaatgccgtgcgtacggagacacttatgtggcgacggctgacggaacatatggagagaaaggatttgtcaccgatatcatccgtgaaaagcagctcgaattcgatgtcctgctaagctgcggaccgacaccgatgctgaaagctctgaagcagcagtacggccataaagaggtttatctttcgatggaagagcggatgggctgcggcatcggggcctgcttcgcctgcgtgtgccgcacgggtgaaagcgatacatcctatgtaaaggtctgccttgacgggccggtatttaaagctgaggaggtggcgctgtaatgttagaggtgaatctgccgggtctccaattgaaaaacccgatcatccccgcttccggatgtttcggtttcgggaaagaatatgccggattttacgatttatcatgccttggaggcattatgattaaagccacgacgaacgaagcccgcttcggaaatccgacgccgagagtggcggagacaagcgcgggaatgctgaatgccatcggactgcaaaatcccggccttgagcatgtgctcaatcacgagctgccttggctcgaacaatttgacacgccgattatcgcaaatgtcgccggttctcaggtggacgactataaagaagtggccgagcacatcagccaagcgccgaatgtgcatgcgcttgagcttaacatttcatgtccgaatgtcaaaacggggggattgcttttggtactgatcccgtcatggcggccgaactgacaaaagcggtgaaagaagtttccgcagtgcctgtgtatgtgaagctttcgcctaatgtcgcaaacatagccgaaattgccaaagcgattgaagcggccggtgctgacggtctgacgatgattaatactctcatcgggatgaggctcgatctcaagacgggccggccgattttagcaaataaaacgggcggactgtcaggcccggcgatcaaaccggtcgccatccggatggtatacgaagtcagccaggccgttcaaattccgattatcgggatgggcggcgttcagaccgcagaggatgcattagaatttcttcttgcgggagcgagtgcggttgccgtcggcacggcgaacttcgtcaatccgttcgtctgcccggaaatcatagaacagctcccccacgtgctgcgccaacacggctttcaatctgtaagtgaatgcatcggaaggagctggaaacatgaaaaacaacctgcccatcatcgcgcttgattttgcatcaggggaagagactttaacgtttttagacttgtttgaaaaggaaaggctctttgtcaaaacggggatggaacttttttatcaggaaggccccgccatcattcaccaattaaaagaacggaactgtgatatatttttagatttaaagcttcatgatatcccgactacggtcaataaagcgatgaagcggctggccggcctcggcgttgatctcgtcaatgtgcatgcggcagggggcgcacgcatgatgcgcgcggcccttgaggggcttgaagaaggcacgccggcaggcagaaaacgcccgtctttaatcgcggtgactcagctgaccagcacttcagagcaggtggcgaaggaagagcttctgctgcataagccgctgttagaaacggttgtgcattacggcaaaatggcggaagagtgcgggctggacggagtggtatgttcggtccatgaaacaaaagccatttatgaagcggtccggccttcatttctgacagtcacgccgggcatccgcaccgccagtgacgcagctgacgatcaagtccgtacggcgactccgtcatttgcgaaagaaaacggttcgtcagccatcgtcgtgggccgctcaattacaaaagcggaaaaccccgttaaagcatatgaagcaattaaactggaatgggagggcgttcgccgatgaaacaggctatcgcaaaacatctattacacattgaagctgtctttttacgcccgaat

(The sequence listing continues in the following parts.)

The invention claimed is:

1. A feed additive or food ingredient comprising a probiotic composition comprising an effective dose of a combination of a first isolated live *Bacillus amyloliquefaciens* strain and a first isolated live *Bacillus subtilis* strain and a carrier suitable for animal administration, wherein said feed additive or said food ingredient reduces or inhibits the colonization of an animal by *Clostridium perfringens* upon administration to the animal in an effective amount as compared to a corresponding animal not administered the feed additive or the food ingredient; and wherein the first isolated *Bacillus amyloliquefaciens* strain comprises a nucleic acid sequence having at least 99% sequence identity with SEQ ID NO: 261; and wherein the first *Bacillus subtilis* strain comprises a nucleic acid sequence having at least 99% sequence identity with SEQ ID NO: 16; and wherein the carrier is an edible food grade material or an animal feed and wherein the effective dose ranges from $1\times10^3$ to $1\times10^9$ CFU/G of the combination.

2. The feed additive or the food ingredient of claim 1, wherein the first isolated *Bacillus amyloliquefaciens* strain and the first isolated *Bacillus subtilis* strain are present at a ratio of 0.75-1.5:1.

3. The feed additive or the food ingredient of claim 1, wherein the carrier is selected from barley, maize, oats, tapioca starch, oilseed cakes, vegetable wastes, mineral mixture, gelatin, cellulose, carbohydrate, glycerin, starch, water, rice hulls, glycol, molasses, calcium carbonate, whey, sucrose, dextrose, soybean oil, vegetable oil, sesame oil, and corn oil.

4. The feed additive or the food ingredient of claim 1, wherein the first isolated *Bacillus amyloliquefaciens* strain comprises a nucleic acid sequence having SEQ ID NO: 3 and the first isolated *Bacillus subtilis* strain comprises a nucleic acid sequence having SEQ ID NO: 14.

5. The feed additive or the food ingredient of claim 1, wherein the first isolated *Bacillus amyloliquefaciens* strain is strain ELA191006 deposited under the deposit number PTA-127065; and wherein the first isolated *Bacillus subtilis* strain is strain ELA191105 deposited under the deposit number PTA-126786.

6. The feed additive or the food ingredient of claim 2, wherein the ratio represents the number of viable spores per gram dry weight.

7. The feed additive or the food ingredient of claim 1, wherein the first isolated *Bacillus amyloliquefaciens* strain and the first isolated *Bacillus subtilis* strain are not genetically engineered.

8. The feed additive or the food ingredient of claim 1, wherein the administering is oral.

9. The feed additive or the food ingredient of claim 1, wherein the animal is poultry or swine.

10. The feed additive or the food ingredient of claim 9, wherein the poultry is chicken, broiler chicken, an egg-producing chicken, or a turkey.

11. The feed additive or the food ingredient of claim 1, wherein the first isolated *Bacillus amyloliquefaciens* strain and the first isolated *Bacillus subtilis* strain are in the spore form, or are lyophilized or dried spores.

12. A method of reducing or inhibiting the colonization of an animal by *Clostridium perfringens*, the method comprising administering to the animal an effective amount of the feed additive or the food ingredient of claim 1, wherein the reducing of the colonization is when compared to a corresponding animal not administered the feed additive or the food ingredient.

13. The method of claim 12, wherein the animal is poultry or swine.

14. The method of claim 13, wherein the poultry is chicken, broiler chicken, an egg-producing chicken, or a turkey.

15. The method of claim 12, wherein the administering is oral.

* * * * *